United States Patent 8,781,750 (CELL-TYPE-SPECIFIC PATTERNS OF GENE EXPRESSION) - sequence listing, part 28

SEQ ID NO: 36902 - DNA, 194239 bp, Homo sapiens
ttcaagtgattctcctgccttagcctcctgagtagctgggactacaggtgcccaccaccacgcccgggtaatttttttttttttttttgtatttttagtagagacggggtttcaccgtgttagccaggatggtctcgatcttctgacctcgtgatccgcccacctcggcctctcaaagtgcagggattataggcgtgagccaccgcgcccggccaatgggcacatttttcatatcactaaaaatttcttttttattttttgagacagggtgttactctgtcacccaggctggagtgcagtggcgcaatctcggctcactactaaacctccgcctcccgggttcacgccattctcctgcctcagcctccggagtagcaggaattacaggcgcaagccaccacaccccactaatatttttgtatgtttagtagagacggggtttcactgttggccaagctgttgtcaaactcccgaactcagctgatccgccggcctcggcctcccaaagtgctgggattacaggcgtgagacaccgcgcccggcctcctaccactaaaaattcttcggaagcactgtttcaaatcacgcagagcacttagagttttcccttttctcagctactgcgctgttgggggaagggggacctcaagtgtttgcaaaataactgtgataattacctttgtagataaatctctgagtataagtttttgaggtcaaggttcgaaatggaacaaattcctttctacaaaggccaggaccccttggcccttccgcccggtgcctggctccccctgacatcagcctcttggttcgtttgtggaagagcagctctattgagatacaactcttgtgattaattcatgtaaaatacacggttatgtcgggtcatgtcacagcaggggcgaccatcgcgggtcccacgcgcggccccgggcaggaccagcgtcccgggccgggggctgcagggcagggcagggcagggcagggcagggcagggcagggcagggcagggcggggcgcggggctggggcggggtctgcgggccgggggcggggctgcggggggcgcggggctggggcggggccggggtctgcgggctgggggcggggccgcggggggcgtggccgcgggggcgcgcggggatatccgggggcgggggcgccggcgcggcgcatgcgcgctgcattgttttgactgaaaatgccgtcggtttcgaaagcggcggcagcggcgctgagcgggtcccccccgcagactgagaagccgacccactacaggtcagcgcccgtccggcctgcggccccccgcccgcgcccggtgcagctcggagcctcccgccggggctcgcgccgcctccgccgcccccgcgccccccggcctccgcgcagcgcctgggctgggggggccacgaccctctgctctcggcggcctccgcctgaggtcggagcgcggcgcccatggtctgggatggcacctggttccggggtccacgcgcctctggggagggaggaacgccccggggttgggggttgcgcctgggctcggggaccgggaccctctgctccggctgccgaccgtgaggtcacagcgggtcgcccagggtccggggtggcgcttgggcttggggaccagggtcagcgcctgggctacgaggtcgggtgagggtcgcgtctggagtcgggatgggggtgggcgcagcgcctggggcccgccgggaatgtgagtacgggtcgaccctgggttgaggctcctgaggccggtgggtcccgccgcccacgagtccgagtccctggaggtgctgccggaagcgagccgcggcgctgtctgtgtttgtaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtaagcggccgcgagggggcgccgctgcctgggcggaggtggggggcctccacccggggatgcggccgggaccctcagcggacgccttagtgtccatacctggcccctgcagagggagtcgtaattatacgctgaaattttctagtgaccagggatgctggggcggcatttcctattctcaggccagttcccgagggattatgtgtgttttaggggtaacccttgtgtgactcaaaccaattttgcttcacctcccacttttttttgtttgttttttgagacggagtttcactcttgttgctctggctggagtgcaatggcatgatctcggctcactgcagcctctacctcccaggttcaagtgattctcctgcctcagcctccggagtagctgggattacaggcatgtgccaccatgcccagctaattttttatttttagtagagacagggtttctccatgttggttaggcttgtctcgaactcccaacctcaggtgatccacccacctcggcctcccaaagtgctgggatgacaggcatgagccaccgtacccggccccactttttttttttttttttttttttttttttttttttttttgagacagggtcttgctctgtcgctggggctggagtgcaatgataggatacggctcactgcagccaccaactcctaggctcaagtgatcttcccttctcagcctcccaagtagctgggactacaggctcatgccatgccagctaattttgcatagtttttgtagggatggggtctcactacattgcccaggctggtcttgaacttctgggctcaagcaatcctcctgcttcagcctcccaaagtgctgggattccaggtgtgagccactgtgcctagctgtttcccactctgatttgacacagttcctgcatgagaaccaacctctggccaagtgccttgttttgtgtttctatagagacagggttcttgctgtagcctggtctggtctcaacctcctgggcacagcgatcctccctccttggcctcccaaagtactgggattccaggcatgatccactgcgcccggccaggttttgaagcgttttgtagtggtcggttgctttccacacagagagcttgttagaatattcacgctgtagaatatatctgggatgtttcgtctcttgatgtttacgtatttattttaattttaagacagtaaagtttttatgtgcaggctcatttatgtagcatcgagactgagtctcgctctgtcacccaggttggagtgcagtgacttgatcttggctcacggcaacctctgccttgtgcaggtttaagtgacctgcctcagcctcctgaatagctgggattacaggcacccgccaccacgcctagctaagtttttgtatttttaatagagttgaggtttcgccatgttggcgaggctggtctcgaactcctgacctcaggtgattctccctccttggcctcccaaagtgctgggattacaggcgtgagccaccacgcctggcccctatgtagcacttttaaagttaagaaatcaaggttttgttttggttgatttttttctttttttacaaggttcctaatagtgttatgaacagatgtctttattctgaagtatgcaaaatgggaaaacagggaaaatacaagtcagattatatattcacagactggcgggaggtggtatcaggttctacttgcttcctgtgggctgctggcggagggtggagggcggagggtggtccattcctgcctaggggtgagacagcagcagttgcggtcttgaagtcttcatcccctgatcttttggaaggagctgattctccagggaccttcctgttgaaggctgctttcagcacggagatccttgtgaagtctgttttcctttattttttcaacagtgcttagcctaggcgataaattaaaaaaaattttttttaaggacgctagaaactttaaatactgaaatgtttttaattgtacattagttaaatagtgtttgttttgtttttgttttgagacgaagtctctgtcacccaggctggagtgcagtggcgccatctcagctcactgcaacctccgcctcccaggttcaagcgattctcctgcctcagcctcccgagtagctgggattacaggcgcgtgccaccacgcccagctaatttttgtatttttagtagagacgggatttctacatgttggtcaggctggtcttgaacttctgacctcgtgatctgcccgcctcggcgtcccaaagtgctgggattacaggcatgagccaccgcgcccggctgtttttgttttttgagacagggtcttgctctgtgccctgggctggagtgcaggggcatgaacacggctcactgcaacttgaacctccagggctcaaaccatcttcctgcctcagcctcctgagcagctgggaccacaggagtgctctatcactcctggctaatttattttattttatttattattttgtttttgagaccgagtctcactctggttgcccaggctggagtgcagtggtacgatctcagctcattgcagcctctacctcctgggctcaagtgattctcccacttcagcctctggagctatagactctctacaccacgcctggctaattgtttttgtatttttagtagagaaggggttttgctacattgtccaggctggtctcagtctcaaactcctggacccaagagatcctcccaccgcagcctcccagagtgctaggattacaggtgtgagccaccacacacctcggctcatttttaatttttttgtagagatggagtctcgctgtgttacccggcctcaagcgatcttcccaccttggcctctccaacgtgcagggattataggtgcaaaccaccacacccggccatagtgttgttaaggcaggttgatgcctaaacttgaaataatgtagtcagcccattttggttaggatggtgatgtacttcaaggcggttctgaaagtgcataattgaattggtttttaagccactgttttccgcaaatggggctttcaaaggcaggtatttgtctagttgatgtctgggctcagcccctgatttcccttggtcaagccccttatctgcccagacctgggatcctgagttgcaagtagggccactgctgcttaactctggtgtgggggtcctggaagtgtgaagacgagcacccagcctgtctgaccccactccagtgttgaatacagggcactgattggcagcactctatgtcacccaggctggagtgcagtggcgtgatctcggctcaccgcaacctctacctcccgggttcaagcgattctcctgcctcagcctcccaagtagctgggattacaggcatgtgccaccacgcccggttaattttgtatttttagtagagatggggtttctccatgttggtcaggctggtctcgaactcctgacctcaggtgatccacccgcctcggcctcccaaagtgctgggattacaggcatgggccaccgtgcctggccaggtgatgcttttaatgcataaagataaagcatctttttctctcttttttttttttttctgagacagggtcttgctttgtcacccaggctggagtgcagtggtgccattacagcccactgcagcctcgacctcccggacttaagcagtcctcccaccttagcctcccaaagtgctgggattacaggtgtgcagccctgcacccggcgagaaagcatcttttcataactgtttctttttttggagatggagtctcgctctcgctttatctaccagactggagtgaagtggtgcgatctgggctcctgtatcctctgcctcctgggttcaagcaattattgtacctcagcctcctgagtagctgggattacaggcgtgtgccaccatgcctggctaatttttgtgtttttagtagagatgggtttcaccatgttggccaggctggtcttgaactcctgacctcaggtgatccgctagccttggcctccaaaagtgctgggattacagacatgagccaccgcgcccggcctcataagtttttgttgcggagtctgggtgtcttggtgtggactcagcctcactgctaggcacagggtggtatccagttcttacagggatggacagtgctgtagtaagcgcctgcctctaggtggtcacttcaagctgtgctcaagtagcagttccataacatcattacaaaaatattagcctgctgtctgaatggcttacagtttataattgagggtggtaagtggggctaagatgcctgtttggtgttttgttttggatacctgggtatatgcacacatagtaaggaaatttccttattttatttaagattttgtttgtagcgtgtgaatgacttgcttcgaccggccctttaggaagtgtctgacaggctgcctcccctgagatctctcctccataattatccttcattccacgggagtgggactttctcatcgctgaacaaagggaatagccagtttgtcctattgaagtacccgttctggttctcattaagggttgcctcggaatttgtaaataaaggaacgttcagaataaggacagggccttccttttctttagttcattggtttttaaaatttctattttggctgggcgcggtggctcacgcctgtaatcccagcactttgggaggccgaggcgggcagatcacgaggtcgggagatcgagaccatcctacatggtgaaaccccgtctctactaaaaatacagaaaaattagctgggcatggtggcgggcacctgtagtcccagctacttgggaggctgaggcaggagaatggcgtgaacgtgggaggcggaggttgcagtgagccgagatcgcgccactgcactccagccttggcgacagagcaagactcaaaaaaaaaaaaaaagaaatttctattttgggtgttgatactaccaacctgttattttacacatgaatgtgtatcagagagcagagacccttagcccgtatcaggcgttgctcttggttgtggctggaggtgctggggctgagctgtggggcagagcaggactgggaccccaggagggccccccgctgctggcgtctcctttccacggcaggctggcacctcgctccacccctgcctgctcagttgctgcctctgtcagccccccctgggggcagccccaccggtaccagctcctgcggacgcctctgccgtcacccctccctccgtggagggtgacctcctacagcccctgctgtcatctcttctctcttcctcatcctatggctccccaggtcacttctcggcgtcctctatcctctgtgggcaccccctccggtgcctgcccccgtgggtgcccccactgtgcaccctttcctaggtgggtggctgccccttgttgcaccccacgccgtgccggtcctgtgggcatcagcgtgatctcggccccgccccgccccgctcgggaaaggccttttgttccgcgcgacacgcccctccgctgcgcgcccgcgattggctgtcccgggtcacgtgtgaagccccgcccccgtgggaaccgtcctggtcgttgggggggggggcagctcccatgtgggcgtggccttgaggccccgggggtgtagctgaggggcaggcgcttgcttttctctttaaacagattgcggtaaagaaatagaaaaggcgccccgcgggaccccgggcctctccagggtccatcttttttttgtttttcttttgagccagggtctggctctgtctcccaggctggagtgccgtggctcgatcttggctcactgcaacctctgcctcctggactcagctgatcctcgtgcctcagcctccggagtacccaagcgatccatatgcctaggcttcccagagtcctgagattacaggcctgaggcaccatgcccagcctctaggcccattttcattgggaaaaaaaaatacacgtggcctgcagctgtgtagccacagaacgagtggccatctgccagcccacccctgtccagaagagcgctcctgcactgtggccctgcagccaccctgggtctcgttctcagaaaaaacaggcttgccccattcctgtggtgccacttttccagattgacacacagacacaggtttgtccttttttttttttttttgacagggcctcactctgtcgcccaggctggagtgcagtggtgtgatcttggctcagtgcaacctcaacctcctgagctcaagtgatcctcccacctcagcctccaaagtagctgggaccataggcgcacaccaccacgcccagctgaatttttgtattttttgtaggggtggggtcttgctggtttcgaactcctgggctcaagtaatccacccacctctcctcccaaagtgctgggattacaggaatgagccactgcgcccggcctctgtcttctttccagagctctgtttggcggtgtcacctgacagacctgacacttcccgcttgccctgtgcgcctccccaggcctctgtcgtccggcaggtgcagaactcctgtctggatgggtccggggtgtgcctagctgggtctccactgtgcattctgtgagtaactggtgggaggagaaacttttccaagtatccatttctaagattaactgttgctgcttgtatctggcgggtctggagtctgatcttttttttttctttctttcttttttttgagatcgagtctccctctgtcacccaggctggagtgcagtgacacgatctcggctcactgcagcatccacctcccgggttcaagtgattctcctgcctcaacctcccgagtagctgggattacaggcgtgcgccaccatgcccaactaatttttgtgtatgtgtgtatttttagtagagatggggtttcaccatgttggccaggctgatctcttaactcctgacctcaggtggtccacctgcctcagcctcccaaagttctggaatgacaggcgtgagccactgtgcccggccaggagtctgatctttctattaaaagatcctcttgcaatatttaattttaaaatgttgaatgccttaggacctaaggcgtaggtgaaagttccactcacttcagggtgtgtagaatttgctgtttaaactgatctcatgatgagcttgggctttgggagcaagaggaaagcccacggccggcctgggacgtgcgagcagtctttaaaactcagaggcatccgggtgcagtggctcatacctgcagtccaaatacttcaggaggcctaggcaagtggatcgcttgagcccaggagtttgggaccagcctgggaaacagcaagattctgtctctacaaaaaaattaggccgggcgcggtggctcacgcctgtaatcccagcactttgggatgccaaggcaggcggatcacctgatgtcaggagttcaagaccagcctggtcaacatggtgaaaccctgtctctactaaatatacaaaaattagccaggcatggtggcaggtgcctgtaatcccagttactcgggaggctgaggcaggagaatcgcttaaacgcaggaggcagaggttgcagtgagctgagattgtgccactgcactccggcctgggcaacagtgagactctgtctcaaaaaaaaaaaaaattagcaatatagcccggcatgggagtacgcctgttcctcccatcacccccagctgtttcagtgctgtgctctgggccccccacctatgcctgcgtccttaagctggaagggagtcgtgtacactgcctgtctcctaagcccggtggttctcgcacgttccctgggaaccagccggcagtgcagatccacgggcctcgtccacaccagctggggggaccacatgggccacgggcctcctaggtgattttgatgcatgtggctcgcagtctcgagaatgtgttaagggggtctggtggaccctccttgggttcaggtgagagcttcctgagggaagggcagcttcttgcactccaggatctggctgcctcctatcctctggtctcggtgggtccagggcattggagcgtgaggcagagcggtgcccatgtgctgggtgtaatcacgtggctctgctcactgattgtctcggatgagtttgagaaccgtgtttgtcacccgacccccgggggctcgtgcgtcccctccttgggcatccgtgagcaatggctctgtgctttctcttaggtattccctctcacctcctaggtgtccgtaagagtaaggcattttcttaaaactttttccagtttcttttttttttttgagatggagttttgcccttgtcacccagcctggagtacagtggcgcgatctcggttcactgcaacccccgcctcccgggttcaagtaattccctgcctcagcctcccgagtagctgggattataagcgcctgctatcatgcccggctaaattttgtatttttagtagaccagccaggctggtcttgaactcttgagctcgtgatccacccgccttggccttccaaagttctgggatcacaggcgtgagccactgtacccagctgcctggctggctgcctgccttccttcctttctccctccctccctccctgtctttctttcctctccctccctcccttccttcctcgcctcctttttttttttttttttttttttttttttgagacagggtcttgctctgttgcccatgctgaagtgtggtggcacaatcacgactcactgcagccttggccttttgggctttaagcgatcctccctcctcagcctcccaagtagctgggaccacaggtgtccaccaccacgccgggctaatttttaaatttgttgtagagatggggactcaccatgttgcccaggctagtcttgaacccctagcctcaagcaatcctcctgtctctgccccccaaagtgctgggattacagatgtcagccagtgtgccagtccttccttctaagtctgaaaaataccccactgtgtggctggaagcccgcgtttaccccattgtgtggatagaagcccacgtttaccctgtcttgtggacggaagcctgcgtgtaccccgtcacgtggatggaagcccgcattaaccatgttgtgtggatggaagcccgcgctttccttattgactccattggcgcccacttgggtggtttctgcctcttggctcttgcgaatgacgctgctgtgaacatgggtgtgcaggtgtctcctgaagaccctgcctccaggttttttggatgtgtacttaggagcaggatcgctgggtaccaaggtagcgttgtaatttgacttttgcttggctggctcctggggaccctgagagccagccaggcaccccttcttctgcctctgtcgaccctcagctttcagtgtctggcacatcacaggtgcccagcggagcctgggtcggcctctctgaactctgtgtctctgtttcctgaccttagaggatggggctagacctggtgttgctgaatcgctcttggtccccagccatccctggctggagctcctagtgcccaggctgcagccctgtgcacagtgaggtgggcggggccctcacggagctccccagttggagctggaggtgaaggtttcagtccttacatttgggggcctgcagtgacggcccatgtcatcctctgccttggcccttgggccactcagggtgattctgtgaccagccagggctcgacaccattgatgactcagggtcctctgtgcgtccctttgcctccttctggagtgacctacctggaggcgcccaggaatgccagagcggtttgtgtcgtctccttgtctccgtcgctgctgcctgcctatgacttgagccttggcagctgcttcccctctccactgcaccccatcgtgcttcaggagctgcctgtgactccccaggagcatggctctgggcctgcaggtggcccatgggatggtgatgctacctcacctgtgttccccaccacgccatctgccgcctcttctgcccatccccctcgtgtcccccaagccgcgtccagggccctgtgcttgttccctcccctacctccctcctggggtccctgaaagcagcaggacgctgggcaggaggggcccccactttgtgactgcgacgggtaaggaaggtgacgcagcctgcgtgcagggcatgaactctcattcccacacaggtttaaaggtttatttggaacattaggaaggatgagctttgtggaaattcagcattgtgtttcctgctgtgtttggctgactgggggtttgcgatggtctgtgtttcttactgtgtttgactggttgactgggggtttgcggtggtctgtgtacctgggcggttccacatttggggacaggtgctgcgtccagtgtgtccgtccttctgattagaacaggaatctggaagaagggaagggaattcactgcttgccacgtgctgacagggcgtggacccagggagcttagggctgcctctgggtccatgataaccaggcattgcgtgcctctctgctccccaggtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcaggtgagtgggcatccacgagtgggcacttggcctgcctgctgctgtgggctctgctggatgagcaggaactcggcaagtggctcgcctccctgctgctgcaggctctgctggcccaaatctctctcctccagaatttctttctgagtctggatgttagtcctttttttgctttttttgagacggattctcgttctgtcacccaggctggagtgcagcggcgcgatctcagctcactgcaagccctgcctcctgggttcacaccattctcctgcctccgctgcccgagtagctgggactacaggtgaccaccaccacgcccagctaattttttttttttttgtatgtttagtagagatggggtttcaccatgttagtcaggatggtctcgatttcctgaccttgtgatccacccacgttggcttcccaaagtgctgggattacagtgagccactgcgcctggcctctggatgttatttctttcttttcttttctttttttgttttttgagatggaatctcgctctgttacccaggctggagtgcagtggcgtgatcttggctcactgcaacgtctacctcctgggttcacgccattctcgtgcctcagcctcccgagtagctgggactacaggcgcacaccaccatgcctgggttattttgttgtatttttagtagagacagggttttactgtgttagccaggatggtctccatctcctgacctcatgatctgcccgcctcggcctcctgaaattctgggattacagacgtgagccgctgcacctggcctctggatgttatttctaatgagacagtccttcagctcttctcactgtgtgtttctcttctgggcccggagggcagctcactggggttgaggctgtgaggcactgctgctttccaggagaacgaactcagcacacagtctggggcagacagtccttcagctcttctcactgtgtgtttctcttctgggtccggagggcagctcactggggttgaggccgtgaggcactgctgctttccaggagaacgaactcagcacatggtctggggctgcagaaaagcgaatcctgcccacacaaaactccgctcttacttgggtggggctgagcatagtggcccatacatgtaatcccagtgctctgggaggccaaggtgggaggatcgcttgagcccgggagatggagactgcaatgagctgtgattgcgtcactgcactccagcctgggggacagagccagaccctgtctcaaacaagacaaagcaaacaaaatgaagtggttgggatttggatgaggactgcgggccaggacagcggagcgccacacactgagactccgtcctgaacccttcggcagcagcctctctgtgcagtggtgggaggggagcgtgccctccagtgacctcgtttcagctttggaggctccagatgcagagctgtgaccactgtgtcctcggcttgcagggagctgcaggcccaggaagccttgcagaacggccagctgggcggcggggaaggggtcccggatctgcagcctggggtcttggccagccaggccatgattgagaagatcctgagcgaggacccccggtggcaaggtaactccacggccgcagctgagggcggtggtggggggggcgggcacagcgcgagaacagctcgggccacttggttccctgtgcctttcagtttacgtgcaaggtgatcagatggggaaaccgaggctcgtggagtccaataccaagccctccccaacagggggtgggtgccgagtgggatttgggcccaggcgccttcccccgcacctgctctgaatctctgcggcaactggcatctcagtggggccagccattgaccaagtggccgaggaggtagcacaactcccaccggaactcgtgaggcgtcctgtcccagagccggggcgcccaccaggcacccaccaggatgctcagcagagcccccagcccaccaggcacccaccaggatgcccagcagagcccccagccctgcgcctctctggggtggtgctctagacagcagctttcaaatccctgagcttggccagaaacatatggaccagggggctgtccctcggggctgggggacctgcattcctggctggcacacagatgaggttatatgcaggggagattttgatttgaaaaaaaacgtggtaaggctgggagcactggctcacgcctgtaatctcagcactttgggaggccgaggcgggcagatcacttgaggtcaggagtttgaggccagcctggccaacatggtgaaaccatgtctctgctaaaaatacaaaaaattagccggttgtggtggtgggcgcctgtaatcccagctacttgggaggctgaggctggagaatctcttgaactcggggggtgaaggttgcagtgagccaagatcacgccactgcactccagtgtgggtgacagagtgagactccgtttcaaaaaaaaaaatgtaaaatacacacaacataaaatgcaccatttttaagtgtacagtccagtggcatttagcacgtctgcagtgttgtgcagctgccacctctctctagttccagaacattccatccctgcagaaggaacccccctgcttatgagcagttcctccccatcccctccctggtccctgcactcactggcctgcatcccatctctgtgaatttgtgtattctggacattgcgtatggcagcgattttttttttttttttttttttttttttttttttttttgagatggagtctcgctctgtcacccaggctggagtgcagtggcacaatctcagctcactgcaacctccgcctgccaggttcaagcaattctcctgcctcagcctcctgagtagctgggattacaggcaggcaccagtatgcccggctaattttttatttttagtagagacggggtttcactgtgttggccaggcaagtcttgaactcctgaccttgtgatccacccacctcggcctcccaaagtgctgggataacaggcgtgagccaccacgtccggcccagtgaatgacttctaaaaataggctttattttttagagcggtttccggttcacagcaaaactgagtagaaaaatagatttcccaaacaccccctgccccctcagcctcccctgccgtgcacctcctgcactgcgaggtacgctctttaccaacagtgaacccacactgatgtgtgcttgtcacccagaggctgtggtgcgcatgaggctcaccatgcggcatttcggggtgtgcatgtctctggattttagcatattctcaaaagctgtgcacacatcacctctctctagttggagaacattttcatcccccagcaaggaagccgcacacccacagcaggactccctcccagccctggtggtctcggctccactccgtctctgtgggttccctagttctgggcattttcacataaacagaatcacaccacgtggccttctggcccggcttccctcatggagcgcgagtcctttgacatcagcgtgtgccgtggcgtgtgtctgcgctccccaagtcctcctgcagccccttccatttgggggacagccaggtccttccacctttggtctcctctgcccagcattgcttccagtcgcgctgctcaggcaccgtgtggcccatttttcagatgccaacttcgtgctgggcagctacaagacggagcagtgcccgaagccgccacgcctgtgccgccagggctatgcgtgcccacactaccacaatagccgggacaggcggcgcaacccccggcggttccagtacaggtgagcctgcgggaccgtgctcagaggactccggctggtgggcgtccttcccggcccgtggctcgcgttgcccaccccggggttctaatgggagggctgcccttgtggcaccatcatccccgggaggggagggcatctccaagcacagtggctgtgggaggtgccatggaggcccacgcgtctgtcctggggatgggcctccccacctacgctcagtgtctcccatgcagtcccctaccggggcccctctgccaggcaaggggacggagcactgcaggagggaccccaagcccagctgggacccccgtgtgccccacccgtgcctctggttgcagccacgctctccagcctgtgggctgcatgctgtctcctcacccaagctgccaggggctcaggcactgtcgtcacctgggctcaatcttgtcttcacagctggcagctgggacgccgggtccttaggctgagtcccagggccaacaacccaagggtcgccctgcccagggtgcacacaggaccttcctccaccgcctgagccccagctgtcccctgggtctggcttgtgggtttggcacctcgcagcctgcttgcctctgaagcccctttctcctccttgctccagcccggccttctggttgtgcctggcctggcttgcctcctgtctgcagtttgcacctgagaggggggtgggggggtgcagaccccacagggtgtctggatgcctgggccatggccttggcctccctgaggccctgtctgtgtccagctcttcctttgagcagagagccaccctcgcctcttttgaatgacctggtgctgcctcgcatgccccggagagcacctgtgcttcctttgggaaggacgccccactccttgttgttatgccacgttcagtctccctctgagcagcttccgagtaaaggacctgaacggctgtagaacaaaccacaaattagtgtctgagattttgtcatcgcccgtcatggaaagaaaataaaaattattttttcaacaggcacttaatgtgtcccataaatacaaatcagttacaataaagcagctagagattccacgaagagtagaggattttgtttttttatgagacagagtctcactctgtggcccaggctggagtgcggtggtgcagtctcagctcactgcagtaggaacataggtaatttgaaattggtgcggagttttaaattgtgggatcaaaactctcgcttccattttatagaaagttggcgaggagacagccccgtgctgtctgggcgcccggcctcactgtccccaggaggttcggctgcttctcccctgcgttctccacgtccgtgagggtggctctgactgagactcaagttaaattctgtgaagaacagccccggggctcctgaccccatcctggcactggccgggcctgcgtgtccgtgagcgcagagctgcgttgcctgtcactccagggccccatgcccgaggcccctcctggtgggaggcagacacccctgggcacacgaggaaccatgttttcctgtgtccccctgacacctcctcatccccaggtccacgccctgccccagcgtgaagcacgggggtcggggtgggggagccaagtcctctgtgtccccctgacacctcctcatccccaggtccatgccctgccccagcgtgaagcacgggggtcggggtgggggagccaagtcctctgtgtccccctgacacctcctcatccccaggtccacgccctgccccagcgtgaagcacgggggtcggggtgggggagccaagtcctctgtgtccccctgacacctcctcatccccaggtccatgccctgccccagcgtgaagcacgggggtcggggtgggggagccaagtcctctgtgtcctcctgacacctcctcatccccaggtccacgccctgccccagcgtgaagcacgggggtggggggcagggagccaagtcctctgtgtcctcctgacacctcctcatccccaggtccacgccctgccccagcgtgaagcacgggggtggggggcggggagccaagtcctctgtgtccccctgacacctcctcatccccaggtccacgccctgccccagtgtgaagcacggggatgagtggggggaaccctcacgctgcgatggcggcgacggctgccagtattgccactcccgcacggagcagcagttccatcccgaggtacgtccctccaaccccccaggcgtaggggtcgctggaaggtcccagagaagctgtggggttcacagcgtggttatcacacagaaggaacagtgattaactttggccgagggctggcacaggtcgggaagcctgggggtggaggcatgagggctgtacctgcttgcttgtcttgcttgctggccttcgggctgccctcagccagcgagtctctccacttggcctgtaacagaagaaagagtcatgtgggaaaaaagcagagagaaaatgtcaattaaaaacatacatattcaggtctgggtgcagtagctcacgcctgtaatcccagcactttgggaggctgaggcagctggataacgagatcaagagatcaagaccatcctggcaaaaccccgtttctactaaaaatgcaaaaaatcagccaggcgtggtggcgggcgtctgtagtcccagctactcaggaggctgaggcaggagaatggcgtgaacccaggaggcggagcttgcagtgagctgagatcgtgccactgcactctggcctgggcaacagagcaagactctgcctcaggaaaaaaaagaaaaagaaaaaaatatatatattcaggccaggcacggtggctcacactgtaatctcagcactttgggaggcagaggcgggcaaatcacttgaggtcaggggttcgaaaccagcctggtcaacatgtctgtactaaaaataccaaaattagctgggtgtggtggtgcgcgcctgtagtcctagctactcgggaggctgagacgcgaggagcacttgaacttgggaggctgagacgtgaggatcgcttgaacccgggaggcagagcttagagtgagccgagatcacgccactgcactccagcttggaggacagagcgagactccatctcaaggaaaaaaaacaaaacaaaacacatgttcaggccaggcacggtggctcacactgtaatcccagcactttggaaggctgaggtgggcacatcacttgaggtcaggggttcgaaaccagcctggtcaacatggtgaaaccctgtctctactaaaaatacaaaaattagccaggtgtagtggtgcgcgcctatagtctcagctacttggaggctgaggcgcgaggatcacttgaacctgggaggctgaggttgcagtgagccaagagtgcgccactgcactccagcctgggggatagagcaagactctatctaaaaaaagtaaaatcctcagccaagggggaggcgtgcaggggctgggaaggaccaggcgctgcttcccgtcgtttcttgactcatgttgtcacagacgcgcatcatgctttctgggtgtcggtgaccacacactcaatggtgtcaccaggggcctgtcgggagtccggtgtccggggcgttttctgtgttcagtcacgcaggcctggttgcagaccccagtctctggtacccagctgagtggagctggcaccacgtgggccacagccgcaccataaatcctgagggagataaaccctcccgcctgggccccgccccaggtaaacaaggactcttccgaggcaggaggttcctggggcggaaggggcagcctgagatggagccaggcctgtgcctccactagaaggtgcagggtatggacggtacagggaggctgtgttcacacccagccgtgtagttgccaagggaccatactcagatttgtattaaaaacaaacaggccaggcacagtggctcacgcctgtaatcccagcactttgggaggccgaggcaggcagatcacctgaggtcaggagttcgagaccagcctggccaacatggtgaacccgtctctactaaaaatacaaaaattagccaggtttggtggctcatggctgtagtcacagctactcaggaggctgaggcaggagaattgcttgaatccaggaggcagaggttgcagtgggccaagatggcaccattgtactccagcctgggcgacagagccagactctggctcaaaaaaaaaaaaaaaaaaaatgaacagaccgggcacggtggttcacgcctgtaatcccggcactttgtggggccgaggtcaggagtttgagaccagcctggccaacatggcgaaaccccatctctactaaaactacaaaaattagccaggtgtggtggcacatgcttgtaatcccagctacttgggaggctgaggcaagagaatcacttgaactcgggaggtggacgttgcagtgagccgagatcttgcgactgcactccagcctgggtgacagagcgagactctctctcaaaaaacaaacaaaatgaacaagcaaacgggaccccaccgggtgcccgacgtggtggaagggccatgggggggtggggccaggccggaggtcaggagagaggcttcctgctgggacccaggcaggtgtgggcactggaggcctggcgtgccaggtgccgtgtcctttacggagagctacggagcaggaggggctgggccaggcctcccaaggccgactgggggcttccaggctggtctgtcccttgccgggtcttaagtgttgttgacctcatgagaggggctgtcaccctaggtgaagggtcagtgggtctgatcagggaacagacacacgtgttccttttaataggcacttattaggcacctgctgcataccagactctgaatttggtgcatctttcagaaaatatcaagcggggaaatgactttgcctgtgatgggagggcagatgctgcgggaatggccccacatgtgtgcgtgttccctgtgggtcggctctgcagagaggagggatgtggggaccaagggcacacgtggaggagggcagggcccacgccccccttttcaggggtgtcttgttacgatttggagcttaatcctctcccttgggatgatgccagctgtggtctttccacagaatcccatttccaatccaacctctttatttcacttttttccccagatctacaaatctacaaaatgcaacgacatgcgccaaaccgggtactgcccgcgcggccccttctgtgcctttgcacacgttgagagtgagtaaccgtccctgtggcaggttcaccttagcaggttccgcggctctgcaggccctcactggagttaccgatgacccggagctgcccacgaggacctggaaggcgggcaggagctcagcaccgtggttgggggctgggggtccctgacatgcccgtggaggctccctggggtgtttgtgccatgtgaggctgggctccctccacgccggcgtgggccaggcctggtggaatctgcagggaccctgtcttcaggcacgctggggccctgagcctggaggctgagtcctggtgtgggctggctggcacctccacctgcctcctgggcatccaagctgggtccttctgccacccactgcctgggccttgctccgagactgccatcttgccaggcacccacccaggagcaccacctcccttgtggagagagggggtctgtccgccccagctcggggagacagcagagaccctcaagcagggttgctcagggtgaccctgtgctttccagagcccgtttgctgtccaggggatgagggcttagctttggcgattatgtggtccctaataagttcccagcagcagaaacaagccccagtgggaacccacgcggcctcctccacgctgcagtgggtttccttctggcagccctggggtttgggttcagtgggaacccacgcggcctcctccacgctgcagtgggtttcctggcagccctggggtttggactcagtgggaacccatgcggcctcctccacgctgcagtgggtttcctcctcgcagccctggggtttgggttcagtgggaacccacacggcctcctcctcccagccctaggatttgggttccaggttttgtgtgtgtggtcacaagctcaaattttcctttgttttttattttagtggggagggcagctattcttgttcacgttttaaacattgcttttagtgttaaaaacatgaaaaactggtctaagaccagagggtcctgttgccctgagtgtccccaccactgcccagccgtcctctgccgcacccctgagggatgattgtgacgaggctgcgcacactcggccctgacgtgtggtgcggagacttctgcgtgtcactgtcgcccaccagcggccctcagagtctgctgctcccctgtccttgcagagagcctggggatggtgaatgaatggggctgtcacgacctccacctcacgagtccttcctccacgggcagcggccagccgggaaatgtaagtgaacggccttcccaggacaatgcccagtgtcctttggtttaattgaactcttagggatgtggatggatatgagttttcagcaatgtggtcgtgggcagtctgtggagttcgtggctcttctagaagagtctagaaaaatccttgccactaggctgggggcagtggctcacgcctgtcatcccagcactttgggaggctgaggcgggtggatcacctgaggtcaggagttcaagaccagcctggccaacatggtgaaactccatctctactaaaaatacaaaaattaaccaggtgtggtggtgggtgcctgtaatcccagctactcaggaggctgaggcgggagaatcacttgaacccaggagacggaggttgtggtgaggtgaggtcccgtcatttcacttcagtctgggtgacagaataagaccccatctcaaacaaaaaaagaggggggaagagggggttgggcttctaggaaggtaaggctatgggggagactggcggaaggtaagagcaacttcagtgaggttggttatgcagcctcaatctgcagtctctcctcctggtgtggagaggggagaggacaccttcacagagggaattcacgcccggcttcgaggcaggaaggaagcagagagctgctcctgcatctactgtttctcagctgccttcaactcaaaataatctttttgtcaaagagtggcatgttttggggtggcacactctgactcccttcatatatttcttaacagtttcacctgagcctctgccttaggtgaatggctcggtttggggtttgatgccatggttggttcagggagtgcagagctggcaccctgccttcacacggaccaacccaaggtcagagagccacgttcaaatgtaagaaatggaactcagggccgggcgcggtggctcacgcctgtaatcccagcactttgggaggccaaggcgggtggatcacctgaggtcaggagttcgagaccggcctgatgaacatggtgaaaccccatctctactaaaaatacacaaattagccgggcgtggtggcgtgcgcctgtaatcccagctactccagaggctgaggcaggagaattgcttgaacccgggaggtggagcttgcagtgagctgagatcgcgccactgcactccagcctggatgacagagtgagactttgtctcagaaaaaaaatgaaaagaaaagaaatggaactcaggagaaccgacagggagccagcaggttcaggcatctcttctgtttcatgagaccttcgagatttggcatctttggccagttgcagtggctcacgcctgtaaaccaggcactttgggaggctgaggtgggacaatcgctcgaggtcaggagttcgagacccgcctaggcaacataacaagaccctgtctctacagaaagctttgaaaaattaactgggtccactggcaaatgcctgtgctcacagcttcttgggaggctgagacaggaggattgctttagccagggaggtcatgccactgcactccagcctgggagacagagcgagatcctgtctcaaaacaaaacaaaaccaaaaatagcattcgtctaaattctgagcagagcttatgtgtgtgtgtgtgtgtgtgtgtgtgtgtgtgtgtgtgtgtgtgtatctttaagggaccaagagtactgctgaataggtacatatatattgtgtgtgtgtgtgtgtgtgtgtgtgtgtgtgtgtatttttttttggagacagagtctcactctatcacccagcctgcagtgcggtggtatgaccttggctcactgcagcctccacctcctgggttcaagcgatatccttttttaaattttttattctattttttgagacggagtttcactcttgttgcccaggctggagtgcaatggtgccatctcggctcactgcaacctccacctcctgggttcaagcgattttcttgcctcagcctctcgaggagctgaaactacaggcatgtgccaccacgcctggctattttttgtgtttttagtagagacaggttttcaccatgttggccaggctggtctcgaactcctgagctcagatgatccgcccgcctcagcctcccaaagtgctgccactgtgcccagcctgaattgtatgtttttaatttacatttcctccctgctttttccacatatgactgttttttatgttgcaggccaagcggagagactcgccggccgagggtggccctaggggcagcgagcaagacagcaagcaggtacaggcccccaaggtttcccaccctcgtgcctgatgtcgcgttagggctgaggcttcccgccctcgtgcctgacccgtggcatcgcgttagggcagcgctcatgcatccttggtcccgcccactctcggctcgcaaagccatctggttgacgtccgcttgttgtagaattagctctttcctggtacccccgtgtttgtctgtttgaaacgttcgtgttataccttggaaacaaagccacaacatcgtgctcggggaaataagaggggccctttggagcccatctgtgttacttttttgggctgcgagggaaggatgcagatggggccgttccaacagcagaacttgccgggcacggtggctcacacctgtaatctcagcactttgagaggccaaggtgggcggatcacgaggtcaggagtccgggaccagcctggccaacatggtgaaaccccatctgtactaaaaatacaaaatattagccaggcatggtggcacgtgcctgtagtcccagctactcgggaagctgaggcaggagaattgcttgaagccgggaggtggagattgcagtgagccgagatcgtgccactgcactgcatcctgggtgacactgtgagactctgtctctgaatgaatgaatgaatgaatgaatgaggtagttttagttgggcacagtagctcacacctgtggttccagtactttgggaggctgaggcaagagaattgctggagcccaggaggtggaggttgcagtgagccaagcactccagcctgggcgacagagtgaggccctgtctcaaaccaaaccaaaaccaatccccaagcagcagcacttgactctctcagttctgggggctgagtccgagcttgagctgtccagagctggctcctgaggccccccgggtgcagatgctgcctcctccgtgtcctctggggtcacccctctgtgcgtgggcatccctggggtctcttcctgaggacagtggctgcgtagggccctgcccccacacctcatttcattgttgctgttgtgtttttacagattcttaaattttttgaggcagggtctggctgtgtcacccaggtgtagtgcagtggccaagtcccagctcactgcagcccgggactcccaggcttgaagcagtcctcccacttcagccttctgagttgctgggaccccaggcatacaccaccaggcttggctaatttttgtatttttttagaaatggggttgcccagcctgttctcgaactcctaggctcaagcaatcctcctgctttgacctcccaaagtgttgggattacaggtgtgagcctccacgcctggagtaagaactcatttcaccttaattactcctcacaggccctatctccaaatttagtcacaccgggggtcaaggcttccacgtaggaatttgggggggacacgtttggtccataacaaagacactgtgctgactgaaatgagccagttaccgaaaggcaaaacctgcgtgattccactcacaggaggtctctagtggagtcacattcacagacagcaggtggcatggtgggggccggggccggggccgggggagggggcaagtgttcacggggtcagagcttccggctggaagatgaggagttctggaggtggacgcggtgatggctgcacagcggtgtggatggaattcatgccacgtactacaccaaaccatggccactgtagcaaattttatattatatttcactataatacagagaagaaaaaccaggcaggcagtgctggtggtagcttggggtgtgctgtccccacggggcgaacggtgctggtgttagcggaggtgcggtgtcctcatggtgtgaacggtgctggtggtagcggaggtgtggcgtccccacggggagaacggtgccggtgttagtgaaggtgcgggatcctcacggagctctcgtctgacccctctcactgtgcccatccctcatgtggatggactcccacaccaggcccgtcatctgtggccattgtgccttggggtacaaggagtgacatggatgttgatgattttcaggtgatcgtttgggctgaagtcacagtgtgcgcatcaccctggccagctcccgggcagggtcagcatggggtctggggggtcactcagggctgaggcttcctctctggtccctgttggtttatggcctccagtaggctggggaaggcctccggggtggagtcccctcctgcagacaggcgggaaggaggcggccttggcttctgagggtgctgcattcaccctgggccgggcagcgctttgggagcctgaggctgcctgtcccagccgagggtcagcccgtgcccagccctcagatcagtgctgctttgggggcaaacgtggcacctgcactgtggtgcctcctggctttctgcattcttgggctctatgcagacacaggtgcggggcacagactccctgtccgacccagggcggggcaggcctgctctgcaaaccccagcgtcgtccacggcttcttggtgggcccggggcccttccaggcaacagtccctcagctctcccttacatgggaggtggcctctgggcctgggtgatgctctggagttgggttcaggcaaggactgagacgcccacaggggtcatggagctgagaggacatccacaggggtgactgtgacccgggcggtggcctctaggctactggtgggtcaggacatggggaacctcagcctgactgagcaggggcagcttgtgtgtagggaccgtgccccagagcacggacctgggcagaccccgggacacagggtgggctgccaagagatgggatgaggcgggggtgggggagggcttccgcaggccgggcagccgtgcggcggtgcagtgtccacgtccccggagggccgggcagccgtgcggctgtgcagtgtccacgtccccggagggccgtgcgttgccatcctgagcttttggttctgagtgatagctgctggatgcggtgagctcagcagaccgccccacgtcactcaccccttgctggtgcctgcctcctcagccccacagcccaggtggccctgtcctttgctggtagagaaggtcggctccctccccgatccaagccatcggggtacaaggagctcccaggtgtgcgttgctcctggatgtctggtcaccagaacgtctgtcaagaggtccttctcagccttcctggggccacactgagggtctgaagcagggacaggaagtgcaagggatagggggcgggttgccactgagatggcaccaggtctcgaatcacccatagtgtttctgggctgcttgctggagaacatgaggcttccagcaaccctgtcaccaggctcaccatgggggattgatagggggtattggcagcaccatgcatggctgggagtgtccccggtgttgcatggctgggagtgtccccggtgttgcatggctgggagggtccccggtgctgcatggctgggagggtccccggtgctgcatggctgggagggtccccggtgctgcattgctgggagggtccccggtgctgcatggctgggagggtctgcggtgtagggtgcaggagttaccgccgtccctgatgctcacggggtggactgtggtccgttttttcatggcttgaggaaaagtggtctctgggccagggagaggaagtggattatggacgagggggcaggccccttctcgcacctgggcagggagctctggtggctgtctccagactttgcagctggaggggactgttttcagagtcagtcacggggggctctgtgcacctcctgggccgtgggctgaggggcaaatctggtatccagaaggaagccagggcaggcagcaggacccttaggtcacagaagccaggagccaggcgcgttcttgtcggggatttctgatctttaggaaatgcacattaaaatttcttcattatggacagttttacttaaggagacaaactagtaaaatcacacctcccaaggttaactttttctgcattactttgcagcaaaacccagatatcataccatttgaattgtaatatttcaggatgcaattcattttttttggaaacagagtctctctgttgcctgggctgcagtgcattggtgcgatctcggctcaccacaaccactgcctcccggattcaagcaattctcctacctcagcctcccaagtagctgggattacaggcgcccaccaccacgcccggctaattttttgtatttttagtagagatggggtttctccatgttgggcagcctggtctcgaactcctgatctcaggtgatctgcccacctcggcctcccaaagtgctgcgattacaggtgtgagccaccgcgcccggccttggctaattttttttgtatttttagtagagacagggtttcgccatgttggccaggctggtctcgaactcctgacctccagtaatctgcccaccttggcctcccaaagtgctgggattacaggcatgagccactgtgcccagccagaaactcattctaatccagcttttgatgcttggttttgcagtgacctcgtaggtggctctgggtcttttgtgtcgggtgttttcttgtgagcagcaccctccccgttactgggtttttattcagcactgctctgtgtgttgctctttttcttttgatctattatccaccaaatacagatcatgtgaattgccctgtgttttactttccctggtgacgaggtcacaggaccacgctatggatgttttggaagtggtgctggatctctttttaagtccctgggaggacatttctctgggggccccccaaggtgctcaggagccagtcctgggcgagagccggggcgggggcacccaggaggtgtggggagaagggcaggcaggctgcacggcttgcccctcgggctggcgggctcctggccgctgacacatctttctgcacgtgccagattgatttttactggcaaatgtctactcctgaaacgttttctgcagaaaagctcacgagacactccccagaggtgtctgtgcctgtcccaagtgcaccgtagcccgctgccctgccgtcctggtgtttctcctcggtgcggtcagagtccctccgggtctgggaagctctccctgggcctcgccagggcgtagaagttggccgccgtcccgcggtgctttctgcagggtgccgacgtggcgctgcctcctccacgcagggggtgcgcgctcacggtgtttatgtctttgaacagaaccacctggccgtgtttgcagcggtccacccgccggcccccagcgtgagctccagcgtggcgtccagcctggcgtccagcgccggctccggcagctcctcccccactgcgctgcccgcgccccccgcccgtgccctcccgctcggccccgccagcagcactgtggaggccgtcctcggtaagtccagcaccgtcctcctttctccctgacctccttctgtgttcatgctgtagcttttcagggacagcgcttctatttcaggacatgttacagaatcgtcatttttgtagagaagccagacgcgtattttcagtcatctgtcactttggttgtgttgcacgtgtggttgtggaaacaagccctgactcagagaggctcctggcctgggtgccgcaggcgctggggacgaggagcctcccaggagccaggcagagcaggcgccgtccggctcagggactgagaacggggaggttgttgacagatgatgggagttgtgggagttggccgcctgtgctcccagcgctgtgggaggccgaggcaggaggatcacttgagcccagaagttgaagaccagcctgggcaacatagtgagaccccgactctactaaaaataaaataattagccaagcatggtggtgcgcacctgtggtcccagctacttgggaggctgaggtgggaggatcccttgaacccaggaggtcgaggctgcagtgagctgtgattacaccactgtactccagcctgggtgagagagtgagaccatctcaaaaaaaaaattgaaagtaggggttgtgggccagtgagggcactgagggtgggggacagtgatggggtggggagtccagtgaaggcttggagtcgggggcacagctgtgagcacctgggctggcagctttgggaggcctttagttggagggagtcactgggcactgagacacgtgatggtgctgggctgtggggacccgtgggggcctggctgggagcccagaccctggggggcagattcttccagaagcccggagtgggcagcaggcagagctgggggcaagacagtgccaggagctgggctgtgtgtgtccttggtccctttcagcccctggggaaaggccgtgttggggtggtggggacacctgccgtgttggggtggtgggggacacccaccgtgttggggtggtgggggacacctggccacacccgtgcagggctttgcttgcagagacgcttggtgagtgatgggatgtgctgaagccccatgttccatggccaccagcgcccaagggacccaaacctgcctctctgtcctgacagtgacagtgagggactcagggaaggccacctgtggtggtctccaagttctctgtccctgggctggggtggaatgggatggggttgggggtacagtgaggccgggccctgctcagctcagcccgggtctggcctctgctgctgcagccctggagcccaccccttcctctcctacatcctctgctgtgcagggtgtggcgggggagctgggcatgggatcaggaggacagggctgctggagccacgtggtgggggccctcgctgcagtccctgcctggacacactctggggacttggagtgggaccccagcaccatcaggacccgcgtcaatgtgggcggcggcccggcggccagacccgcaatgactcttgcccgagagccgcagcttctggtcgttggtggttgccccacacggaactgctcaggcccagctgcaagcccccagcaactcctagacgatgccggccaaggaggccgaggagagagagactcttcccagcggccacttaggccacagaccacacatcggcaggacactagaccagtcccatcctgagtggtgtctgcgaggaaagccaggtgcagctcctgaggccccaggacggtcctcagtcccccaagcacccagggccccgctctcagcacctctgcaaccaggtgcatcttctgggcacagctcttggcctgtgttgctgctgggccgtcccatccctgcatctgcttggggttgagcccaggcctttacatttttcttttgtgtgtgtgtgggttttgttttgttttgattttgttttttttttttttttgagacggagtttctctcttgttgcccaggctggagtgcagtggcgtgatcttggctcactgcaacctctgcctcccgacttcacgccaatctcctgtctcagcctccagagtagctgggattacaggcacctgccactacgcccggctaatttttttttttttttttttgtatttttagtagagatcgggttttaccatattggccagcctggtcttgatctcctgacctcgtgatctgcccgcctgggcctcccaaagtgctggggttgcaggtgtgagccactgtgcccggcatgtgtgtgtgtgttttttttgagacagagtctcgctctgtcacccagactggagggcagtggcacaatcttggctcactgcaacctccacctcctgggttcaagtgattctcctgcctcagcctcctgagtagctgggactataggcgcctgccaccacacctggccgttttttgtgtttttagtagagatgaggtttcaccacgttggccaggctggtcttgaactcccaacctcaggtgatcctcccaactcggcctcccaaagtgctgggattacaggtgtgaaccattgtgcccgacctgcattttttaaagggtctctttcacaaatactgggaacttttgtggccgtgtgcatctccccctcgcagccctggtgttcctatgtgggctctgttgtgcacctgccggagaaccctccagaatccagggccagtccctccctcaggaggccatggggagagtgggaatcctggatggacccagcgcccagtggtggggcttggtcggggcgggggcaggggcacaggcgcaagcagtgtttgcgtttgtttcgtcctcactggctgggagtatggggctgccctgcccagggaagggctcctcatttctgccttgccatggagggctcacctggtttcaggacaggactcaaacttccgccctccggcctgttttggaagtcatcttctctcggagcctctatggaggaggaagcatgtggtgtgggatgtctcctgttagggcttcaccgtaaagggtaggtttttaaaactgtgaatactccatgggtgggagtgctgtgtgctgtgttaagctttctctcaggcagaaacaagcccacatgtgttttcagtttgaaactagggcgtacatgttgttcctcttgaacagagaggtctcatgagttgaatatgctggggtgcccacccccatcccattccatcccagcccagggacagagcacttggagatcaccacaggtgacggccttccctgagtttgtttttgttcattttggggttttattttttaagacagggtcttgccctgtcacccaggcaggagtgcagtggtacagtcagctcgctgcagcctccaactcctgtgctccagagatgcttctgcatcagcctctcaagtagagctgagaccacaggcaggcaccaccgggcccggtgagaacatgctagttttaatttgagatcactatcatacatgggttgcataatccagggccctggatcttactaaatcacaccctcaaattcacacatccccttcagaaactcagaggtcagggatgaagtctacacagtggctaaagctccatgagggtctggcctctgagcaggttctttttttttcttgctctgttgtgcaggctggagtgcaatggcacaatcttgcctcactgccacctctgccttccgggttcaagcgattctccctcctcagcctccggagtagctgggattacaggtgtgtgccatcatgcccggctaatttttgtatttttaatagagacggggttttgccatgttggccaggctggtctcaaactcctgacctcaggtgatccgcccacctcagcctcccaagatgctgggattacaggcgtgagccaccacacccggtcacttatttttttcttttaaacaaataagcacacattctttttaaataaagtttctcttccccaacctaaaagtagtaatgctagaatttgagcatagcagaaaaatatttaggaaaattaaatcccaaacaagagagaccatcttggactgtgctcactcgggtggaaagtcgacccaggtgcctgtgtgcttgacagaggcgtggctgcatccgcgtagctgaccttcagatggactggagttagcacatttgtagtcatttttccaaccattctttcgtatctgaggtacgtttttgacctgttttagtatgtcactcgcgatcttgaagcacactctttcatttacttaaatatttcctgagccgtgagcagtggctcacgcctgtaatcccagcactttgggaggccagggcgggtggatcacctgaggtcaggagttcaagactagcctgaccaacatggtgaaaccccatctctaccaaaaatacaaaaattagctgggtgtggtggcttgctcctgtaatcccagctactcaggtggttgaggcacgagaattgcttggaccgcaaaggcggaggttgtagtgagctgagatcgtgccactgcactccagcctgggtgacagagcgagacttgttctcaaaaaaaaaaaaaaaaaaatcctgaaccagctactcagaggtgaagagatggattttttttttttttcaggatcgacactgccttagttagaggcaatgtattgttgctgctgctgcggctgaaattgtgagctttgccacccagtgccagcctcacttttttcctctgtccatgtctgagacatcgctgtaaagttacatccctgcactagccacaggcactggaggcagtgtcctgcccgctgaccccagggcactcctgcgccccaggctcagggactccctgcccatggctcccgggactgtctggccccaggtgtaggcccgcctggctgcgtgtgtattttattagctgttgtagagggttttggacaaagctggtgtgtagactgggtcgttttttccttgtgttaatagtacagtttccttcaggttgtaggtgtactgtgactggagcacggaatagaagaaatgagcggattctgtatttaagggatttttagtgggatcatttcagacccatctgataggttccattttccttcatcttacacttcataggaacaggtttcagattaagagagacctgcgagctccgtaccccgcgtttagatggggctgggcaggcacgcggacttgggagggaggagggtcctgcagggcaggcagcggccccagctcacgccgccccgccccgcgagcgcccctgttgggtcgaccgtgtttcacctgagtccgcccggagcagctgcaggtgcaggtgggcagggcaggaggagccgggcagcggggcagctctggggctttctgcctgaagacctctggcccccgctgcccgcgcccacttgcccgcccagctcgtagccaggagccgcggggaccgggtgcgcccgagtcggggggaaggttgggggagggcagcgcggggggcgtggccagtgcgacgggggcggggccgagtcacgttgcggggcggggccagcgcggagggggcggggcgcgggccgggtttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggtgcgtcccccgcgtcacggagccgggtgtgacagccgcggggtgggcccgggcttctcagaggcccggagcgaggcgaaggcgtcgccttctcggaacctgcctctgccgggcgctcgccgcttcccagcgcgggctcgggccgcctgcgtcccctagctaggcggggtcggtgccccgagggagggcaggggagcggggcaggagagcggagcggagcggggcaggagagggcaggggaacggggcgggggagggccgacccctgcgtcctggcctggcccgcctgcactcagcccgcgtggtacgggaatttccctggcgtcggcggctcccccgccctgtcctgagttccgagcagtctgtagcttgtcctcgcgtgtccctgaccccgggggaccgcggcgccttgaatgtgctgtgtcacggcagagccgggctgtgtcgcggtgactcagcggggccggtggtttcctaacgcccggggctgaggcagcctggcctgacccagctgtactcgcttaggtgaccagcctcacctagattttgcctctgcacaagggtcagctctttctttgagaatgtttcagaagatctgggtctaaccttgaaacagtgaggtgaggtgggggagaagctgcgggtgagaaagtgggccaggacggtgcagcagccgtctccccccttgatttctgggagtgagccctagatagcaccctaggggtggtggagcctccaggaccctctccggtgctctctttggatgaggggcacttggctttgaagcggggccggagtctctcgggggcacccacacgctccctgaacgtcccctctccaggcagcttcccgggcttcagcacaggtgacttggctgaggtaggtggtggctgacgccctctgagttgagtgcgagccgtagtttgtcgggtgagcattgaaggcagcttagcccctccacatgctgcgcactctgcagctggtgggtgaagcttctgccgacttagcacggagcctggtgggatcaccccactccaaggggagaaaaggcgcctccgttcctgtcccccaacttctttgcgtctttgattttcatgaggagtttctggatctctgccaggtgtgaggggcggtgagctctgaaggggctgccatatcctgatcctgggacttgggtgcagagggcaggtccaggttcccgagcctggctgacctgactatgggcaaaccgcttggccctgcccgtcatcaagcccccgtatgggagcatgagggggctgtgggcaggcctgcgggttggggggtcggtgcctgtcctcagtgagtctgtccagggccctgacatggttcaggctgacacctgcaaggatgtagtggggggcattccatgcagggcttggaggccgagcagctttctggggactggtgtggctgatcttactgaatggaaggcacagccaggctgagcctgcagtggcacagcaggttaggagcccggcaaaggacccattgggaagcggtgaccggcacgcgcaagggcacaagcttcctcctttcttgcaggtcaggattcaggatgcaatgaggcttttcttggtaggaaggttactattgcaatgcatgaaggcaggctgggcatgggcctcagggggtgtgggttgagcgagcagcccatgaggaagggatcctgcagtgccagcttccagcagcccctgcacacgtggtgtctgggaagggcctgcagtggggccatgggaacaagcaagggatcctttgccagggaggaggaagggctttggcccctgctggacatctgggctcggggctgcagagccactgtgttgggcgggtccaggccacaggagaggctgccagccctcagggaggagggtgggcctgggagggaagctggtgcctatgacaagaggcagttcagggcacaggcgcagggctggagggaagggcccggggcagcggtgggcagagtgagtggtgaggaggccccagaaaacagctgcagggggagtggaggcagagggggggtctcctttctgagggaggactcagggagggagggctgtgcacagcaggggccagatctgttgatacagagtcctgaggggcctggggaggacgggcaggaccaacaggggcatctgcaggtgggcccccatgtcctgggttgaattgtgtcccctgaaagttgcatttgaggctgggcatggtggcttgcacctgtaatcccagcactttgggagatgaggcaagcagatcacctgaggtggggagttcatgaccagcctgaccaacatagagaaaacctgtctctactaaaaatgcaaaattagctgggggtggtggagggcacctgtagtcccagctgctcaggaggctgaggcaggagaatagcttgaacctgggaggcggaggttgcagtgagctgagatcgcgccattgcactccagcctgggtgacagagcaagactctatctcggttgggggggctgggtgtggcgggggaagatgcacctgaaccccaggcgtcgcacctaggtacgtggcgttgcagggaaacacagcaggtcctcttatcccagggttcgctgtccactgcctcatttgctggtgcgaggtctgggttcaggacagcagtgtacagcatttgcgcaggtaacttttattactgtgcggtgctgaaatctatgttaccagttaatcttgttaatctcttactgggcctgacgtgcaaatgaggacgttcgtataggaaaaagcttggtatataggggttccgtgctatccgcagcatcaggcgtccatgggggggtcttggaatgtatccccctgctacagatcgcagggtgctactgcagggtcctcataaccaggttaaaatgaggccggtagggtgggaccctgagccagtgaccagtctccctataagaagaaacttggacagacactcggaagaggtggcccccagagcagaggcagacactggagccacgcagctgccagccatgaaggaggatggacgccaggaggaggagtgcaccccagccctggagggaggaggagtgtgccagccctggaaagagggaggaggagcatccccaagccctcagaggagggaggaggagtgccccagccctggagggaggagggaagaggagcaccccagccctagagtgagggaggagggaagaggagtgccccagccctggagggaggagggagagtggaggaggagcgtgccccagccctggagagagggaggaggagcgccccagccctggagggaggagggaggagcatgccccagccttggagtgagggaggagggaggagcatgccccagccttggactgagggaggaggagcgccccagccctggagggaggagggaggagcgtgccccagccttggagtgagggaggaggagcgccccagccctggagggaggagggaagaggccctgcccgccacagatctcactttcagccttggagccacctgtccaaggccgctcagtgcgtggtcctctgccactgcctgcagtgtctcggctctgctgctcagcacgacttcagtcaggctttgaggtcttgccctcttcagccatggcctgagaacgtcaagtggatgacagcgaccgggagggctggcccaccctgcaggccagggtggatgtccgctcagggacgccaccgtcctgtgaatgggaaggagaggagtgaatggctctgggtgcggctggcccaaggcctgcctttggctccgccgatgagcatccttgagggctgaggcattttcggatgctactgtgggttcctggtccccagggggtcttggcctggctgccccgacccccaacctgttactctagtttctggataagaccttcgaaagtccctaaaagcttcattggaacggtgtctccgtgggagtggaggccactcccgcatgcgccgtgtgccgtcccggacgccccaggggttcaggttctctgccctgggccctgctgcctctgtgacgggatggggaaggacagtgttgccaggtggcgccacagcccggcctccacgccccggaaattccctcacggctggcgtgtggacgagggttgagtctgggtcgtgctgtgcggtggagtggggtgggggtggcctctgccttgcggcctctggagtccaccgtccactcccgagccaggcttctctcccgcctgccgctctgggtggtggagcacggtctccacacagtgtggctgctgagcgcggccagattcggggtgaagttcagaggcccggacctgccagctgcgccacgtccacgccagcctctgcctgtgctccgctggggccaccaccgcggcacgaggatactccggctgccctggggggctcggggggtgtgaccgccgagcgccaggcctcgggcgaggggccacccgccaccctgtggttgctcccatggtccccgtggcgctgactggtgccagctgcttccagggaggagaagcggaggcctgggcagaggggtgaggtgcaggccacgtgccccacagctgtgttcccgacaaatctcatgtgcggctagggcagcgttcttcttcagaagtcaccctcctgcctttcctgctgattatgctgaaaatgtctggaaaggccccagctgtcttccccggcagagtggggttttgtccctctgcggccccttggctgccgagtccttgtttctccagctgttttttgggatgccccctgtgtggtgaacctgctgtcaccctgacatggccaccaagtcctgacgagtcagccctgcctggctcagccagctccctgctgggtggggtgggttgtggggagtgaggctgcaggaggtctgcgagggcgggactcgatgtcgggtaggtggggcagtgaccgcctctttgcttctgctgggccccagcttgtctgaaccgagcaccaggcaggggctggccaggctgtggaggttcccggcgcgccgacccccacggtcgggtctgacaggtttccccggggtgcggttgcctggggccatggagggaccatcggtcccaggtgaggacaggaggaagggggtctagggcccttcagggacaggcaggggtggctttgcctgtctcagagcaggcctcagcagcacactgtccagtaccaggcatcagtgagggtccaagaacttgcagccagcagggacgacagggcagggccccccaggagagaccccacacagcgcacatgggagagtggatgccaaaggtgggcagcggggagggcgcctgcgcaacagtccctgtgtggtgtgccccacgctgctgaggtctctgtgcggtgttggccggcagtccctgtgtggtgtgccccacgctgctgaggtctctgtgcggtgttggccggcagtccctgtgtggtgtgctccacgctgctgaggtctctgtgcggtgttggccggcagtccctgtgcggtgtgctccacgctgctgaggtctctgtgcggtgttggccggcagtccctgtgcggtgtgctccacgctgctgaggtctctgtgcggtgttggccggcagtccctgtgcggtgtgctccacgctgctgaggtctctgtgcggtgttggccggcagtccctgtgcggtgtgttccatgctgctgaggtctctgtgcggtgttggccggcagtccctgtgtggtgtgctccacgctgctgaggtctctgtgcggtgtaggccggcagtccctgtgcggtgtgccccacgctgctgaggtctctgtgcggtgttggccggcagtccctgtgcggtgtgctccacgctgctgaggtctctgtgcggtgttggccggcagtccctgtgcggtgtgctccacgctgctgaggtctctgtgcggtgttggccggcagtccctgtgcggtgtgctccacgctgctgaggtctctgtgcggtgttggccggcagtccctgtgcggtgtgctccacgctgctgaggtctctgtgcggtgttggccggcagtccctgtgcggtgtgccccacgctgctgaggtctctgtgcggtgttggccggcagtccctgtgtggtgtgccccacgctgctgaggtctctgtgcggtgttggccggcagtccctgtgtggtgtgccccacgctgctgaggtctctgtgcggtgttggccggcagtccctgtgtggtgtgctccacgctgctgaggtctctgtgcggtgttggccggcagtccctgtgcggtgtgctccacgctgctgaggtctctgtgcggtgttggccggcagtccctgtgcggtgtgttccatgctgctgaggtctctgtgcggtgttggccggcagtccctgtgcggtgtgttccatgctgctgaggtctctgtgcggtgttggccggcagtccctgtgtggtgtgttccatgctgctgaggtctctgtgcggtgtaggccggcagtccctgtgtggtgtgctccacgctgctgaggtctctgcggtgttggccggcagtccctgtgtggtgtgccccacgctgctgaggtctctgtgcggtgttggccggcagtccctgtgtggtgtgccccacgctgctgaggtctctgtgcggtgttggccggcagtccctgtgtggtgtgctccacgctgctgaggtctctgtgcagtgtaggccggcagtccctgtgcggtgtgccccacgctgctgaggtctctgtgcggtgttggccacaacactgggctgggctggggaggcggcgccggcccacagggtgtatcccagagctcctgcagccgctgcggtcctctggtctgccccaggtggcacgtgggctctcagatcccagatcctctggtcacccctcacccccaacccaacttctgtgcagtggctgcgggagtttgagacacgctgtggcttcaggggctggtggcctgagctcagcctcctcatgatggcttcctaattctaggaaggggcagtggggtccctgcttgccattcggggttgggggtggggacttgggagggaagggcccgtgcaggagggcagccccacggcctgcagggatgtgtggggacagccttggaaggcagggctggctgggtgaggccactctgaggcgggtccttcccactcagtcttgagccttgggaattgaggtcttggtgcttggcatgaaattgcacgtgaacacctgctccttgaaatcaccctcacagaaagttttttttttgtttttgtttttgttttttttgagatggaatcttgctctgtcgtccaggctggagggcagtggcacgatctcggctcactgcaagctccgcctctggggttcacaccattcttccgcctcagcctcccgagtagctgggactacaggcacccgccaccacgcctggctaattttttgtatttttttttttttggttgagacggggtttcaccgtgttagccaggatggtctcgatctcctgaccttgtgatctgcccacctcggcctcccaaagtgctgggattacaggtgtgagccaccgcacccggccctggaaagttttttaaacagtcgaatgtgcacacgtggacagatgctaacacacacttaggtatttaaactctgaggggcagcagcagcgtgtcagaggcgaggacccagctgctggtctgtggtgcggggcgtcccacctgagcacgctcgttttgccggaggaacagccaagcctcacactgcctgtggggggctgcgaggacgggctgggggtgtccttccctggctgccccagcaactcccacgccttctgcccttggtctcactctaagcccaggtgggacggtcgtcctcctcagctaggcttcctgagctctgcagcgctgggtgggctgtggatgatggggggctctgttgacaggttctgcgttagacctgcatcttagcaatgtgaatattgcatccctagagaaggacctggaagagcaagacggccacgacctgggagcagcaggtgagggtggggaggacctggggccctgctcctccagccgctgaacagccaagtgctgtggccggaggatcgcttgagcccggggaggtcaaggctgcagtgagctgaggttgcaccactgcactcctgcctggaccacagggcaagacccggtgtctggttttcggagcgggaggatccccttctggcggtacctcctcctcctctccctgactgcctctccctttccctcccctgcacatggactcctcagcatctctcctgcctcgggcctgcccacttcttcagttgacctttgtcccagcaaagtggccgcgcagagacaggcggggcctttcctgaaagtcttgatggtccccgaaggataaatgtattcacattgtagacaaaagattgacatccatacaaatgtatctttttttttttttttttttttgagacagagcctcgctctgtcgcccaggctggagtgcagtggcgcgatctccgctcactgcaagctccacctcccgggttcacgccattctcctgcctcagcctccggagtagctgggactacaggtgcccgccaccacgcccagctaattttttgtatttttaatagagacggggtttcaccatgttagccaggatggtctccatctcctgaccccgtgatctgcccgccttggcctcccaaagtgctgggattacaggcgtgagccagtgcgcccggccccatacaaatgtatcttaacatcgtatacaacatcttttcattcagcctaaaagtgtatcttttctttcttttaaaagaaagtaaaccatttcagggggcctggacaagtgctgggaggaccgtgccaatggcttagttggccggcagggcctggtgggtgtccggcctctttggggggggcccatgttaaacccccgtctccccacctctggttggaatccctttgagcccatggcttgcccagctgtgttggacatggccaccgggggcgctgtggctccaaacacatagatggtggtggctggcctggcccctatattcccaccccccatatccccaccaccaccacctgcagggtccgtcttccacggctgccgcccatggcagatgtttgggcagaggcctggcggtactcccttcgctgactggtccgcccccgccaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtgagtgccggctccctccatgctggcgttgccgtgaagcctccgtggggctccctcccagatgccgtcctgactgaggggcctcacacggaaccttgtgccctatctgtggtggcaaaccacatgacctgctgctcacaggttcccccacgccgcagaccgagtctcgctctgtcgcccaggttggactgcaatggtacgatctcggctcgccgcaacctccgcctcccaggttcaagcaattctcctgcctcagccacccaagtagctgggactacaggcgggcgccaccacgcccagctagtttttgtatttttagtagagatggcgtttcatcacgctggccgggccggtctcaaactcctgacctcgtgatctgcctgccttggcttcccaaagtgtgggatgacagtgagccaccgtgcccggctatttgttacgttgtaaaagaactaacacttggtcgggtgcagtggctcacacctgtaatcccagcactttgggaggctgaggcaggcggatcacctgagattgggagttcaagaccagcctgaccaacatggagaaaccccatctctactaaaaatacaaaattagccgggtgtggtggtgcatgcctgtaaccccagctactggggaggctgaggcaggagaattgcttgaacctgggaggtggagtttgcagtgagctgagattgtgccattatgctccagcctgggcaacaagagtgaaactccatctcaaaaaaaaaaaagagaaaaaggcccggcgtggtggctcacgcctgtcatcccagcacttggggcgccgaggtgggcggatcacgacgtcaggatatcgagaccatcctggccaacatggtgaaaccccgtctctactaaaaatacaaaaattaggcgggcgtggtggcacatgcctgtaatcccagctacttgggaggctaaggcaggagaatcgcttgaacccgggagtcggaggtcgcagtgagctgagattgtgccactgcactccaatccagcctggcgatagagctagactccatttcaaaaaaaaaaaaaaaaaaaaaaaaaaaactaatactttgggccaacatagtggctcaagcctgtaatcccagcactttgggaggtcgaggtgggtggtcacttgaggccaggggttcaagaccaggctaggcaccatagtgagactcctgagtctacaaaaaaatacaaaattttaaaagtttttatttttttaaaacaaagtttcactctgtcgtccaggctccagcaatcttggctcactgcagcctctgccttccgggttaaaatgattgtcatgtctcagcctcccgagtagctgggatcacaggtacctgctaccacgccaggctaatttttgtatttttagtagagatggagtttcaccatgttggccatactggtctcaaactcctgacctcaagtgatctgctggcctcgacctcccaaagtgctgggatgacaggcctgtttttttttttttttttttttttttttgagacggagtctcattctgtcgcccaggccggactgcggactgcagtggcgcaatctcggctcactgcaagctccgcttcccgggttcacgccattctcctgcctcagcctcccgagtagctgggactacaggcgcccgccaccacgcctggctaattttttgtatttttagtagagacggggtttcaccttgttagccaggatggtctcgatctcctgacctcatgatccacccgcctcggcctcccaaagtgctgggattacaggcgtgagccaccgcgcccggcctgttttttttaagtaacatttaaactatttcagtcatagtctctaaagctgcatagacattggcagtcaccacatggacacagctctgtggggtctttgagagtctcagtgtgtgaggggttcctgggagtggagtctgagaaccactgcccctcccacctcatggtgtggtcccaggaacttgaatttaattcctctctgtttagactcctcaggtggccaggaaggcgtagatctggtggggagaccggccggggcaggtgtcactgtcagcgcctcttcctgagcctggtggggtccaggagtggggcaaggggcaggcgtggctgcacccctgctgccagggcaggtgagccccagagggtgcccacgtagcggtggggcctggggcatagcacccaccaatcccaccaggccgcgagcacagcagggctgggccgtcatcgaccgtttcacactcaggtttgaacggtgtccccgggagcatctgggactttgtttccggcagcttctcccccagcccctcccccatcctgagtgccggccccccatcctcttcgagtgcaagtccaaacggagctgagctggcccgggtcaggcggcagctggacgaggccaagaggaagatccggcagtgggaggagtcctggcagcaggtgaagcaggtgagtgtgtgggggggccagacaggtgagggggagggagggccgcaggggactcaggtgagcgtgtgggggtgagatgggaggggagggagggagggccgcaggtgactcaggtgagcgtgtggggggtgagacgggagggggagggagggagggagggagggagggagggccgcaggggtctcaggtgagggggccacagctgatgctggggaggggaggggaggatcgctggtgacacaggcaagagggtctgcaggtggcacaggtgaggtggggggtgctgagacgggccctgggtttcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgagtcctgctctgggcagggtgaggggccagcctgcctgcagggctgctgtccctgtctggggagggccctggctggtgcggtgtccccttcctcccctgccccagggtctgctccgggcctagggaggaggagacggtgccccaccccagcacagccccctgtggcctccttgcctgtctccctgggagccgcctttcctgtcaggctggcccttgccctttcacccctccctcttgtcagcgaatgccacactgctccccgtggccccatccctccctgttcacagctgtgaccctcacacatgacccctccacttcggcgtgcccctcctcacctcgcctgctaagggtgggctcttggactcgctgctataggacagagggtcctgcgtagcccacatcctgggcacccagctgccctcaggggcctggcctgtctggccactgccgtgtctgtggtggccccaggaggctgtcctctgcccagggctcttaagacagagcataccccctgaccccgcagctgccttctccctgaggtggccctggctggggcgtctccctgaccctgtctctgtagctggtggccgggcggcctgagatgctgagtcctgcccggaaggccctccggctccccagctggcccagcctgggcaggggcctcctgagcccgtcattgttctggccctgcaggtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccgacgtcagagcttttagaattacttttttaagcagctgtcttctggctgggtgcggtggctcatgcctgtgatcccagcactttgggaggcgggtggatcacctaaggtcaggagttcaagaccagcctggccaacatggtgcaaccccgtcttagtaaaaatacaaaaattggcctggcgtgagagcgggcacctgtagtcccagctactcgggaggctgaggcaggagaatcgcttgaacctgggaggcagaggttgcagtgagccgagatcgcgccaccgcactccagcccgggtgacagagcgagactctggctcaaaaaaaaaaaaaaaaagctgttttctgattactcagagctgtcctaggcaatggtgctttgtagctccttggagatgtcgctgggcgtcctggcaggggtcaggcagtgaactgggagagtggttgcctccccagcacccgtgaccaccctggtcctgctcgtgtgggagatgctcgggccgtgtgtgcgccagggtccggggtgccgggtgtatgtggcagtcacctgacccgcgctgccagttatcatcggagctcatccatgtggccagtgaggtcacaggagaggacccggccacagcctctcagtggcctggagcacacgggggaagcgaccccccccaggtcccggctctgctgtggtcccctgtcccgtctgcccctggagcgacagtgtggtttcggccgcagcagaaacgtgactgagaacgcatccccgcgatgacctgacccttctgctcagggctgggactgtccctaggagttgagcaggaacaggcatctgtggtttacggcgacctggctctccgcgggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccagggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacggggcgtaggagctggctggcggccggctctgcatgttcttgttgcctgtcgtctgtaactctagtgttcgacattcgccgtgatacagtggtgtcacgacgtgtgtaactgtggtcagcagaccttgttccgcgtggacgcctcaagtggattaatttctggaagcctcaatctgtatgtttgagtatttacatgagaatgttatttgaatggaattttcttaacccagaaggtagtatttataatcatttacttgtagcgaactgtttaaagttaacacttgtttaaatttttttacactatagcatttatgcaatggtttacagaattcatggagttatttttatcagtatgggaattaattaaaaccttgaatctttgttttgtctgcttctctgagcacaagcctggtcagctggtccctgcgggtcctaccagccagcttctctgtagggctctcggccgcgtccacctctgctctcccaccacaaggtcacaaactcccacgcagtcctgggtcaccccgcagctgctctggagacttggctctgggcgtctcgtggcccaagtgctccaagttggaagtttctgccaaaacaccaggtggccagtcctcacctggacccacaggtggcgagtgtgatggtgagcctggccctctccccacaggtgactcacctgtgggcctcgtgtaggggatgccgtgctgggtgagcaaacctttcagccttttgatctcctttgagagttctttatgagcctaccaaccacaaaaagagttcaagggaaagcccaggtgctggagggctactgcgtgccaccacctccccccaatacggtaccttcctgcagttttccagggtctcaaaccccaagctgtcaggacctccctccagctgggtgggttcattttcttctggggtctttaagtagccagcatcctcaaaaagtgtcctcagcaacttctcatggccctgaaggtggaggatgcaggggcagcacccagctcccagccaggcccaccaggggccaccccgagcgcacgcttacctggggggtgatcagctcatcggccaggtcctgctctacctggtcccactgccgctgcagggcctctggcagggttgggtacactgaggacccaagagaagccaggctcagctgcaccccatgtcccaaccctggcccccagcactacagggcctccagcagggctgcgtgcgcggctgaccccactgggctcaactgcgtcccgcacccctacctagcaaggcgtgggggtggcagacgaggggggtctcgaacgtcagcgcgtagacgcaggtgctcggctcggacacatgggccagccggttgctttttccacacgccagctccacctggggagggaacgtgggtaggtgggttggggagactggggcccctcttcccgggctcccgtctgaggccccaccttgctctgccggctccgggaacggcaggcgtcaccgtccctcatccacatgcccgtgaaggtgttgttggcgatctcccactcgtgccagatgctggggagacacgggcacggcacgtgaggccgggtggggagctgcgctgctgctttgggatccctgccccggccccactcacccgaggatcccactgtaggcgttccagcggaaggtctgctcgtgctgggtcacgttgtggaacgggcagaactcatacttgtacctggggacacagatggcatgaggggggtccgcaggctgcgccccagcccaccctcgcacccaccctgcactcacgtggactccaccaggctgaagcacttgcccgagagtcggaagagatgcacgggtcctggaagagacctcacactgatccccagggtccaagcacagaacctgtctgcaaagactggcagagtctgttttcaaaggaccagttttctttttttttgagatggagtctcactctgtcacccaggctggagtgcagtggcatgatcttggctcacttcaagctccgcctcccatgttcacgccattctcctgcctcagcctcccaagtagctgggactacaggcgcccgccaccatgcccggctaattttttgtatttttagtagagacggggtttcaccgcgttagccaggatggtctcgatctcctgacctcgtgatccacccacctcggcctcccaaagtgctgggattacaggtttgagccaccgcgcccggccaaggaccagttttcaacaaaaagcacaagacgttcaaagaaacaggaaaacaggtaccattcaatggaagaaactgacaaaaccgagaattctaaaaatagcccttcaaaaattagagttaaggcttgctatcgtggctcatgcctgtaatcccagcactttgggaggccaaggcgggaagattgcttgaggccaggagtatgacaccagcctgggcaacactgtgagaaccccgtgtctacacaaaaagcacacagaaaaaatgagctgagtgtagtggcgcgcacctgtaatcccagctactcaggaggctgaggcaggagaatctcttgaacccaggaggtggagagtgcagtgagctgagatcgtaccactgcactccagcctgcgtgacagagcaagaccctgtcttccccaccccccaaaaaagaggacattcccagataaaagcttcaggagttggttacatgcaggccggtgtgccacccggggaagtgagcagacagcagctcagcggaggcagacggaggtcctcgtgcagggtgaattaataccagttgcctttctagctatggtctgtaaagctacaggacttaaaccagtggtccccaatctttttggcaccagggactggtttcatggaaggcagtttttctaccagccgggggtggggatgggtggtttggggatgaaactgttccacctcagctcatcaggcattagattcttttttttcttttggagacagtctcactctgtcacccaaggtgaaatgcagtggcgcgatctcggctcactgcaacctccgcctcctgggttcaagtgattcccctgcctcagcctcccgagtagctgggatcccacgtgcccgccaccacgcccagctaatttttgtatcttcagcagaggcggggtttcactgtgttggccaggctggtctgcaactgtggacctgaagtgatccgtccaccttggcctcccaagtgctgggattacaggtgtgagccactatgcccggcctgaaagactaacttcagatttaaagacataaacaggttgaaagtgaaggtatggaaaagtattcatataaacaggcaaaagagagctgaagtggctgaaactattttaagagacaaagatgttatacattgataaaagggtcaatgtgccaagacaccacaattatccacgcacaaacagtgccacccactacataaagctgacatgagacatccatacgccacttttttttttttgagacggagtctagcattgtcgccaggctggattgcagtggcacgatcttggctcactacaatctccaccactgggttcaaccgattttcccgcctcagtctccccagtagctaggattaccggtgcctgccatcacggctggctaatttttgtatttttgtagagacggggtttctccatgttggccaggatggtctcaaactcctgacctcaggtgatccacctgcctcagcctcctaaagtactgggattacaggcgtgagccccagcgcccagcctgatggattcaatatttttaagatgacaataccacccagagtgatctgcagattcaatgcaaccccatcaaaaccccaatgacagtttttgcagaaatagaaaaacacatcctaaagttcatagggagtctcagaggaccccaaatcatcgaacaaatcttaaagacagagttgagagactcgtacatactgattccaaaaattacttcaaagctgttatgatcaaaacagtgtgatactggcataaagactggcatagaggccgggcgcagggtctcacgcctgtaatcccagtgctttgggaggccgaggcagacggatcacgaagtcaggagatcgagaccatcctggccaacatggtgaaacctgatctctaataaagtacaaaaaaattagccaggcgtgatggcggatgcctgcagtcccagctactcgggaggctgaggcaggagaattccttgagcctgggaggtggagaggttgccgtgagccaagatcgtgctactgcactccagcctgggctacagagttagactctatatggaaaaaaaaacaaacccatcaagggagtgaaaagacaacccacagaatgggagaaaataaacactggcaaaccacgtatgtaagagactcacatccagaacacagaactacagcccaacaataaactcaagttaaaaatgggcagagaagccgggaatcccagcacttcgggaggccgaggcaggcggatcatgaggtcaggagtttgagaccagcctggccaacatggtgaaaccccgtctctactaaataaaaatgagccaggtgtggtggctcacgcctgtaatcccagctacttgagaggctgaggcaggagaatcgcctgagcctgggaggcagagcttgcagtgagccaagatggcgccactgtactccagtctgggccacagagtgagactccatctcaaaaaaaaaaaaggacaaacaccataagcaactgaaaagatcccacatgactgatcattagggaaatgcaaattaaaacaaccctaaggtaccgcttcacacccactaggatggctgttagcaaaaaacagtgttggtgaaaatgtggagaaactggacccctcgtgcaatgctggctggaatgggaaacggtgcagccactatgcaaacagtttggtggttcctcaaaaagctaaacatggaattctaataagatccagcaaagctactctcagaaattggaagcagagactcaaatatttacacccaagttcacagcagcctattcccaggcagagggtggaagccactccagtgtccatggacagatgacgggtaaacaacaacgtggtctgtccttgcagtggaacagtcctcagccatataaaaaggaagcactgagagcctccagcctgggggaccttggggacactgtgccaagaggagttggtcagacacaaaaggtcgcacacagttatgagtcacctatgtgacgtctatgaatagccaagttcagagacagcagaatggtgggtgccggggctgggggagcggggcagctgggagtcagggtttgaaggggacagagcaagttgtggagatgatggtgctgacggttgcagggcagtgtcaccagcgcctgggggaagagggaaggcgtgcagcgtccctaccctccagccaggccagccccaggcagtgctagagcaagggcgtgtacacatcaaggccagtggcaactcgtgagtcaagccacagcagccaccctgttctttaagctggggagtcgggacctggctggggacgccaccttaacacagcgcccaccgagactgtcagccacgggccatcctccaggactgtggggaaggctggggcttgggccgtggaggcagggaggggactggcccccatccccgtcccctgaagggcctgcgctgcagcagcaagtgcactggttagaggaggacgccccagactgatgtttcaaactctctgtagttttaccgtattaataataaagtcgaggccaggcgcggtggctcatgactgtcatcccagcactgtgggaggccgaggcgggcagatcacgaggtcaggagatcgagaccgtcctggctaacacggtgaaaccccgtctctgttaaaaacacaaaaaattagccgggcatggtggcgggcgcctgtagtcccagctactcaggaggctgaggcaggagaatggcgtgaacccgggaggcggagctggcactgagccgagatcgcgccactgcactccagcctgggcgacacagcactccagcctgggcgacacagcgacactcggctctaataataataataataataataataaagtcgaaatacacacgaggtgctgggtgactgttccctgggaatctggccagcccaggagccagatgccacactggggccaccctcagcctggcccccgcccccggagggcagaggctaatgccactgagacctctggggtgctggcccggcctggccttctgttccctgacattccactcacccctggggctgtcccctcccaagacagatggagaccaagatggccaggctgccctgctcaggggacaggggctgtggatatagaaaggtcctggtccttccttgtcaaataccatctgggtggcccctactcccaggctcacccactgtcctcccagcctgaccgctgggggctctacctcagccctgtcacacctgctgtcccacagcctggggtgcttgggcttggtccctccagtctggccctagggccctgcccaacaggcacatagggaagcctttggagccatcccagagaccctgatgtgtccctcacccatctgccactcagactcctgcccgcagaccgccacccgcacactcccgcccgcagacccccgcccgcacactctcgcccgcacactcccgcccgcagacccccgcccgcagattcccgctctcacactcccgctgggagggtggctggtcaagctcctgtgtcctgggaactcacgttcccaggcttgccccaggcagacactgcttggagacaccccaggaggggcgtgggcgccgggcttagctctgcacctgcagggccatccgtctaaacaggactgtgtgagggcagcggggcctggcctggctccccagctgggaggaggcctctgcctgggtgctgtccacagcttcagtggactcctactggctgaggtgcagcctcccgcaggggatggtaccacaagcccccaactggcagtgcccagtaccccaggtcctctgctgctggcccacaccagaaccccggccacggcccctcccctccgcctggccctcaggtttcagcagcctgtcctcctgagacaggtgggggctggcccctccacgcctcttgggccagacacagccatacctgagcgggagtctctacccccaaataccaccacccccaaatgccaccacccctgccgggaggcttctcctctgctcctgcttcacccgcacgtcccctgcaggctccgtgttcacggcctgcatggccaggacactcgccggtgcccttggctcccgcgggcccaggtggccttactgccagctgtccctgcacccgaggccacagctcaaggcccatcagcttggctgagcctggactccgtttcccctctgccccggtcaggcttcggtgggcagcactccccctagggctgcgtctcttggtgacaatcccttctcaagggtggtcctccctcccacgctgctccctggcccggccccacacctggtcccagtaccctcccaacctccacaacccccacacgccaccaagaacttcaccggggacctcaccctcaccctccggcctcacgcaccccctggtgagtcctgtgcccaccgtgaccctctccaagcaccagggactgcctggcagacccagcccggccccagccgaaagcaagctcccagcctgacccctgcaactcacatgctgggagccgcacttgccatggcttctctagccaggatcccggggccactctactcctcccccgccccctccccagatccaggaccctgccaaggccccagagtcctgcccagctggccgctccctcccaccgccaccgaggcagagctccctcctggacagtgtgctgggctatgctggactctgctgggcgctggcaggaccaccacactgaccgtgccccattccctctccatgccacagcgggacactgtctccaaatcacagacctaccaacctctgctcctcctgctgtcaagggacgaggctcccgactcatctggtggaggccatggagctgcccactgcccagcccagccccaccagcctcggccctggcaagcccaccccttccttctccttggcagacactcttctgcggggaccttctgagccctaggccacaatcaccacgcccctgagtttctcagcctgattatctttctgctcagctcattccacagaccacactctcctacccactgcacacaatccgcctcacacgttgatgttgaaggagcgctacatcaaagacagaaaaaacaagtagaatatccacacccgaccccacagacgcaggagaggatccacacccgaccccacagacgcgggagacgatccacacccgaccccacagacgcgggagaccatccacacccgaccccgcagaggcgggagaccatccacacccgaccccgcagacgcgggagaccatccacacccgaccccgcagacgcggcagaccatccacacccgaccccgcacatgcgggagacgatccacgccccaccccgcagatgcgggggagtatccaggccccaccccacagacgcgggggactttccacgcccggccccaccccacagacgtgggagacaatccacgcccggccctacagacgcgggggagtatccacgcccagccctacagacgcgggggactatccacgcctgaccccacaggcgcaggaaaaaatggtctggagaaaaacaccatcaacaaaacaaaaagatcaggaaactgggaaacaaatgtgccacttacatccaaaggtgggaagagaactgttccaaattaaaacactaaagacacataatgaaccaaatgcacatgtgaacctgactggccctgatgtggggatgggggtgggaaaactagaagaggtattcttttctaaatttttatgggttttttttttttttttttttttttgagacgaagtcttgctctgtcacccaggctggagtgcaggggcatgatctcagctcaccgcagcctccgcctcctggattcaagcaattctccagcctcggcctcccaagcagctgggattacaggaggataccactatgcccggctaacttttgtttttgtggttttttttagtagagacggggtttcaccatgttggccaggctggtctcgaactcctgacctcaagcgatcgtcacacctcaggctcccgagcaacatgcacgcaccaccacgaccagcatattctgttttctttccaggactctcacctccaaaaagacgtggtcccattagccaaggctgcctctctcctactggaaggggttcggtcgggaactgcgctgttacacagtggcctgcctcctccccagcttcttgggataggtggtggcccgactccagcacttcaggccctgggaagccaccatcccatggcttctgagccgcagggaagtgagcctaaccccaggtgcgccatcacgcccagccacacaacaaaaaacttaaaaagatgtgtttggagtcaaagtccaccaaacctaccaacacggtgcggcaccatctgatcccctttatctctgatctgtggctaccccagctgaatcccctctggccctggctgtcctgctcaaggcctttggccactccctttcctggatccctttccccaaatagccacagctttactcccttttctcctttagcttttggctgaaatgtcacttcttagacttttcctcagcaccctatttaaagcaatccccaccaagacaggaggattgcttgacgctgggagtttggggccagcctgggcaacatagtgagacttccatctctacaagaacacttaacatttgccgggcatggtggcgtgcacctgtagtcccagctactcaggaagctgaggttggtggattgcttcagcccaggagttcaaggatgcagtgagctatgattgcactactgcactccagcccgagtgagagagcaagaccccgtctctaaaaaataaaaaaagcgatcccccaaacaatactctaacacacatacacacactccctcctctgcttcacacatctacatggcatttttcatcattggccattctatgtattttatctaattctacaggctcagtgcctgttcctccatccctccccattagactgtcagctccatgaggacaagcattggtatatctgtgttcgtttctgcaaccccagcacagaccctaacacataaaggtattcgataataaaattactaaagctgggcgcggtggctcacgcctataatcccagcacttttggaggccgagatgggcggatcacttgaggtcaggagttcgagacccgcctggtcaatacggtgaaataaaccctatctctactaaaaatacaaaaatttgctgggcgtgatggtgatgcatgcctgtgatcccagctactcgggaggctgaggcatgaggatcgcttgaacctgggaggcggaggttgcagtgagccgagatcgtgccactgcactccagcctgggcgacagagcgagactcttgtctcaaaaaaaaaaaaaaaaaaattcttggatttttgtctattatatttaatactcattcagcgtttaaatgatatatatactcatgacccaccaattccacttctggaatcctgcactgggaaaccgctcacctgagggcaaaccaaagcacctacacagcatgttctccacagaactatttctaatggccaaaaaaatggcaagaacctaaatacaatcggggagtgcagtgccatcctatcgcgtgctgagcaccaagagaaagaacgaagacctatatcatcaccatgaagcgtcccgagagatacagcgagtgacaacgacaaatcagccaaatactcgcgcagcatgattttttaaaaaagcgattagattacaaaaactatacgttttccagttgcatagacacgcacgtaaaagcacagaaacgcgtctgcaaagtcaccagactattaacagcagttacctctcggaaaggaaaggaaggactaagtctggagataatttaattcgctacaagaacgttctggtatattctctcgtacttccacattaattttagaaggctgacaaaccaatgctttagactccgggccgtaactctcagggtcactcatccatcctccactgttgctgctccccgcggccacccccgcgccggccaacagcgctcctcactcaccagacacgggtgaaggatccctcttggcctggaggcgactggcctgaggcaagaacgggttgttcaccctacgggaagcggcaaggtcagcggggaacgggcccgggccgtcccccgctcgagccgccagcccgcgaggctgctcacccaaacgcgttgggctcctccaccaccttcatcttcgctgcacctgccggcgcgggccctacggggagcgagaccgtgagcggggaggccggggtgcagagcgcgcgcggggcctggggacgcggacggccgggccactcaccgccggccgagagcccgaggagcaacaggagccgcgccagccccgccgccatcgcgccgcagcggccgccgcgcggtcacgtgaagtgacggtcacgtgaccacggggaccggaagtggcgtccggcgcaagcgctggcagccgcacagcccattgggaggccgaggggcgcggccgtggggtggggagtccccggcaccccaggtccgcgccatgggccgcaggagggcagcgcgcgggccgggggcggaaggcggccgccctcggcacctcccgacgcgctccctggaggccttcgccgaggaggtcggcgccgcgctgcagggtgagcgaggcgtgatggggagagcgggtcagggtttgagggcctgcccgggggtcccacgctgaggccgagtgcccttctctctctcgtgcagcttccgtggagccaggggcggctgacggcgagggcggcccgggcccggcggcgctgccctgcacgctggccatgtgggagttgggccactgcgacccccggcgctgcacgggccgcaagctggcccgcctggggctggtgcgctgcctgcgcctgggccacagattcggcggtctggtgctgagccccgtgggcaagcagtacgcgtcccccgcagacaggtaggcgcgggaggcctgcccgaggtcgtcttcatttccagcgcgtggttcccttcagggatggtttagtggcacttgtatgtcgcacccacatccacacccacgtgggcagggaacgtctgtctagtttgcctccgttgcgtagcgcagagcctgggataaaggaggttttggggtaataaacgtttgttgagtgaataaacacatgctccaggtgccccaagcagctgcctcaaaagcttgctcgtgaagtccgtttgagggtgtttggggatggcggaatgatgtccctgaatcccttagctaggccattctccggggcatgctccaccttgggtagtgctggctcctgaacttatcccatgctgtccctggcagacagctggtggcgcagtctggggtcgccgtcatcgactgctcctgggccaggctggacgagacaccgtttgggaagatgcgagggagccacttgcgcctgttgccctacctggtggccgccaaccccgtgaactatggccggccctacagactttcctgcgtggaagcgtttgctgccaccttctgcatcgtaggtgagtccaggggccccacagcagtgtgacccggcggcctgctgttcctgctatgctcccagcatcatgtttcctgccgacagaccccaggaggagcataagggacggacaggggaacagttcagacagaccacggttccagccccaactgtcacttcaggttttcggcctgtggagttgcagtagaggcagaatgggatcgctgttctatcagggccggtgtgtggggtgccattcattatcagggcaccactgcccagagaatcctccttatcctccacgtcctccttactgaattgctgatctaaagaggccctgatgaggcgtggggcagtcttggtgggaatgtttgtttcgcagcaaaggagggggacttggtcggttgcagaggtgtggactgtagcaagggaggtgcaggctgggggcagcacgggttctcaggactgtgagctgatgtttgctggggaccctgcggttacttgggagagcgccgccatccggcagcagggtgatcaggaggcacttgaggggaccgtcgacttctttgggtttcctgtttctcacaccgtcaggctttccagaccttgctgtcattttgctgcggaagtttaaatggggcaagggcttcttggacctgaaccgccagctcctggacaagtacgcggcctgcggcagcccggaggaggtgctgcaggcggagcaggagttcttggccaatgccaaggagagcccccaggaggaggagatcggtgagccttggcggggtgggaaccaaggccctccaaagcctggggggtgggaggcctggtcctgctctgagctcacttagaggccactttcctctctcggctcagatcccttcgatgtggattcagggagagagtttggaaaccccaacaggcctgtggccagcacccggtaggtccttgggcttaatttcatgatcactcagacccagggctctcttctacctctggcctgagcccttcctgctgcctgggggtggtgttgtaaacaacaccccgatggtcttctgactagaaaacctgcagtgcatgtcccactggagaggtttgggtgtggagagcacagggaggaagaggaatctgtcctcggctgggggctttttgtggatgacgttgactccagctagccagggaggacgtcatttgggaacgtgctccccctcctctcccaggctgccctcggacactgatgacagtgatgcgtctgaggacccagggcctggcgccgagcgcggaggagccagcagcagctgctgtgaagaggagcagacgcagggacggggggctgaggccagggccccggctgaggtttggaaaggaatcaagaaacggcagagagactgagggttgcagacacatatatttttgaggctgggtgacgagaaaatctagagacatgagggacataaatgggcctggcagcctcggctctttgcggctgctggcaggactgagctgtccgggttctccccacacttccagcacagctgtgctctgtgtcctgcctcggcgctctcgcaaatgaagctgcaggccaagaagccccttgtgagtctgtttttcacactgggcctggggaagggttggggcgaactctcggctctgcctggaagggtcgtggagcaggtctcaggtggccacggatatgtgcgtgaaggacagctgaccagttggcacggagcccttcacactgaccaccagccttgggtgacgtccctggcctcagagtgacctcaggggaacctttccccggcctgggagccccgtggggactggagacctatgcggttcttgactcacctgccctttgcatcccctctgtgggtggaggctctggaccatccacccagtggtgccagtggcacccttttcactccccagctgtgattaccaaaaatgcgtctgcacattgcccgttgtgcagagagcacagccactcactgagtccctggagaccagctgcccaccgcccacccagggccggggagcccaaggaagcgggcagggaggcccaccaggtggtcaagcccgctctggcctgcactgtgtcctgggcagctgctggccaagtcctgccaagttggccacccagatgtggggttgggtgcaggggttcacagcacacaccagacagacacggccagggcggtaggcgccgcggggccagccacgacacacacgtcacagcacaggaggggcgccgtgggccctggttgcacaaagctggccacagtgagctggaggatgcttcagggaacttggggtgggggccagggccggggctggcagctgatggactcaggggtccgcctccatgcacttctccagctccttgagtttcttcacgaactcctgcgcctccttgctggtgcggccttccagcctcctcagcgcagatctcactgcaagcagcgcgggcaggtgtgtgggggccggggtcaggcccgctgcccctgcctccacccagatgctcactcaccctgggctctgggccggcacaggtgcagggtgacaggctgcccagcccttgcacccccgcccacctggggccgggcgacaccagtgacgccacctaggccgagggccgcctccccagcgaagtcgttggtggacagccagtcgtggtccatgacggtgaacaacacacaggccgcgcggcggcggcacgcctcggcaggcacggaactgcggacagaggccagtcgggagtctcgctccggcagcctggagcctggggctggggctggggcttaggacactcacaagtagaagagttcgtcgtatacagggtgcagcgtccgggtcttcacctgggtcctctggctgcggaccagtggaaagagatgcggtgggcccagctccacgatcacaaaggggtcacttaagcctgcaggagcacagtcgtgagcccccctgcccccatcccaccaccacccgacccgtccccgctgcaactcaccgttggcgtccagggggagcaggtccgcggcgtgcagcacctccacggccagccgctgctcagccgcctcgtaatggcaacggacgctcaggcgtccaaaccggttctgctccagggtcctctgcggaaaggcgggtgagcgcagctgggctctgggagcctcggaggcagcaccctgtccctggcgcctccctacctgtttgagcttgtccaggtagaactgctcgatgcactcgcgggtggaacatttgtgcagccgcagctcctccttcagcctctgcagggggaagcgcatcaggaggggcccctgggtgctggtggtcagcgctggcacttggagacctgactgcccgtggggccacctcatgctcaaggacacagcccgtgtggggctgcagtttgaactcagtcccctcatccacacccccgccccacagagggtcccacctcaccttgtagcttccatccctcaggctctccaggggcaaaccctgaccctctgcgtggaaaaaactgaccagggcctggggcagggaaagaaggcagaggtgtcagggagcctggcttgtgctggggacaggtagagacccccagcacaaaggggcccaggcagcactgggggctcagcagccaagggcagagccctttctcacaccctggcgggcatcggaagctcccaggaagcgtggggaaaggccatcaccagaggccacacctcggcattaacgggaggaggcgctgtggacagccctggagtggctgctctccagccacaggagaccaggcaggccagtggggacaaagggagggatcagagcagccctgaggcgggggccggcggggaggactccttcacagagctctacctccagcgtgaaatggaagcggctgtagaaatcagcagagacgtcacggtttgcacccagcgcctgcagaatggcctggaggagtagctcccacagggcctccagcaccctgcagggcagcatcagtgaccacgggccagccccacctgccccgctggccccacctgcagaatggcctggaggagtagctcccacagggcctccggcaccctgcagggcggcctcagtgaccacgggccagcccagcccatcccaccccacccgcccgcacctgctcaggttccccttcaccagcgaggcgttcagcagggccagcttctcatccaggtacttcatgagcggggccacggcctgcgggcaggggtggtcaggccaggcttaccccgcacctctgccctacccccagtacacacagtcctccacggcccctcgccccggcactcacctcatcgttctggatggagtcaggcgagagactgatgtgctgtacatacttgcggatgtcgcccaccatctgagggcaggagcagtgctcagcacgggcagggggcaccagggactgcctccacgccttggtctccaggccccacccaccttagaggtcaggtgcgctgtcaccgtgtgggcctcccgttgcagatcatcgtccagggcctgtgtgcagctgagcagagggcgggggagcaccccctcgggccccgtggccccctctggccatgccaggcccttcaaggcctgcccagcagccttgcgcacgagctccacattgttgaggaccacgcagagctggaggaggtgtggccaggcaacgatgggtccggggcctggtgatggccccccacctcctgccggctcccctccccagctggtcactcaccgcctcgctcactgcttcaccggccgcccctggctgagtgtccaccttcttccgaagcagctccgtatagaagagggtggcctcacacacgtcctgaggaggggatggcggtggggagccatggagccctcccctgccccatctcctctcccacccgttcccctcacccccagggcccacccacacacctggccaagctgggtgcccagcccctgagcctgggcagggtcaggccacgccaggcgcacccacaactcctggatgtggctgaggcagagaccagcagtggctgcggagctgctgtgcctggaggaggcgtccacgggctccagctagggaggcaggggaggctgggtttgctggggaggcaggggaggctggggaggtgggggaggcgggggttgtgggggaggctggggttgcggaggaggccggggaggctggggttgtgggggaggctggggttgctgaggaggctggggttgcgggggaggctggggttgctgaggaggctggggttgctggggaggctggggttgctggggaggctggggttgcggaggaggccggggaggctggggttgagggggaggctggggaggcggaggaggctgggggttgctggggaggctggggttgctggggaggcgggggaggctgggggcctggaccagccccagtgtcctcaggccagggcagctgtcaccgtgtccatgtccacggctccctgaagcctccacttggcctggtccctcagcacttggaaccagagcttcacagcaggcaggaagggggcgtggatgccagccagggccagagagcggctgtccctgtggtgggagggttgtgagggctcggccctgactcagacaccttaaccagcacgttccaggctcacagctccaggaccgtccccctcacaggtcctggggccctggtcccaaagtctgtctgcaagagatagggacggggcacccaccggccagggatgctatcccagaagcgctggaggtcagccagggtcaggtagagctcaaagagccccgaggccacctccagggtcatcttggggctcagctcctccgtcagcacccacgcctcctcagccacctgtccgggacagcaggatcaggcctccagcagcaaggaatcccaggaccgtcctagccaagggcatctgcccacttccccatgcctggcaggcacccggggtcagggaccctcctcaccagacgctccagctgccggaaggtcagggtgaagacgtccacattgaggatgctgcagagcaagggacacacctcatccacctgcgccccacctgcaggccctgttggctccgaccccagccccaggacagcactgaggggccaggcccacctgtggaagaggctggcgtacacactgtagcagaactgaaggtcatcatagacggcgtcagccagcacaaccagcccaggcaggcgctgtggtcctggctgcaaggaagcctagctcgtacccacctctcggctgcccgtacccctcatggccagggtcccccacaactgcacctgctctcggggactcttgtcattcaggatcctgtcgtaccactcacggttgcctctctgcaacagacaccaccaagacagcatggtggattgcagggaagaggaagaggtgggcaagagaccgtggtgcagaggtgcaggggacgggaaggcagggaaggggaagggagggcttagcagccggcctccactgggctttggaacacaccttcagggccgcagcaatgtccatgttcagctccgactcgaaggggcagatctcaaaggagggttggaagagctgcagcttgcccagacacctgggtgggggcagcacgctgacgtggggcctgccctgccagccgcccccacccacgctgacacgcggcgctgcacccacttcagcagcagctccaggcggtggacagcggtgctgttggtggcagggaagtagtctcggagctggcgcagcagctgcagcccgaactcagagaaggcggaaaggctatcagccaggctctcctcctgtggggacagggcccttcagtgccagcagccccgaccggccactgatgaggagaaacatcctccctgccttggcccgcaacacccttccccgggcatggtcagcccagctctgctctgagcagcaccctccacaggcccagtcggcctgtcccagacggcctgtcccagcctcggtttccacccacgcagctcacgtagggcctgtgcccctgcagttcccacgtccgtcctgccagggccgctccctcctgtcgctcagatgggcgccaccttggcggctttccccagccctgtcctaagtcctggccgccccccgaggtgactcccacgagtctcccgtctcctttctgcagagcgctggctctcgcccacgtcatacagtttgtccatttgtctttgacccccacgcgggcaggactctgcccctcgccgaccggcactgagcgaccccagtccccagcactcccttcgccatggctggcaagaaggtcccggctgcacccacctgctcctggggcagtgaaggagcctcttcccagtgtgcctgcatgtcctccagcagccccagcaggtagctgtagtccagcgtgcaggtttgatggtggcggctgctgacctgccagtgcctgtggggcccggcccatggtcaaagggtatgaaccccgcccctgccatgcccactcagcaccgcctacagcactacccctttctctgccccacccaatcagcactgccgcgcctactcatagcactgcccctttccctgccctccaattagcgctgccgtacctactcatggcaccgcccctttcgctgcctcacctacccgtagcaccgcccccttcccttcccgcccaatcagcgcagccccacctactcagcaccgcccctttccctgccccaccctcccagccacgacatccactcaccgcatggcccccgatgccccactcgctcacgcccgcccacattccccgcccactcgtagctccacccactcacagcacggccagctgcaagggtgacaggttgctctgggctccgtgcaggcagaggatggtggcggctggtgtgctgagctctcctcgccagctgctggagttgggctgggggaggaggtctgtcgtgggtggaggcgggacagccccacatcccctcctcaggccccctgccgggctgttccaatcctaggcgcacccactacctcctctgctgagtgctccaaccgcagcagatggctgagcagcagcaggtgggacaggaagccggatcgcccgcgctggctcatggccgtatccctctgcaacgcagagcccacccagtcaccagctctgcccccgccccaaggacgggggtggaggacggggacgcccactttccccacctgcgtagtgatcagcttgagaaccaggtggcagtgtccctgcacacgcgaggcactggagcgtggctccagcttgaaccagcggtcgacgccagccacaggcacctcctgggggtagcatgggggtcaggcccaccagactcctccccctccccttccacactgactctgtgagaccctggagagaccacatggcctgggcttcccttctccggggaatgagggtgacaagcgcactcagtggaggcccaaaagcaggagcttctccaggcagtgccctgccccttgaaggctgggacactccccaggcccttctctaagtgtcaccagccccaccccacacccactcacccggacaggtatgttgaggcaccccaggaagtcatcggtgtggtcctcggtgggtcctgctgtcccgtttgcgcgggctgacttgacgatctgtttgaagtacctggccaccacaggtggtgagcatcacgctgatggctcctggggagccactgcccgccgggccccatgaccaagctgagggcacgggtgatgggtagaaaggtcccagcagtcatacctgcccatgcccttcaggccgatgacttcattcagcttcctgcacgcttctaccagggatacatcgtcgtcatgatccctggtggggacaggggaggacctggcttgtctggagcccgcagccgggccctgagtccgtcctgctcccccgcaaaaggtgtgcatccccgccgccctgcatggcgcaggggcctgtaccagatgtccaggtgcagctggtccgtgctcacatcctcaatctcgctacaaggagaacagagatgcccatgagggtccccggcgaggctctgcccaggccggggtcagggagtccagaagcagcagggaccaggccacaagcacccgctctccagacaggctgttcaggtccaaatcctgatcccgccaggtgttgccagccgtgtggccccggtggcacaacgcccatctctgggcctcagttttctcctctggaaagtgggcacacggccccaaagagaccgggagctgctgcgagccaccaccctccaggcacagcccagctctggaccccaggcagagcccccctcccgcacccagacgggcgagggcctcacaagaggaagtgctccttccagacggggttcagggtgctgctcttcacctcggtgacctggatgcacttggcaggcaggggtccaccgcgcttgctgcccttgcggaagccgaagcgctgctccttctgtgcacggggctcccgcgtggcgtccgaggcaggcaggatgcccagcatgcagtatgggtcgctgaagcctgggcacggcaggcgtctcagccctggccccacgccctctggccctccatggccgccaggcctcggcgcagccgaggtctgctgggtccccactcaccgttggggtccttggccagaaggttcttggcacgcatgacagagactttcagggcatacgtgggggcctgtggacagaggggcgtggggggcctggtgaggctgagctgccccccagatgccctacttagcatggaggtgacagggccttgccccgtgcccccgccacgcaggcacgtgctggtcagtgcctgcccaggcagtggcggcctcaccttggccttcctcactcgctcgatggcctcagtgtgctcctcaaggctggtgccaaacacctgtggagggtggctgggttggcagggcctaggcaacccctgaagcgaggctggccactgtgctgggacctcgggctcagcccgtcacagacacccaacctcagtcctcacgggtgcagggttgggggaagcctgggaggcagcggcagagggtttgtgccaaggggcctgggcatgcccagagatggtgggtgtgatgagggccacgcaagtgcatgcgtgggaatgggggccacgggaggacaggggagttcagagcacatgcaggtggaagccgggagcgtccttcgaggtgcgtctgtcagcctatgtgcatgtatgtgtgtgtgtctgtgtagacatgcagcctgtgtgtgtctgtgtgcacctgcagcctgtgtgtgtgtgtgcgtgtctgtgtgcacctgcagcctgtgtgcgtgtgtctgtgtacacctgcagcctgtgtgcgtgtgcatctgtgtgcacctgcaacctgtgtgcatgtctgtgtacacctgcagcctatgtgcgtgcatctgtgtgcacctgcaacctgtgtgcgtgtctgtgtgcacctgcagcctgtgtgcgtgtgtctgtgtgcacctgcagcctgtgtgcctgggcatctgtgcgcacctgcagcctgtgtgtgtgtctgtgtgcacctgcagcctgtgtgcgtatgcgtctgtgtgcacctgcaacctgtgtgtgtgtctgtgtgcacctgcagcctgtgtgcgtgtgtctgtgtgcacctgcagcctgtgtgcgtgtgtctgtgtgcacctgcagcctgtgtgcctgtgcatctgtgtgcacctgcagcctgtgtgcctgtgtctgtgtgcacctgcagcctgtgtgtgtgcgtgtctgtgtgcacctacagcctgtgtgcgtgtgtctgtgtgcacctgcagcctgtgtgcgtgtgcatctgtatgcacctgcagcctgtgtgtgtgcgtgcgtctgtgtgcacctgcagcctgtgtgcgtgtctgtgtgcacctgcagcctgtgtgcgtgtctgtgtgcacctgcagcctgtgtgcgtgtgtctgtgtgcacctgcagcctgtgtgcgtgtgtctgtgtgcacctgcagcctgtgtgtgtgtctgtgtgcacctgcagcctgtgtgcgtgtgtctgtgtgcacctgcagcctgtgtgcgtgtgtgtgtgtgcacctgcagccgtctctgtgtgctgtgcacggatcggggagattctgcatactgtttgggtgatgatggtgtcagtgggtggggaaggggttgaggtggggaagctgtcagggtctgggtcggggtcagggtgggctgacctgctggagatagctgagcagggcctcctcgtcgtccacctggtcagggcccatggtacccgcgcggtaaagcaccgtgtacagggcctcctcgtagagcatctccacctgcaggtgggggaagggcggccacagtgccgcgtcccaggcccccagccctcagcagcacctcctgtctgcctgagcccaggccccacctctgcctctttgcaccaggagcccctccgctcctcactcacccacccactcaccctggctctctgccatcaccagaccctgtgcacacagtaggtgcctctaaacggctgagggagcagccgctgcagacgactgcccctggttccgacccccacctttacctcctctggggccagggctctcaggccgaggctgggatccacaggctccgggggtgctggcgagccactgcgcagggggacctgtgtgtggggcccagggtgagggctctgacggcagggagagccccaggcctgcagcagggaagacaggtggtgccccaggaggtgggagcgagggcaggagggagcggggaggagcaaagggggagccccatgctgggctgtggtatcgggccctgggggtggcacccttacctcgaggcacggcaagccctgtctgccttcccccttcttcagcatgaggcgcatgtgggcaaagaactccacgccatccccgggtttcctggagaaagagccgggtcagctcacagctctcagcacgctggcccctgcctgggaccctcgactccaggggcaggaagggccatgtgacatccacagtgtggcacagctaactgcagaccctccttcccgcccaggggtgctggggcaggggcggccatgtgtgaagtctggcgggaaatggccctgtgggcgtgtggggctgggcccctcggcacccaccaggcccccgtggcaggctcctgcgggtcggcgctggcactccctgggtcctgctcagtcctgcggcggaaggacgggcacacctgcacctgcctgagcacgctgctcttaatgtccagcaaggtcgacatggcgggtgacctacagcagagagcacagcccgcagcctcaggtcgtccactcaaccctccgtgcaccacagcaggcgggggggtgggggggtggggcgggaagaggtggggcagaggcctgggagctcacccacagcctggatggcgctgggcacctggtcaggcggtgagggctcctgtccccacacctgctgggtgaccggctaagtccctgcgccccctgcagggcggcttcagggaggaggtagcaaatgctgtcaaaggcggggctggtgcccacccagagctgggggtccatcagggacttatggggtctcactggcgagggaggcggttgccacactcgccccccacacccctccccgcgacagcacagcaggaggcgcctgtttcctggggctgcatcaagaggaccaagatctgggccacagcactcagctcccccagcccccgtgccgactctggggccaggacggatgccaggtacccagctctcctatgtaggaggtaaaaactcgccagaaccctgacatcctgggtggaggatgcccatgtggccaggaggccctggaggggactgcctgggggtcctcgctcaccaagcacagcgggggtcaatgccccctcctcaccccaggagctggtcagcaaacctgaggtggacagtagaaggtggggggcagtgtccccacaaagcagggcctgctccccatagttggtacaaacgagaacatgaagcgagccgggccccgctggaaaatgccgggtgtaggggctacagttccctcccagtccatccagcgtcagttcccctcatgttgccatgacaactgagccaacctgtcagcctcctgcttggagcagcagcagcagcagcagcccagatgtcaccgctgggacagagctgccctctgccaaggcccggagcctgggcccaggcagacccggaagccccctggaaggccccacccactttttgttttgttttgttgagatggagtccaggctggagagcagtggcatgatctcagctcactgcagcctccacctccaggttcaagtgagttgcagtggcgcagtctccgctcaccgcaacctccgccttccaggttcaagcgattctcctgcctcagcctcccaagtaactgggattacaggcgcccgccaccaagcccagctgatttttttgtactttcagtggagacggggtttcgctatgttggccaggctggtcttgaactcctgacctcaggtgatccaccagcctcggcctcccaaagtgctgggattacaggcatgagccagcaccgcccagcccacctgtgtcagggaggaaggccgggtggtcctgccctgcacacccccttcaacaggggtaggatgatggctaagacaccgtagcctcctgagaccctcttcctctgcatgggtgcaggtgcagaccctccacctctgcactgcctctgccccccagcagccccagggaggtctcctccccgctccatggaaactgtcccagagccaggccacctctgccccaccacaagagaggtacccactcttgggttcctgtcccagccttgccggcctctgatttctaggacaccgcgctcccccagccccccggggtcctggccttgctgtctgggtcccttcccttgccagtgctccctcatccacctgcggagggtgcctccgggctgggcacactggccctcgcaaagggcatagtcattctcacgggacaggagaggaaacgaagaccagcaggttctaccgcccactcaggctctcacggacagttggccctgcatgccaggccagctccccacagtggcactagactcataagctcagtgggcagcgtgggggcctgagcacaccatgccagtggtgggttccaaacggactttgtcgagccagctcccgggcccctgctgtgtctgtgggggttcagggtcaccagccccaagctatacccacaccagctcagacaccattcccggatatctcgtcttgattccagggtccctgccagcccccgagccctgggtgcaggctcttacgggaccagaccctagagctgaggacaggaaggagggtttgcgtctcccaccctgtgagaggcaatgcttgcgggggggactcacctccttcaaacctatcagtgccttcccctgtgagcctcccccccaaaagatgggggggcttggtaggctgggtacagtgcttctggaagctgtcacccccacagccagtcgtgaaatcctcaggggcctgggagtcacaagcccccttcccctcccttgctgggtggaagaggctgctccccctgctgtcccccgaagccagtggagcagccgctgctggagctgttgccagggcaaccgccgcggcatgtgcgtgtgacaggggcgatgggggctcgcagtcctggagacaaatgtgacgcaggagccaagtggcctgaactgcggggttggggagggggtgtctttgtgataacaagatgttccaggcagaaaaagggggctcggtaccctccctgcattttcctctccacattcacctcctcatccccagagcggcccgagaggggtgccctttgctccctgcatctcagatgggcaaacggaggcgcagggctgggagcccgcccaaggtcccagagccagcaagtgggctggggacggcagtcaaggtctctttggtgtccccagtgctaagctcctggggcaaccagctaggccagcccccctgaccccaactgcagctcctgcccctcccactgcccgttgctaggatgggtgcaataatggcgtcttggcacaggtgtacagaagacttggctcatcctgggtgcgcagaaacccctttggttcccctggaaaccccaggcttcctgggcagctgatagcctggctgcagccaactgcgtgggccctgggagccacctgccacagaggccggagctgctgtgaatggtgggcatatgcatctgtctgtgaccagtacaggaagcactggctgcctgggtggctctcagcacttacggggcaggagtgagccaggtgcaggggaccccccgtctttcccgtgggcccagacgtgatgtaactccttcccagtctctcaccctgggacagtagcatgaggcaggatgaacccccccatactctgctcatgcctgatgccaggaccagaaccacactcccatctgtccagtgagcagagggaggaccgccaaggagctcctgccttgtggcactggggctgagccacacctgcccatcccaccttgctccctggctgtcccccaggcctgggctgaatggggaatgacattttgcaaggaggatggcacatctcatttcacagcccagggtgggggcgacttgcccagagcccagatgtgaacctgggactcttaagccaagctgtctcctgccaggccatttgggggctcagggttgggggcagtgaggcagctgagtctgggggcagcggagcagaggctgggtcagccttcctccccagtgcaggctgtctaggaacaaacgccttcaacgtgttgggggcgcccttcttaccacatttggggcagggggttagctgatggtgccctgggtgtgtgcctggggcgggaggtggcaggacatctgccccacaggctggctctccacgctgccctcttggtcttctctccagcttccctgctcttcctccctcagccccccgactccccttcaccaggccctgggggtttcccgcaggaatctctccctggtctcaccgactcctccagatggcccctgcgaagccgatggcggtgcccaggtgcaggtcacctggcgggcccgctgcaaacgctgctccccggggtctcattccagtcgaaccccgggaatctgcattctaacaagcgctgccggtggccttgggctccccgaagcctcagacggctgccaaggtccagccgctggcgcccagcaggagcgcaggagaccggagcccgaggcgccttcttcctcccctcgcccgtgtctgcgcagcgctccctcctccctctgctcaccgaccccctccctgccccgcctcgcggcaccccctttcccggggccccgggcgcccgcaggagccacacccccagttctatgggggtctctcccctcggagggggcgggcggtccggggtgagtctgggggcgggtctagtgtgtcactttaaactcctcccccggagaccccggcccaggcaagagcccacagccctttgccgagtggggctgaaggaggggccgctttgcactcgcagggatttcggggggactaaagggccttacgaggacctgcgggaggagggaagggacgaggacgctggggggtgcagcccgcccgggaggggtgctgggaggccccgggcccgtctgctcccccggggagggaggcgcgggggtcgaagcctcgcttggcggctcaagtgcgggggaggccgtcgccagcgcccggataccctccccgtccgctccgcagtgcggaccccaccgccgcaccctctcctgcgcgttcggaggggaaatgcccccgagaccccgcccctccaagcatgcgcggcctcagtttccccagggccgaggggacgtcgagaccttcccaccgccccccgcctcggaggccacccccgtgcctcctgggggacccggaccaagggggcggcggccgtcggtccgtccgggttggggcgcggggccgagcccagacggcggcccaacagcactggccgcagcccgcggcacttaccgtgggccggcgcggggatgggggggctcctggggcgctgcgctcggcaccagctcggggacgccgaggcacagctaccgctcccagccgcgcgcgccgacgactgagcaactgctgggcggacgccgctgcgggggcggggtctgactgggggcggggccgggcctgaccggggcggggcctgaccgcgctcgccccgccccccgcgtccacggcgccttaggggacccggccggggtctccgtgccttgagccgggccggagccccctcccccgggatgcggggctgtgagtcaacccacaggtggctgcgggacggggagcgggcttggctgcctcgggaccccgcctggccgcgcgcgccctccccgtggcgcgtggggtctagaagggggtggtcggcggggtctcctccgcggaccccagggaagccacggtcacgaagaccagcagcggtgcagacctttctggaagggcctgactcagggacacctcgcgggccccgccgctctcttctcggggcggggatgcgtcctgcagggatccactcgggacgccccacgcccacgcggacggtctgtggggcgatcgtccctggggctctggtgagggcccagttggcgcttgtggggtcacagccggccagagcccccggagcccctggggtctgcactggaccccgccagcccctcccgggtggctccccgctcttcctccgctgcgctgtcctggaaccccagcgggcccgcggtctcctgcagggtttgttaaggcattgatgggtcctgtccccaacccgctggtcccgaagtctgggtgggggcgcgatctgcgttttttccctttttttttcagacagagtctcgaaaaagctctcaaaaatagctctcaaccaggttggagcgcagtggcaccatctccactcgctgcaacctcgaactctccggctcaagtggtcctcccgcttcagcctccccagtagctgggaccacccgccggctaatgttttttggtttcttttgtggagatgggggtctccctatgttgcccaggctggtctcaaactcccaggctcaagggatcccccttccccggcctcctaaggcgctgagatcacaggtgtggtccccacgccagccagcgcctgcacttcccagctccagtctgctgccgccagtccagggaccacactttgagaagtccgtgctaagcatggtcctgtcgggggcctgaggctctcagacttgccgagggcgcagcggccccccggtcgcacctgcccttggtcgaatacagctggacactcgcagccctttggggacaaggggtggggggtggtcagactttggagttttcacccgaagggcacctgggcagcccaaggccagacaggcttccagaacacagctcttcaaagggagggggcccgtctgccaacaactgtcttggcttctggatcccaactcactcaaatccatgcccgccccacacctgtctgtgcaggatcgggggcaggacccctgggtgggctctccttcgggacgctcggcccaggctctgccggatcctgacccagcacagccaggccggtgggggagggcagggagcttgcaggaaatgcagggactggctgggacagggacgcggtgggggaagcaggggagggggcctgggccctcagccccactctgtagcagtgttctcctgaggggctggtgggtctggagaccgggtctgggagtgacgcccctgcctctgcggtcttgcaccaggttctgcccacctgttggaacaaacacaggccggttgccatggtgatcacactggctttaagtgaagggacaggctctgcagctacggtaaacaggaagttgggaggggcagccgctgctccggcccctacgagagcaccaaccctgaaaccaacactgcagtccgttgggtgcgggagcacccttggagacctctccccactcttttctaggtagggagactggagtccggagacgggaaagggcttttccagggccacatagtgataggttgagtcccaaaccagccctgggcctccgtttccccaggagaggacggtcactaggactgtcccctccacaaacatttggtgaggagtcgaggaatgaacgatccgagcgacaccccactcagtgaccaaggccttcattctccaacttgttctgaggctgaagacaggctgacctggatcaaagtcccagcaccctgctcacccctgccccagggcgaccctccactgcccgggcctcagtttccctcttctgtaaaatggggacaacagcagcacccaccttgggtgcagctgggggacctcagtgagccagtctcaactcacagcaggtcagcctcagtcccagttggtggggatgggaactgcagccacccagccagaactccggcccctccagtgacccaatttacctttccatagcttggggctggaagcccatcctcgcgtgagtcccctcccactaagagagagggcaggagagtgggccgcccaccctccccaccctgagccccaggcctcactctgaaggggctaccctggcgtctctgccttcggaccggagtgcagacagctgccgtgctccggggacagtgaggggatggcgcaggtgcaggaacacctcccaccgatgtgtcgggacacgagaccccctgcccagacggggtcagagcttgaggaggctgctggggcaccagggctgcttgtgcaaagctgagaaaagccatttttcaagcctggctcttttcacattctcaggactttgtgctggaaagggtctggcaggcagggagagtagcttttcctccttagggccgggccggtggcggggggcggagatgggggggcaggtaaaaacaccaggctctggatacgcaggcgccaaagccgctgaagcacacaggtgaggccatggcagagttagacagcccctcctgttccacgctcatgagcacagcgcagggcccagtgctaccaccctctggtggcagccctagaaattgcaggcacagcctcccagaatctgcccccaacttccctctgaggacccaagcaaggaagggcagggtccttggagagctcgtggggtcagagcccagggactctggccagggaccctgcctgccccggagctggaggaccctgaagactgccagaacctgttccttgccccatcaagagaggggctctgggtgggagggcctcagcccaagtctggcctcatgcctgagatgctggtctccagatcccacaccagaagctccgggagtcctgctgccacgcgtgcacaggtggggccggctggaggtgaccacccagtgtcacgctggagttctctcaggcctccgtgctagtagcagcatctgtgaggggtccagggcagggcagggacaaagaagtgggcccaagacagggtcctaccaagcccccaaacaaaggccattggtgtgccagagccctgcaggcaggacagcccctgctgcggtgaggcttggatggcagggaggatggcaccctgtcccctggccccgcctcccaccagcctgagggtgggggtgtcagaggccccttcccagcgagatgggcttctgtgctcactgtggttaggggcccagcagggagaggccaggccctcagtgtgcatccttctgtgcagagctggggttgggaggcgactcctcccagctctgggggcttcagagtccctccttttcttttttttttttgagatggagtcttgccctgttgcccaggctggagagcagtggtgtgatttcggctgtaacctctgcctcctgggttcaagtgattctcctgcctcagcctcccgagtagctgggactacaggcgcccgccaccatgcccagctgatttttgtatttttttgtttttttttttcaactggtaatcaatttattaaaatagttgacttaagcatctgcaatggtgacttccacttcaactcctggctcaatactgatggaagtaatctgcttaacaatctcagaaggactgtgcaagtcaatgagttgcttatggatgctcatctggagtttttttttttataagtttttttttgagatggagtcttgctccgtcgcccagactggactgcagtggcgcggtattggctcactgcaagctctgcctcccaggttcacgccattctcctgcttcagcctcccaagtagctgggactacaggcacctgccaccatgcccagctaatttgtttgtatttttagtcgagatggggtttcactgttagccaggatggtctcaatctcctgacctcgtgatctgcccgcctcggcctcccaaagtgctgggattaccggcgtgagctgtaacctggcctcatctggagtttttcttgtagtgattctcaaagtgttggtaggattcaaaccggtcctttcactttgagattcttttcctttgtgcctctgatcaagtcagcacacaccttttcaagtgattttatgctgtagctcgttagagtgattcagatttggtgaattttggtgaatttggtgaatttggcgaatttggtgaattttggtgaatttggtgaattttggtgaattgccatctccggctccttgggtgtttttctggtatccttaaaagccaaaagaattttttaggccgggcgtggtggctcacacctgtaatcccagcactttaggaggccgaggtgggcgaatcacgaggtcaggagttcgagaccagcctggccaacatagtgaaacctcgtctccactaaaaatacaaaaattagccaggtgtggtggcgtgtgcctgtagtcccaggcactcgggaggctgaggcagaagaatcgcttgaacccgggaggtggaggccgcagcgagccgagatcgccccaccacacaccagcccgggcgacagtgttagacttcgtctcaaaaaataaataaatttttaaaaaataataataaagccatagctgctgcgtggcttcctgaccagcttgttccttggcgagagcggacagtggtgagtcaggagcaggagcgtgcggatcagcgattcacagcacctaccaccacgtcttcctcaaagggctaatttttgtatttttagtagagacagggtttcactatattggtcaggctggtcttgaactcctgaccttgtgatccatccgcatcagcctcccaaggtgctaggattacaggcatgagccaccgcgcccggcctaatttttgtatctttaatggagatgggcatttgccatgtcggccaggctggtcttgaactcctgacctcaggtgatcctcccaactcggcctcccaaagtgctgagattacaggcgtgagccaccgcgcccggcctcagagtccctccttaaacgcacagcccaggctcgggaggccgaggcaggagaactgcttgaacccgggaggcggaggttgcagtgagccgagatcatgccactgctctccagcctgggcgagagagtgagactccatctctaaataaataaataaggcacagcccgcatcgaggagtgggaacttgccttattcggcggagggcatcctggaggaagggcagaggcccagggaaggaagagcccaagccacacgtgctcggtggttttcttgtgcctgttcctatttcttcctaagagccggataagccgatctcctggcaggtgcagaagcctttggaccaggctgggccagagacaggcagggtggatgggaccagttgccccagccccttcccacccaatgggccaaagccaggagcccccaccccaactgggcccaatggcttcctcagaccaggtggtgcctggggatctcaggctgtgtctcctgagcaggtgcttcaggacactcccagacccagaatcagggtcggctggggatggatcccaaacccagcactcccaggcccctccctgctggagctggctcaaaccagctccagccagtccgaatcagtgcaaggccctccaacctggcaacttgtcgtcatggtaatcatgaggaaggcttcccatcagcggatcccagtgagtgatggcggggccaggcctcaggtccaggaaggtgaggcgacctggggaccagcagcctggccaggagcctgcattcctgcgggcagcggccagcatggtggccaagtctcctagcctcctccggcccagccagacccaggtcccaagggacctgagagacggagggcacctgtggctagcccgactgccaaagccaagggaggtctcccccggcgccagctcaggcctggctagcccgtcccgcagggggctggggtccctgcacctgtgcaccagactcctacctggtggctccagccagccctggatgggccctgtgaggagagctctctggacacctggggtccctgctccccaaggaggtcccctgccagggacagcaagagcagccttgagtcccagggaggagacccgtagagcaggccagggaggtgcaggtgaagagaccccgaggctggctagaggggatgtcacccggaggggctgacgtggggctggaagcaggaccagaacaaagccctggggggtagggctgggccttggggtcgggggacgccctgtggccccagtgggctcccacccccaaagcccaggggagccagggacagggcaggaaaggacacacccggcaggccgcagtctgtgcaaatgctttaatggtggattcttagatacagtggttaatccattgcccacaattctttactaattccgaggcacctcatgccgggaacacactttcccttccactaaacaaaggtgaccgcgtttcagagctctcctcttacaaggttcacgtccttcgttaggccgaggaccgtggtactacaaaagaacatttcgttagctgaagtcactacgattggcgagaaacatccgttacttcagaatacgttaactacaaaatatattgaatttccatatgtattaaccatatacatgtgtaactattactaaatgtagttcagtcattacaaaataagacattctgggagcgggctacaaatattcaaaccagctgaattccccaggtaaggccccgtgttataaacaaaccacaaacatcagacgtcagaccgagagctcagtgactgcagggtgcgtagccggaaaagccaacaaggcactggcaccgcagagtcgctggaggggtggtggggggcactgccggctcggggggcctttggaagtcacctctaacttcgattcccagccaacagcggctggagtcccacacggacctggagggtgccgagctccccttcccagggccctggaccgccctccctgcattctttgctcctttggggagccccgccctgccctcttgggaccctgcacttgggccacggggacccagctccagccaccggggggtgccagggcagcagggccagctccagccccaaggcttgaaacgaaactgaggagggccaagctcgctaggatggggagactgggttgggagccagaggttggagggctgggagcaccgggctgtgtcccccagggcttcccatctctgtccactgtgccttcctgctgggaggtgaccggcacccaacttcccagccaggccacttcctgcagtggctcaggcagccccaagaggcctggccggcccaacctttgcagagggctcagcgtcaggacggctgctgaggcgcacagcctccccaggacagaccacactcaggtggcctcaggacgaagaattccagacacaggctgcccagggccctctacctggcgctaagggtcggggaagccctggagggccacggctgtgggctctcccagaaaaagcacctggcgtttgccacgggtggtagcaaggctgcctcctgaggacacaagggacagacacctgaggtggcaccctatgcacagcgcagctccatccctgtgacctggccactgaagaggggaacccccgccagcaggctgcccggataggagtcctcaggcagcccccagccctggtctggacctggccttgtggcccccaagacagctggcaccggtgcagttgccagggtctcgatgccaatcccgacctatgcagatcttagctgcccagcgctctacagcccgcagatgcggggagcacagaaacctcagcagcactttgtacacagccctgtttacaaagatccagggcaagacagagcctcacagcctgcgtgcatccgaagcagatggagagcctggtcctggcccgcggtggggctgcaggtgggtggggagggccgggcactgggaggccgcctcctctcactttcaatgataataatgcaaccaaaacctttatataaacagtttatttactctaaacagcaacacagacaaaacgccatataaacacaaaggaagtggcgcagaaccgagatgctgacctggggtctgaggctcaaaagcagcacagcccaggttctagaaggttctagagaggagcggcaggagggagggtgcatttccatacagccagctgaggccaagtgcagctctgcacggtgagaagcatgcctgcatcccagagcgaggaactcgcccctgggggacttacccaagtataaaagtttataattttacagcagttgaaatactgacatcaatattaaaataaaagcgagttttacataacaatcaaaaatacaaaagaccgaaggaagagaccctgtatggaaacgggcaattcagcgaatcgagaccgcacacccgcggcggcaatggaagatggcgcccgcccaacccccccaggtgactagtcattgtatggagcaactttagatttgcaaaaatgttgtaaacaagttcttgccaaaccaatcccttccttttgacgatgccacaaggtcgctgcttatgagggcgcaaacttcttggcttgtgctcggacccttttctcgtactccactctgttttggctgaggaggtcaaaagagaagagacgtgttagagggctgagctgcctggccctcacgctcgccccggagccagctgggcagaccaggctgcaggatgggacctcctgggggagggcagtgtggagctcgtcatagtaacagaagcagaagcccggagaagcagggaggcctgcgtggtggggagcccatgctggctctgacgtggctgagactgtcccgtggtctgacgggggcagaagggcagggaggagaggaacccacgctgggtgaacgtggtgttcaagggggacagaggggtcccgcagggctgcgaggagggctcaggcccagagggcccacgccagggcctgcaacatcgttgccgatgccaagtctggtcctaactagtaatcagcagcttctcttttctgtaggtctggggacagtcctaataaactgaaaacactgactgcttgccactgtttttgttaattcccaaaaatagacaccaatttctggagggtttttccatgaggctctcagccgcaggggcaaaggtgtgggaaggcaggcctggttgagaaggcgttgtgcccgagctgggcagtgcaggggcatcagcgaacaggtctggagctgggtagagtgaggctcagcctgcaagcagctgcccaggagagtggcatggcacacactgcccgggcaaaacaggtgggcgggagggcggccgaggctgcacctaggggctgatgggtcacagggtgcagtgtgaccctgaggatgggggaacaccatgacatttatggaggtggctcctggggtcgcagtcctgccagtctcgccaggattggacctggtctgagacactgagcctcactctgcatggtggaacagcccaggacggcagcagcgccggtgccacccccacccacgccaagggcctggaccgcagcccagaccccagcgccctccttgggccaccagccggccccagggcagagcagctcagctgggtgggcgtggaaggaaccagaggcggtggctacacgtcccagctcttccttgaccaagcagaggccccgagaaaaggcacctgccagggcaggaacacggtccaaggcctccaggaaacccaggaaaaacgatctgaaacccgcacacatgcttcacaaagggtgcttttcaagcggatgtgtgtaggagaaagaacgtttgtttacgtgcacgcaagtgtacagtgcagcccagcaggcaccaagcccaggagacgctggggagagtcacacggggcgggggactgcaaccctgcccagcccacgccgcagatgggagccacagcccagctctggagatggtcggcaaatggggtgcaggccagacagagctcacgcccacaccatgctggggatggcagaccatctaagggctaggcaggaaaacatttgccttttgttttgtttttttgagacagagtctggctctgttgcccaggctggagtgcagtggcgtgatctcggctcactgtaagctccgcctcccaggttcaagccattctcctgcctcagcctcccgagtagctggggttacaggtgtgcgccaccacgcccggctaattttttttatttttactagagatggggtttcaccgtgttagccaggatggtctcaatctcctgacctcgtgatctgcccaccttggcctcccaaagtgctgggattacaggcgtgagccaccgcgcccggcatgcttttttttttttttttgagacagggtctcactttgtcacccaggctgcaatcttggctcactgcagcatcaaccacctgggctcaagcagtcctcccacctcagcctcccaaatagctgggactacaggcatgcaccatcatccccggcttaattttttttttttttttttttttaaagagagcaggtcttgccatgtggcccaggctggtctccaactcctgggctcaggtaacgtcccacagtggccttgcaaagtgctgggattacaggcatgagccaccacccctggcaaattttttaattttttgtagagatagggtctcgctatgttgcccagtctagtcatgaactcctgagttcaagcaatcagcccaccttggcctcccaaagtgttgagattacaggtgttgggccaccacacttggcctagaaatcattttccaggcacggtggctcatgcctataatcccggcactttgggaggcgaggcgggtggatcacctgaggtcagaagttcgagaccagcctggccaacgtggtgaaacactgtctttactaaaaatacaaaaattagtcaggtgtggtggtgggtgcctgtaatcccagctacttgggaggctgaggcaggagaatcacttgaacccaggaggcagaggttgtagtgagctgagatcacaccactgcactccagcctgggcgacagagtgagactctgtttaaaaaaaaaaaaaaaaaaaaaaaagaaaacattttctgcctcaagggccatgtggacacccacgagcactgtggcttcctgtccaagggaatgcatttcacggactcctagggcacagcaggccagcacacaaacccaggtcacgccacgtcccacgagccacttccagcaatggcttggctgactgagcggctatgagtttttttttttttttgagacagggtctcgctttgtcaagcaggctggattgcggtgctgcaatctcaactcactgcgcatcaacctcctgggctcaagcagtcctcccacctcagcctcccaaatagctgggactacaggtgtgcaccaccatgcaggggagccaggctgagcctggggtggctgctgtgatacttgctccctgcctggggcctctgtgccaccctcggccaccagggagggcaccttgcagacacctgggctgggcccgcatccagggagaaacacatctctccaaaaccacgtgctttttttttttttgagacagcattcctccgtcgccaggctggagagcagtggcaggatctcggctcactgcaacttccgcctcccgggttcaagtgattctcctgtctcagcctcccaggtagctgggattagaggcacccaccactacgcccaactaattttttgtatttttagtagggacgagggtttcgccatgttggccaggctggtctcgaactcctgaccgcatgattcacccacctcggcctcccaaagtgctgggattacaagcgtgagccactgcgcccggccgaaaccaggtgcttttcctcacgacctgtgcaggccgggcctaaggcaaccgggacccctcagcctcccccctcctgaccaggagatgcaccctggagggagagggcctctgatgcccacagtggcagggatgtgtggggtggctgcaggtgagccttctgggtccctggccattgggggccctgagaccccctcagaggtgtggggacccgtggtgagatggggctgggtttctcaacgctgcaggcggagcagtggggggtcggaggccccaacccaccttcttatggacctgcccagaacagctgcagagggaacaggacaggcgggcgcatggcctctgctcagggcagggtcctccctgctttccccagcactgtttggctgtcgtctgcatcctaactcacaccaggccctcctcggtgcagacaggaccccaggcccacggggacccttctagccacagcagcacctcacagggacagggtggaagcccagggtccgtgtgacagcatcacgtcactgagccctgctgggctgggcccccccacagaaggaaccaagttgtagaggggatggggacaagcagcaagggcggcgcgggaggctggggtccatgggaggctgagccggtggagaggcctctcagcatggcctcctctggcacccacgcccagggtccttcccctcctagctggccacaactcactggggcagtggcccaagacagcccgtcacctggcctgctccctccccgggacacggctccggcgccatccatgcccaccgcagacggtgtgcaacggtgcctgctgcccacagggtttatgccccccgaccttccccacagaggcgtggaccctggctgtccgtagggtgagcctgtgtcctccactcccgtcctgccaggcggccttggctgggacggggaggagctgccaccagcggggccagggctgctactaaccagtaaatcgtgtaggcctctgcttgagctgggtcttggatatttggttcatttagaagttcctgtattcctaataggatctgtgccagagacaaaaacacaagacgggtgtgagcagtttgaaagggagacaccgtgagactcggcctcagccacagagaatgaccacagacccacgtgtccggaggggagactaaggcagccctgccggtgccagaggcggaggccccgtacctgtttgattgtgatggctggcctccagtccttgtcctcctctaagatggacaggcacactgtccccgaagggtacacattcgggtgaaataatggtggttcgaatttacctggaggaagaggaagaaaggaagcactttttggaggcaggcactgtcccagagtcacgtccttccccacatcaccctcctcccaacactggggccccgggttggtagccaggttatttggccaaaaacttttcaaaaaaattaaattgtggccatgaggagactaaaggaagacatatccacctttgcacacagggaacagagccttggggacacggccgcagccgagacgaagctgtgtctctcccaggacagaactcccagcacagccaggcagtctgggaacacaggccccagggtggccacttaacctgtggcccccacatcctttccagctgggccagactcaggggagatgggaggagctgcaggagacgtccagggacatagccaacgcccttccagagtcggctgttccgacgcagaccctctgcttccaggatatacgggcttttaggaccctgtgttatttctttacaaaaaagcagaaaagtttgccaccattagccccaccagggaccatcacagttgatattctaggctatttcccatcttttacctgggcatcctccctcttctctctcaatgctacggaaggacacacagtgcggcatgtctagtgcagccggaggaattaccagaaagccaacgcgccacgaacacctacagcttccccgaacactcgctcctaccgaccactgcatctgccccgtaatcccaactgcaacatccgcaggcagcttcctggacttcaggtaccatggagatgcacagggcacactccctggggaacgcgaagacaccaccgcagaccgtcccacaccgcgaccatcccacaccgcaggagcacacgggcgacaccagcagctgcgtggctgtcctgagtgcgaacacgcgtgagcgcgctgctgtggaatgtggggtgacggtgttggccctcaagccgtgctgcttccaggctgctcacgcaggctgcgtcgctggcggattccagccaccgggtgaggtgcacggcagccactccgtggtgctacgctgcgcctgctggtgaccgctgagcgcccctttcggcccaggctgcttcctggcgactgcttcgcagaagttcctcaagcgatacgtcttacagggctcttctgcttggggcttgactttttgcttttttaattttttgagatggagtttcactgtggtgcccaggctggatctcggctcactgcagccttcacctcccgggctcaagtgattctcccgcctcaccttggcctccagagtagctgaggttacaggcacccgccatcaagcttggccaatttttctattttattagaaccggggttcctccactgttggtcaggctggtctcaaactcctgaccttaagtgattcacttgccttggcctcccaaagtgctgggatcacaggtgtgagccaacgcgcccggcccgaccttttcctcttctaagggaatcttttggcaaaaacaaaaattgcctaatttcaatttaatctgattctcaatctcgtttcttctgccgatcacaacttacccgcagaaaggcacagatgctggatgccagcactgccaggtccacctgtccctcccaaggtagaggctgcctcctacttcctcatggcctccggcttggccgctcccgcgcttcaaagaaggaacacaaagggggtgccctcctgtctggactgtccgccaggcatcatgtggcctcttcactcttccctacctgtcatcctaggacgtctgggctggggcaagtgggggtgacaccggcacccatctgtgcctctggtggacacatgtatgtgcttctgtgaatctcgactgactcaagtgaacagccaggtcctacagcatgagctcagcttccactggtgtggcaggcagcgtccaggggaaacgttcagaacatccgctctctccagcggtggctgaggctcccgctgccctgcgccgcggctccgtctgctcccctgtgcgctacggcagatcccactggggaggctttcactctttggcaaagccaggcatccctgccgcatttgctggctgggtggaggcctttcctgtgagggacacgctggacgtcatggcagccttcttactgattcccaggagctcttggtagattcagggtgagggctgaggtacgtacatacactgtagtgtgccctcctgcccggcgccaactgcagtctttatgataaagagagattcttaatttcaacttagtcaactcgtcaatctccctccggccagcacttcactgcatccctggtgaagagatccctgcctgcccagggctcacggacaccatcccgggtcttcctctccacgctgtcctgcttgggcaccacaagccatctggaagctgtttctctatggtgggaggcagagctcgtctctcctgctggaatatccctcaggtgtcacagcccaaaccaccacatgcgtggcctccggactcctcgttctgtccgcgggtctgcctgcctgtcttctcagcaagcctgcagtctccatcaccgtgtcccgtggcaggtctagtggggggtgggtgggtgtgctctgcacccacggagcctcagcctgggtctcgccaccccaccaagaagccaaggcctccacgtttctgcatttcctgggtccatgggacagtttccaacaagatgtgcttgactccaactgggatcacatggaatctgcagacgagcctggagagaagggctgtctgtacaatgtcgtgtgttcccctccacacacacggcagagctcagctaccgctcaggccggccttggtttcccttgcaatattctacagttttcggtacagaggtcctgaaccaatcttttattgcatttattccaacgtatttcatgctactataaatggcagttttaaaaccttgctcgctgaaatgatataaaagcagatttgtgtacctcaatctcgacttcatttttatatttattatttagctttgtttcctttaccaggtcctgtgctacttttcttttctttttttttttttgagacagggtcttgccctgctgcccaggctggagtgtagtggcgcgatctcggctcactggacccgcctcctggattcaagcacttctcctgcctcagcctcccgagcagctgggattaaaggcacccaccaccacacccgctaatttttgtttgtttgtttgttttttttagtagagacagggtttcaccatgttgtccaggctggtcttcacctcaggtgatcctcccacctcggcctccaaaagtgctgggattccaggtgtgagccaccgtgcccagccttgcacctcagctttactgagctgttgtcctggccttcctccccacctcttccgttgtgacttctttttcttgtcttgctgcatttgcttggaattccaatcaacggttgaacagaatcaatgaaagcagctactgtgtctcattcttatatttttcttaattaaaataagtcatcttaagtaatacctgctcatggtttaaaaaaaaaatcaaacagcaaaggacaatccaaaaatgaagcaagtctcgaccagctggtgctgtcagcagtcctcaagctcctctggtcactgccactgtggaaaacacttgtgtgtcttgagtgacaattgcagtggaagcttttacacagcactctcgcctcaccgtggccaggcgctgtctaggtgctgggcacgtgttaatgcgtggaactcaccacagaaagggcctgccgatttccagctatgggacggcagggacgtggcggccctctcctccctctcctgagttttgctgaactgactgagatcactaacttagctgtaggctcaaagtcgaacctggcctcagccctttcttctcgcgccttctctgctgctcccctgctctatgcctgcccggctgcagacgcagccccgggtgggagagactgcgagagcccacaggaagagcagtgaggtggggcaagataaaccctccagtgagactcggagtggtggcgcttctgcacgtccatcccatccagggctggggtcttgtgggcaccaaatcctgtcttcatcgccaacaatcactgagggtccaggcactcctagcccaggagctccagcctggatctcacagcctctccctgcaaaggactctggagcttcccagccaattagctgggatgagagactaagtctattacgtgcaccgcccacccgtggagctggaaacagactcgcatctgcagcctgaggcggggatcagggatcaaagccgacctccaaatctgtgatctcactccctcccagctccatggatcgcccggaccagggcgccacggccacagccacgggcctctttggagaggactccaatccccgcaggaacaggccgacttccaggacactgaacagggagctacttacattttggtggcgaagatggataatcatctttgaaaagcatccgtagtttaaacaagcctccttcccacggagtctgtggggaaataaaccgtggtgagatgggctgcttgcctgccgcaggccggcccaggaggaaggggatcgcttctaggacacaacctccaggactgcgaggacaccgggggccagaggcccgacagaggcggctcccataccagcctgaagcctggaccagccccaccaagggggcggtcaggacctctgccatgcccagagagtgagtcggaaaggccctcctggaaaggagaggaggagacgggggtcgggggctgggctggggggcaacgagtgccgcacactggggccggcagcgccaagagcacacccgtgccctcaccccagggtgttctgcaagcccctgccccaggtcccgcctggatgaggcgcctttgccaccccacaacccgacaccactcccgtcttccttggggccgcgcgcgcacctgcctcgccgtaatgtgaagggcaagggacgttctcagcagagcctcagacaagtgacaaatccaagccacatcctgtctcgggcaaagctgagtcctgctgggactgctcagctcagggggccggagctgctgtgagtttcagagcgaaacccagaggctggcatgggccggagggaacaaggcctcgggcaggaccaacacctcagggatctctccttccttcagagtccacgagcatgaaccttatgtgcaagccggcctggagtccctggccaagcacttcatgtgagccgggcaaagaggacaggcacatgggccgccctgcttgccacagacacacggggccccaagcaggcatcctaggtggctgccgccagtccctgtgccccaggaggttctccagtagacggttttaggccggggtggctctcctgcaaacccagctcccgcgacctgagccacacctggaaggacacagcagaatcccgggttccagcacgcaaaggctgcccgcccctcaggcctgctcccaacacacatcagagccccttcccctctgccacagctcagccctgtgcccggccaggcccagcctgcttccttctcaaccagaaatgccctcggtagggacacagctgtcaccccaaccttgccagcaccaccttctgagctcaagtcctcacggggcgggggccaggccacagctggggatctgagctgttgaccgcggcctgtgacaagggtggccgtcacggacggcagggatctgagcggagtatccccatggcactgccgcacgcatctgctgagccccgacaggcaggaggccggcagcgccccttacccctttctttcctggaatggcgcactcccagttcatgaggttcatcgtgccatcgggattttttgttgggacagccacgaaaccctgagagaaaagaaaacaaccacaaaagcatatcagcgtggcggcatctagtttgagcaaaaccaccaagaaccggcctgcgagtcccaccggcccagcccaggcacgcgaccagctccctcccagtagggagggcgcggtttcagccgagggagcctgtccgcggcactgcacacagaaatgaagccctccttacaaatgggtggtctttcctccatgctttcctctcctgggcgagtctgctgagggcgatccccgacatgttcaaagtccctggaacacaggaggcagagcacggggtcaggagaggcgagcgggctcctgccaccccagcacgcgcacgtggcccgcagcaggcaggcttgctcctaacatacggtggcctggcccagcagggactctcttcttgcaagccgtcgtccgaccccgggggtctaccaggggaggccttgtgagcggcgcccagatcaccgggaggcgggggcaggtaggacccctccccatggccccaacccagccctggtctgcgacacatgctgcggcctctgctcgaaggtgaggagacagatgttcagaggctgggccgctgcggctggggggtagctgccaccctgtggtggctgacatggcagggtcctcaccataccatcaggtggggactaggcagggctggggccccagatggatgtggggtgctgggtccctgccttagtatcaggcgctcagaactgagactcaggctgggccaggggacacctgttattctttttttttttttttttttttttttttgagacagagtctcattctattgctcaggctggaatgcagtggcacgatctcggctcactgcaacctccgcctcctgagttcaagcaattctcctgcctcagcctcccgagtagctgagactacaggcgtgtgccaccacgcccagctaatttttgtatttttagtagagatagggtttcaccatgttgaagacagagcagaacaagtaccacagggcagaggctcagcctcactgagagaggagccctccacggggacacccttcccagaccgtgcagccactaccacgtccctgtggcttcaggggacagacgggtcctgcagggcagggcaggagcatggggtaggggaccaggtccctgatcagaggcagcggcacacacgccagattccagctccacacatctgcacgggacctcgggggcttggcaccttcgcctttgcgttctcggcgggagcctgtcggccagcactgtcactggggacaccaggcagacagggccagcagcctcaatgccaccctcaactgtcaccctactggtggccacctttacccacgaaaaacagcgctcaagatacaaaacttgcccaagaattcaaacctaagtgtgtgctggttttcaaagtccatgggaacactgaagctactacccccaagtctgatatctcaacaccaaacaagagccacctctacaaagctgggggactgagccaggtcttctaagctgtggggggccgtccctactacggcttgggctgtcctagaatagccacaagggccctggggacctggatggctcccacacctgtggaggcccacgaacctcacacacctcgcagccgcagaaaggggccaggtcagcagctccacctgcgtcggagccgccgcagcctcacctggcactcgttagggagacaaggcccagtccccggcagacccacggacgaaggagctctgagaggcccgcactcaggttctgggtggcacgatgacttccccagtcagcagagcagaaatcgggggtggggttgggatcaaagaagccaaggcaggtccagtgtcgccagggcaccaggcttctgaagctgctagagccgcctgccctgcaggtgaatttggctccttttcaccaaacacagatcctcagggcagcctgagaaaaagcaggcgaaggaacctgggtcctccagtcagcaggcgctggcgtcacagcgagagggtgacaggggccagccgggcactggcctccaggtccacgactaagtccaagacaggcagcccgggctggaggcagccccagaccgggccccaccgggatgtccttccccacgccctcctcacatgatgcagaggagcccgcaggccgcccgccctctggaccgtttgcccttccccgtgccctcctctaagtgagggggggggagccaggggccagacagggagaaagtggggggcacagctatggtcaggcagggttcgagcccagagcggagtggagcgcccgccaaccacggtttcaaggctgtctccgcactgggctggactccgaaactccacacgttcctccaccctccactcccacgtggagcagcccagctgcgacttgaggactcacagctctcgcttccccagccccaggatgggcttcctgagtggccgcagcctgtgcccggtgcggtgcaaagcagcctggcgagtggccatttcaaggaggcacgacctcccaggtgcccggggtctgagcgaggccaggcatcaggcaagtctctgaagcctcaggccagtgctccagacactgaaggaccatgggcaaggctatcctcacagccaggcaaggccaggccacagagaggccagacgggcctgggaccctgccacaggcagccctcctgctgaggactggacagagccgcctagaggcccccgtcccagcacctagctattgctgtctcaggtgtgagaagtcgtgaggggtggtcctgcgagacctcctgccaagacctggctgctgctgctgtgtcccctgccccaaagcactcagcaccacggggtggtctcacaggcactgcaccgccagggcaaggagccacaggtgcacacccaccgtgtcccagacagaagccaggcccctccccctgcaccccctcctactggccttctggagaaagcggccaatctgttacaatgtaatcacaacacagatcaagcgttcaaaattccgctgaaaatcgaatttgcccttccaaattcacagataggcacttagtgaacggctagtagttactaaacgcttcagagcaagaaacttttatgatgcaaagacaaaaacaaccctcatctattagagccaggcaaggcccagacactgcagaaacggggacagggccgggcactccaggagcggcccgaaagtctgccttctgtcctcctgctgggcgcccgcaaccggctgagctttagcttctcggatcaccgccttgctctgctggttgacagcaccgacttcagagcaacttcctggctgagggtgagcaaagcactcacctcccacaactccaccgcactgatctccacaacgggtggtcgccacgacaggctggcacaagaagcctttaaaggccctcctgcacccaaatgcaaactctcccaggcttggggaggtattcccttctgcaagacccaagcacctgcagtcgggagacgcttacctggccgcacctgatctgccccaggccccgagaatgtttctgaagcaagatcccaaaccctgagacaccatacaagcgcacaccagcaatcacccagtggcctagggaacggacctctctgaatgagcaatcagggcaaactgaggatccgtcccgtcttccgttgcataggttctctacccaaaggcaacgtttcttgaagagcaagaaacacttggggtaggtcctgtaaaaggaaacaaaccgaactccccaaagacaggcactttgcaaacagagaaactaagcgtaacttccaattatacaaacaaaaccacttcattctgcgattcaagcgtgactacaggccacgatcacaagcccaactaatcattcccttacattcctcctacgcacgttaactaccagaaccaactactattcaaccgataaaaagagatgtccaaaacagaataaaactccccctccagcgaggcgctcacgttcagggccccagcaagcgccagcggagcatcttcagaggcacaagaaaacttacacttgttttggttttaaggcaccgaaaacaagcccgctcgccggcccccacccccgcgagccagcgatgttgcaatccaagactctccccccgcggcccatcctatccgtccgcggggcgaccgtgaccccggaagccgctccccgcgcaggaggaaggcgcggcctcgcggggccccggctgcaggtggctgccccggccccgcgccaggcgcacctcgggggcgaagtgggggagccccggccccgaaggcctgcggcggcccggccgctcgggccgcagcccagcggcgccagcagcgcggaccgagccggcgccgagcgcggggcctctcgggctccccggaaagctcggccgcggcgcggggcccggctcggcggggcggggcgcggggcagtcgggggcccgggcccaacaggagtagaggcctcggcccgacccccgccccgcggccccggcccggcccccgcacgcgctcacctcgggcggccgcagccccggcgagcgtagcggacaggtggaggaccgagcggggcggcggcggcggcgcttccctttgtctcgggacttccctccggagcccgctccgcgcgcagccagagcagctccgaggaccctggcgcgggcggggcgcgcggggcggggcctaacgcggggctgccctctgcacgcctgcctcgcgcgccgctcctgccgcccggccccgagcgcctcccgcgccgccgagcgctccccgttgcccgcgccccgccgccgcgcgcccgcgccccgggtccgccccaggagcccggccggggggcgactttccagtcaggcggcgccctggacacctacgcccttaaaggagccgcgtccccgatgtgagggagcgtctgtaaactccccttcgggctgcccgcgtccacccgaggacacgccggcaagcagcgggggaaaaaggaagccgagatctccaaaggctccccggatgcctggcggtcacctctccagccacaggtcccggaggtttccttggggtcaggtcctggggccgggggtcaaagaccactgaggcctaaggatcctctgaagcgtcgcaggacggtgacgctcccgcgagttcagcgccctgtgaaaccccttgcaattggccagttcggggcggtaggcggggacaccttctcatccgcccaatgagctgaccccgtacaaaaggccgaatgcgagcatgaccgacgggaggagaagtgtggatgctccctaaaccgggggctggccctgggccggggcgcgggcgggacgtgggggaccgcgagcggcgggggcggggcgagcccgtgggggaggggcgcttccggtcccccctcccgcccacgcaacaagcaggaccgggtcgggaggcccccagacccgcgagcgcgcgggacagtccgttcgccaacgcgcgaccgtgctggcccccgggctctcccggcccccccgcccgcatttcgccgacggcggggccgcagccaaggtcacggtgtccgggtgcttggggaccgcggggagtgaccacattcattcattccctccctcactcattcattcattccctcccctactccgtcattccctccctcactcactaattccctccctccctcactaattccctccctccctcattcattcgatccctccatcactcaatcattccttccctctctcacgcattccctccctcacttactcattcattgccaccctcactcactcattccctccctcacttactcattcattcccactcactcattccctccctcactcactcattccctccctcactcattccctccctcactcactcattccctccctcactcattccctccctcactcattcattccctccctcactcactcattctcactctcactcattcccgccctcattcattcattcccgccctcattcattcattcccaccctcattcattccttccctccctcactcattccctctctcattcattccctccctccctcactcactcattccctccctcactgattccctccctcactgattcattcattccctccatcactcattcattccttccctcactcattccctccctcactcatttcctctctcattcattcattccctccctccctcactcattcccactctcacaaactcattccctccctcacttactcattcctccctcattcattccctccctcattcgttcattccctccctcattcattcattccctccctccctcattccctccctccctcattcattcattccctccctcattcattcattccctccctcattcattcccaccctccctcattcattccctgcctccctcactcattccctccctcactcattcattccctccctccctcactgattctctcccttattcattccatccctcactcattcccttcctccctcattcacttcctccctcactcattcattcactccctccctcattcattcattccctccctccctcactcattccctcccttactcatttattccatccctcactcattgcctccctccctcattccctccctctctccctcattcattcattccctccctcattcattccctccctcactcattccctccctcactcattcattccctccctcactcattcccttcctccctcattcattcattccctccctcactcatgcattaattccctccctcactcactcattccctccttcactcattcactccctccctccctcactcattcccccaccacctcccacagggtccccagcgggcatttccctgtcaggcacctgcagcaggaggggcagccacacaccctgggtctgcctgcctgggaggcgcagccgtggggatgtgggtccagggcagcaggggcagcctcccccagaatccagtccctggaagccatgcacagccctgtcccaccaagaccagcgggggcctggcctggctgcaactcccaggctcagagcctccgtggcctgtctagacacctgctgtcctggcccccagccttgaggtcctgggaatctgctttttttttttccttttttttgtgagatggagtctcactgtgttgcccaggctagagtgcagtggcgccatcttggcttactgcaacctccacctcctgagttcaagcgatcctcctgcctcagcctcccgagtagctgggattacaggcgtgcaccaccacacccggctaatttttgtatttttaatagagacggggtttcaccatgttggctaggctggtctcaaactcctgacttcaagtgatccgcccacctcggcctcccaaagtgctgggattacaggtgtggaccaccacgcccagctgaaatctgcattcttaaccagccccctgggcaagcctggcagagggatatggccctttggcttcctgacatgggctaaggttccaacgccatctttctggcgaagatgccagcacagggctgtgtggggaggcgtcagccagtaaaagccgtggctgaagaaaagcaagacagccacgggcctcggtggatcccgctgcagcctcaggcacagagagggcagggctggtgaggtggggggcttgtcatgagtggggcttggggagactgactggatgtggtgtgtggctggggagggcctgggcctgaacctgtgggccatgggagccatagaaggttgtggaacaggagaagtaagacaaggccctggttccctgtgtgtgtgtggtgagggactgaggagacatggctcaggcatctagagaattcctgtcctggtgggaagtagtgccaggaggggctggggtttggggaggctgtggcaggtgagggtgagggacatggagcaggtaggggtgagggtcatggagcaggtgggggtgaggggcatggagcaggtgggggagggaagaggctccctcagttgtgcatcctcagcccacaagtgtcctttgagcagcctgcacctggcacacgttttcaaggagaggggacttgttgggtccagctccctgggtacaaaggagaaactgaggcttggagagggtggggggtttgaatcagtaactataagatcctgggcaaggcttgtggctgactgtgccaggcacgcgcccacctttgccctggtccccttgggaggggagcaggaagtgtgatgcagagctgcctgcggtagggcgggacctccagtgccctgggtgccccctccggggcctgctggggccaggctctgcacaggggtttgagagcagaggcctcttcactgagggccgattcccccagaggaataagggcctctgcagtagagtgaaggtggacccttaccccggagcacgcacaaaaaccagctcaaaagtcagcctcgggccaggcgcggtggctcacgctggtaatcccaggactttgggaggctgagtagggcagatcgcttgagctcaggagtttgagaccagcctgcccaacatggtgaaaccctgtctctactaaaaatgcaaaaattagttgggtgtggtggtgcacgcctgtaattccagctacttcgaaggctgaggcaggagaatctcctgaacacgggaggcagaggttgcagtgagccgagatggcgtcactgcactccagcttgggcaacagaacgagacttcatttaaaaataaaaagaaaaaaaaattcacatatctgagaaggagttattatccaggataataggctgggcgcggtggctcacgcctgtaatcccagcactttgggaagctgaggtgggcagatcacttgaggtcagaagttcgagaccagcctggacaacatggtgaaaccccgtctctactaaaaaatactaaagttagctgggtatggttgtgcacaccactccagctcctggggaggctgaggcacaagaatcgcttgaacccggcaggcgaaggttgcggtgagctgagattgcaccactgcactccagcctgggggacagaatgagcttcgtctcaaaaaaataacaaaaaaatctgggatatagaaaatccctacatcaataagaaaatggctctggagggccgggcgcagtggctcacgcctgtaatcccagcactttggtaggctgaggcaggtggatcacctgaggtcaggagttcaagaccagcctggccaacatggtggaaccccatctctactaaaaatacaaaaattagctgagcatggtggcaggcgtctgtaatcccagctactggggaggctgaggcaggagaatcgcttgaacccaggaggcagaggttgcagtgagccaagatcatgccattgcactctagcctgagtgacagagtgagacaccgtctcaaaaaaaccaaaacaaggccgggcgcggtggctcagcactttgggaggccgaggcaggcagatcatgaggtcaggagatcgagaccatcctgactaacacggtgaaaccccgtctctactaaaaatacaaaaaattagccggatgtggtggtgggcgcctgtagtcgcagctactcgggaggctgaggcaggagaatggcgtgaacccaggaggcggagcttgcagtgagcggagatctcgccactgcactccagcctgggcgacagagcgagactcgtctcaaaaaaaaacaacaaaaaaaaaacaagcaaacaaaaaaagactctggttcctgcccctccagcccggatgtacctcacttcctcctccaattcaggacacgccctcgactctctgggggtctcccctgcagctcaaccagccaggatgagggtttcagaagatactgctcagaggctgtgacccagctgtgccccgatcctactgtgctctgcagggctcctcccgagctccctgggggaaccccctaactgtagaggcctgggccctcagcctctggctggccccagagagtgcagggggtgtcttctagtctcaaattccccaggctgggaggctcagtagggagaaggagcaaagcccgctccctcgctcctgactgtgccgcttccttggtggtggtcaccaggctcacaggtccccatccgctagaagaatggtgggggtaggagcaaagtctggggccgtttctgtttccctgtgccgtgacctacagctttgattttctgcactctcaaagaggtgggcctcattggatgcctgtcactgccaatccccaaattgatcacctctgtcgcggaagagagaggccgggaccagattggggtgagggatgggtctccagtcctggtcgtggccagcacagttggaatgaccgtcgtgagcactgcagagaataaagagagcgcccggtggagtcgtggcagcccctggaaacccatgcagggagagtccagccaggagccaggactttttggcccccaaccctctgaaacagacggaaaagcccacagaccggggtgcatggggcgtgacctttcctcctcccacctggccctgcgtgcagcattcttgtcctggtacatgtgggcgggtcaggtaccctcctctctctccccgactgcagcctgttctgcctctgatagatgctgctaagaccaggagcccttggatagggcaggagtggcctgcccatgccgtattccctccacgtcgtccctctgcccaagcctggctcctgcacacctgggctgcttcctgcctccatgcctttccctgagcagtgccccacccacatgccccgccctcccacctcacccgcccggtggctctttccggcctcctctaaatcgcagcccttggccgggcacagtgactcacaacctgtaatcccagcactttgggacgccgaggtgggcggatcacttgaggtcaggagttcaagactagcctgaccaatatggtgaaaacccatctctactaaaaatacaaaaattagccaggtgtggtggcaggcgcctgtaatcccagctactcaggaggctgaggcaggagaactgcttgaaccgggggggtggaggttgcagtgagctgagatcacaccactgcactccagcctgggtgacagagagagactccgtctcaaaaataaataaataatacatttagagacagggtctccctgtgttgccccggctggtctcaaattcctgggcccaagggaccctcctgcctcggcctcccaaagtgctgggattacaggtgtgagccaccatgcatggctaatttaatgtaatttgatttaattttgagacagagtctcactgtgccacccaggctagagcgcagtgctgcaatcctgtctcactggagccttgacatccccagtctcgagcgatcctcccaccacagcctcccaagtcgctgggactacaggtgtgaactaccacaccctactaatccacaccccgctaatttttgtaccttttgtagagactgggttttaccacgttgtccaggctggtctgtaactcctgggctcaagcgatcgtcccacctcagcttcccaaagtgctgggattgcagcgtgagccactgtgccctgcccactctataattcaacatttttattattgtttgttttagtttttttttttttttttttgagacaaaatctcactctgttcccaggctggagtgcagcggcgcaatctcggcccactgcaacctcctcctcctgggtacaatcaattctcctgcctcagcctcctgaggagctgggattacaggcgcacaccaccacgcctggctaattttgtatttttaccatgttggccaggttggtctccaactcctaacctcaggtgatccacccgccttggcctcccaaagtgctgggattacaggcatgagctatcatgagccatcatgcctggcctattttttattttttgagatggagtctcgctctttcgcctaggctggagtgcagtgaggcaatcttggctcactgcaacctccgcctcctgggttcaagcgattctcccgcctcagcctcccgagtagctgggttgacaggcacctgccatcatgcccggctactttttgtatttttgtaaagacggggtttcaccatgttggccaggctggtctggaactcctaacctcaggtgatccacccgcctcggcctcccaaagtgctgggattacagatatgagccactgtgcccgacccaacttcatatttactctctgttgttttcaagacagcagaagctccctgaatgtgtgttcatgctgggccagcaccgtgctggggtaaaggaggatccattccggccaccacctccgtcctgagctgacaggccgctggggagatggtcagcaaggggggagttgctgcagagccagagccacactattgtgaggacagtgaaagaggccccaacaccctcacaggtccgggcagccttcctagaggaggtggcattgaggtgggcatggagtttccgggatgcagcggtgaagggtgaggtcagagagagtgggccagggcgtggttcagaatggccaggctgagggctcaggggtgggggctgcctgaatcgagcccagcaaggaattcggactcccccctgccggcagaggggcaccagagtagggtcttcataacacaagcgattggcattctgcttggatcagagctgtggagcagctgggaggggcaggaccctcgcgggaaacctctcagccgaactcctgcagaaatctggggtgtgggggctcggtggtgtggacagggccacgcagagaggtggatggaggggtacctgggactcagacttgcagggagtgggagggcagggggagtccagggtgaccccctggcctagcgtttgcgtggctgggggatgccgggtccgcaggtctgggtggccgagggtcgaggggggagctcaggttgggtcctgctgggctcccggagcctgggacccggtggagtgcagacctggctgtcccggctgggcaggtgcgtgaagccccatgaggaggcggcccgggagggggcgggcagaggcaagagggctgtgccgggacccaagcgacggcagcaggggtcagcagaggggcctgcggcggggtggacgctggagcaggagaccaggggaggtttgtcaacagggctccacagacggccagccgggcagagctgccgggagtccgtccgcctcctgggctgcctgccgccccctgctggccctgccgtgaaacgctggtgcctcaggggacacggccatggccctggagtgggtgtcaccgtggggccgcccccgggaggggctctgcctgagcctgtggagacccctccagggacaccggatgcctgagcccagagccgcgcctgcagagtgggctgtgcttgtgttggggcacgaaggacacgctttggccaggacagtggggcactgactggtgtctaagatgcttgaggcagggcaggcagacctgcagtcactcctctgcagagtcgcacaccggggcgtgtgggctctcagccctcaccccacccagcaggagggcgtggggaggcggggcagcgggttggaccaggtctcctgacatggggctgcagccaggtggggttgggctcctgggattcccatgcgcgtggacggtgggtcagatgctgtagccgccatctgaagccgacgtgtgaaacttcagcttcttagcaaggtagactgatgcttttttttattttttaagactgagtttcgctcttatggaccaggctggagtgcaatggcatgttctcggctcactgcaatctctgcctcctgggttcaagtgattcttgtgcctcagcctcccacgtagctgggattacaggcgcccaccaggcctggctcatcttttgcatttttagtagagatggggttttgccatgttggccagggctggtctccatctcttgacctcaggtgatccgcctgcctcagcctcccaaagtgttgggatcacaggcgtgagccaccacacccggcctcccgcgcgaccctggcactgttaaaattttttttttttttaaacaaacttcagcttcttagacgggctttcagggctacagaaatcgctcacgttttacacccgcttatgtaagtgtgtgtgcgctggagcgggtgtacacaggcatgttcactgcacctgtatacaggtgcaggcgtttcaggggggcattagctacacagcatttctcaaccttttggaagctggggtaatttggctctgaaacctgttccctgggtcgtgccctcttgcggatccaggagagcagggacatttgcctgtgcgttcactgccgtattcttggtgtctggagcagtgcctgacctgtggcgggtgcttagtgagttatccgtgcaatgaatgaatgaatcaatgaatgaatgaatgaatgaatgaacgaaccagccggaaccttgctggccgttgactgaaaatgtctggattcaattgactgaatcaaacagacttagagcttgagagggaaaaattatttcacttagaaaataaaagttatctctgcaggactagacatgaaaggaaaaaaaaaagaaaaaagaaaaaagttctacctttgcccccgcggttctcaggtttcacctgacgtggtgaaatacgctgtaggtcacatgcgtaggtttggccgctggccgtccagtagtcctcccaccccgggggacgggtgcggggggtgacccggtgaagagggcagggagctggggcagcctgctgtgcggagctgggggaggaggagggagccctgggggacagacagaaggaccatcgaaggagaaaccctgctggcctcgggacctggaggaaagaaccagggcccgtgctccttgggccaggatccggcgattggacggaacctctcggattccccagtgctgtgaaatccacttggggccatcacacccttcattgctgtgctccctggcagaactcgaatgcagcgtgagctgggcacttttcccagggtttgctctaggtctgggtctcccatcagctcccccggagcagagcctgaggcaaggattcttgttcgggggcatcttcctctcagcaccgtgctttgggaatcgagtgatggtgctgagtgaacccctgagtgaacatctgtggcttcctcccacctcgtctctggatgcactcctgttcgaatggtacctgatcttcttctgtgtgagaattttctctgggcacagtctgtccaggaggggacacgagtacccctaatttcactaagtgtggctgaattatcttccagggtgtctgtacatgcttgtcccctccccacggtggcgtgctcaatggtggctccccacagatatgtccgtgtcctaattcccggagcctttgggtctcatgtagccaatgatgtgaaaaagtgaaggatgctgagaggagatcatccaggtgggctctgaacagtatcctgtgcatctttctaataagaggggttcaccgggatcctgtgcatctttctaataagaggggctcaccgggtgcgggggctcacgcctatcatcccagcactttgggaggccaagacgggcaaatcacgtgaggtctggagtttggaactagcctgggcatcatggtgaaactccgtctctactaaaactacaaaaatcagccaggcgtggtggcctgtaatcccagctactccggaggctgaggcctgagaatcgcttgaacccgggaggtggagatcacgccattgcactccagcctgggtgacagagtgaaacttcacctgaaaaaaaaaaagagggttccacagaggggacgcaaacaggaggggacagcgtggccatggaggcagcagggagtggcacagccatcatgacaataagaaaagacaggacttaaacacataaataatttccactgttttaaactaccatgtttgtggtaatttgttacagcagtggcaggaaattaatacacccatctttaggacacaagcgttcccctttctcaggctagacacggtggctcacacctataattccagcactttgggaggcccaggtgggaggatcatttgtgcccaggagtttgagaccagcctgggaaacacagtgagatcccatctctacaaaaaactaaaaagacacagacatgagccactgtgcctggcctccgaattatgtttctttgctatattttgaaatggccctgcaaagccatcttttgtggggggagatatgcgtctataaggaatttcaggccgggcacagtggctcacgcctataatcccagcactttgggaggccgaggtgggtggaccacgaggtcaagagattgagaccatcctggccaacatggtgaaaccccatctctagtaaaaataaaaaaattagctgggcgtggtggcgggcacctgtaatcccaactactcaggaggctgaggtagcagactcacttgaacccaggaggtggaggttgcagtcagccgaggtcatgccactgtactccagcctgggcaacagagcaagactctgtcttaaaaaaaataataaaaataaaacgcttccctgccacagcccttggcattggtacgctgacctgccaggcattggactgtggttacccacaggttacccacgatttctgtctgacctggctacaaataggccattcccaggacccacctcttgagcccaacaatttgctagagtggctcacaggactcagggaaatgctttatttactattacagatttattacaaaggatatgtaagccaaaaagtatttgagatacgtctcaatcaatttagaagtttattttgccagggttaaggatttggccatgacacagccttaggaggtcctgagaatgtgtgaaggtgtctgggctacagctgttttttttttttttctggagagagagtcttgctctgttgccagctggaatgcagtggcactgtatcagctcactgtgttaaatatagtgaactccgagtttctcttcaaagaatcagcatgtcagtttgttcagctctcttattctttgattctccattttaaagcttaacttcctggttctttgctcccttgcctctactttcagtaaacaactttcccaccagttctaatcagtagctcacatctcttccctggtcatctgctctgccctgagtcaccctgtcacctgctctgccctgacacatcctgagtcacctgttctataactgtccttcctgccaaactactcactctgccactccgactcgtacccctgctctctttaaaatagccaattggaattagcttagactgtgtggtccaaccctagccaataggggaaccacacagcaggaggggctgccggcgtcagggataagaaccccttcccctcccctgtccaggtgtgctctcgccattgctccatccgtgagatgcacccttctatagaagtaaattgtcttggggctgggcatggtggctcacacctgtaatcctagcactttgggaggctgaggcgggtggatcacgaggtcaggagttcgagaccagcctcaccaacatggtgaaaccccgtctgtagtaaaaatacaaaaattagctgggcgtagtggagggcacctgtaatccctgctactcaggaggctgaggcaggagaatcacttgaacccgggaggtggagactgcagtgagccgagatcacaccactgcactccagcctgggtgacagagcgagactctgtctcaaaaaaaaaaaaaaaaaaaaatgtaaattgtcttggtgagaaaatttttggtctgagtgttagttcttctttttggcatgaaggaacaagcatttgtttctaacaactgcaacctttgcctcccatgttcaagtgattctcctgcctcagtctcccaagtagctgggattacaagcacctaccaccatgcctggcaatttattttattttattttattttttgagatggagtctggctctctgttgcccaggctggattgcagtggtgcaatctcggctcactgcaacgtctgcctcccaggtccaagcgattctcctgccttagcctcccaagcagctgggattacctgcacctgccaccacacctggctaatctttgtatttttagtagagatggggttttgccacattggccaggctggtcttgaactcctgacctcaagtgatccaccctcctcagcctcccaaagtgctgggattaccggcgtgagccactgtgcccagctttttttgtatttttaatagagacggggtttcaccatgttggccaggctggtctcaaactcctgacctcaagtgatctgcctgcctcggcctctcaaagtgctgggatacaggtgtgagccactcgtctggcctccagcttggttttatacattttagggtgaccaaagttataggcagagatcagtcaatacatgcaaggtgcacgctggttcagtctggaaaggtggaatgtctgaggggagcttcccagtcataggtggattcaaagatttccgggctggtagttggttgaaagacttaagttttgcctaaagagttgaagtctgcagaaaaaaatggggctaaattcaggggggattgtggaagccaaggttcttgttatgtagatgaagcatccaggtagcaggcttcagagagaatagatggcaaatgtctcttaccagagcttaaaaggtgctagactctcctgaaaatacttagtaagggccgggcacggtggctcacacctgtaatcccagcactttggcaggctgaggcaggcggatcacctgaggttgggagttagagaccagcctgacaaacatggataaaccccatctctactaaaaatacaaaatcagctgggcatgatggcacatgcctgtaatcccagctacttcggaggctgaggcaggagaattgcttgaacctgggaggcagaggttgcagtgagccaagatcgcgccattgcactccagcctgggcaacaagagtgaaactccatctcaaaaaaaaaaaaaaaaaaagagacctgttaagggaagacgattctctgcagagtgtaaatttcccccacaagaggcagctttgcagggccatttaaaaatatatcaaataaatatattttggggctggacatagtggctgacgcctataatctcagcactttgggaggccaaggtgggcagatcacttgaggtcaggagttcgagactagcctgggcaacatggcgagaccccatatctactaaaaatacaaaaattagccaggcatgatggtgggcacgtgtaattccagctactcaggaggctaaggcatgagaatcacttgaacccgggaggtggatgttacagtgagccgagatcatgtgactgcactgtagcccgggcaatagagcgagactccctctcaaaaaaaaaaaaaaaaaaaaaaaaatctgttttaatgttaaggctggtcagtggggcctgaatcccaaagggaggagggtgtaatgaggcatgtccaatcccccttcccagcgtggcctgaactagtgttttgagccactttcgaatccccttggaggagaggaggggtctgtttcatcagttgggggcttataattttatttttgttttgcagatgtcttagaggataaaaatgagcgggcagatgaagagatactcagggtgaggtttggaaggtgcaccaggcccaccccatggatgtggctcagagagcctgggaaacgtgaggtctgtgacctggatcaggcccagagagacctgagcaggaggcgtgtgaagcccctgcgcctgtgcgaggagggaagctgtttcagggaatttgcctttctttccctgtagtttcagactagctgataaattacctaaaatgttaccacaagatgcacaatgtaaccatcactcattatcttcatgttcctggaattttttttttttttttgagatagagtgtagcctcatggcagcctcaacctcctgggctcaagttgtcagaggcgtgtgaaccagagcaactccatcttgaatggggctgcgtaaaatgaagctgagacctgtggggctgcattcccagaccgctgtggcattctgagtcacagggtgagacaggaggtcagcacaagatacaggtcataaagaccttgctgataaaacaggttgcagcaaaggagccgtccaaatcccaccaaaaccaagatggtgacaagagtgacctctggccgtcctcactgccacactcccaccagccgtgacagtttacagatgccatggcaacctcaggaagtcaccatatatggtctaaaaaggggaggtatgaataatccaccccttgtttagcatatcatcaagaaataaccacaaaaacggagaaccagcagtcctcggggctgctttgtctatggagtagccattctttttttttttttcgagatggagtctcgctctgttgcctgggctggagtgcggtggcatgatcttggctcactgcaacctctgcctcctgggtttaagtgattctcctgcctcagccgagctgagtagctgggcttacaggcacccaccaccatgcccggctaattttttgtatttttagtaaagccagggtttcattatactagccaggctggtctcgaactcctgacctcatgacctgcctgcctcagcttcccaaagtactgggattaccggtgtgaaccaccgtgcccagccagagtagccattctttactcctttactttcctaataaacttcctttcactttactctgtgaacttgccctgaattctttcttgtgagagatccaagaaccctctcttggggtctggattggcacccctttcctgtaacaaagccattctcccaccttagcctcccaaatagctaagaccacgggtgtgtgccaccgtgcctggctaatttttaatttttttttttaagagatagggtctccagcctgaccaacatggcaaaaccctgtctctactaaatatacaaacaaatgagctgggcatgggggcgggtgcttgtagtcccagctacttgggaggctgaggcaggagaattgattgaacccgggaggcagaggttgcagtgagctgagatggcaccattgcactccagcctgggcacagtgagactccgtctcaaaaaaaaaaaaagatggagtctcactgtgtaacccaggctggtctcgaactcctgacctcaagtgatcctcccgctttagcctcccgaagtgctgtgattacaggcatgagccaccacacccagcccaccgtgcaggcagtgactcacacctgtaatcccagtactttgggaggctgaggtgggagaattgcttgagctgaggagttcaagaccagccttggtgacacagtgaaaccctgtctttgctaaaaataagaaaattagccgggcgtgatagcatgtgcctgtagtcccagctattctggaggctgaggacaggatggcttgagcctgggaggtggaggttgagtgagctgagatcaggccactgggcgacagagcaatagcctgggaaaaggagagagggagggggaagtggggggggggagaggaaaggagaggggagagggggaggggagaggggagaggagagaggggagagggggagggggagggggagaggggagagggaggaggggagaagggagaggaaaggagaggggagaggggaggggagaggggagaggaaaggagaggggagaggaaaggagaggggagaggaaaggagagtggagagaggagaggggagaggaaaggagaggggagagaggagacggtagaggggagaggggagaggaaaggagaggggagaggaaaggagaggggagaggaaaggagaggagaaaggaaagtcaggctgggtgcggtggctcacccctgtaatcccagcactttgggaggccgagtcaggtagatcacttgaggtcaggagtttgagaccagcctgaccaacatggtgaaaccctcgtttctactaaaaatacaaaattagccaggtgtggtggcgtgcgctgtaatcccaactacttgggaggctgaggcaggagaatcacttgaacccagtaggcagaggttgcagcgagctgagatcgtgccactgcactccggcatgggtgacagagcgagactccatctgaaaaaaaaaaaaaaaaaaaagaggaaaggagagggaaaagaggcttgtagttctgcaggctgtacggcacggcatcagtatctgcttggcttctggggaggcctcgggagcttcccgtggtggcggaaggccaagggggagccagggtatcccacggtgaaggaggaagcaagagagaaggaccgagagggaccaagagccagaccgagtgggctgagcggcgcccacccaggtttcaggaggaaggagatttcgggtgggaaacaaactcaccgggtggggctgttcgtcacaggagcgtgtcctgctggtcacttacgattgctgggcccatgacagcagcagctggtcaggcacgggcagggcaggagagggctcccctcccacacaccgggagcatcagtcgtccttcgggcgatggtcaggcggttgttaactgcctgtgtaacataatacttgttgcagctggcaccagggaaaggcaggctcccaatagacagcaaacacctgaaaccggtgatcagcagcttcccggtaagatctcaggagctgggcgagggggctggagcaggcacactaagaggcaaaatggcagagtttaactggtctatggccttcaagggacctgcggctggtcatgaagagcgcctcaagtgagcacacgcacgactgcggcaaacgcaccacacacgctcccctcccgagcgccagcaggccatggcacacgcagacagcccactcacgggaggaatctcgggagaagggatgcgaggccctggaagcatgccaacctataagaacccaagtcaggctgggcgcgagggctcatgcctggaatcccagcactttgggaggccgaggtgggcggatcacgaggtcaggagtttgacaccagtctggccaacatggtgaaaccctgtctctgctataaatacaaaaaatagctgggtgtggtggcgcatgcctgaatcgtttgaatccggcaggtggaggtttcactgagctgagatcccgccattgcactccagcctgggtgacagaacaagactctgtctcaaaaaacaaacagccccaagtcaaaggtcaaactgcagacttctctttcgagttgcctgcttgggcgttttccaagtgtacttgccttcattttgttcctgctctaaagctgcttatttttatttattattattatttttagataggttctcactccgttacccaggctggagtgcagtggcgcaatctcggctcaccgcaacctccgcctcccgggttcaagcaattctcctgcctcagcctcccgagtagctgggattacaggcatgcgccaccacgcccgtctaatttttgtatttttagtagagacaggattttaccacattggccaggctggtcttgaactcctggcctcaagtggtcttcccgccttggcctctcacagtgctgggattacaggcatgaaccaccacacccggcctctaaagctttttaataatcgttcactcctgctctaaaacttgcctcagtctctccttctgccttctgcccctcagctgaatttttcttctgaggaggcaagaattgagattgctgcagatccgcgtgcatttgctgtcgctcgcagacctggaggatactaccctggcgatgggacgcagagagctggaccaggctgctggctgtgcgggcaggggaggagagagagcggggagagggctgtggacggcgctgcaccctctctctgcgtttctggggctggtctctaactgagctcaaactccccatcctaatgcagccctgcaggccggcgggagggcgccggagacctgacccagaggagggagaccaggctgtatctccagctgcatctgcatcggccccaccgtgtcttcctctgggagctgcggctcctcgggtcggctgtgatgcaacgtgggcaggggcgggggctgggggttgcattgggtaatgcctgcggctaccgctgtctccttcatctctgtctgcagctctgtgtccagcagggccaagaagggcattgggtgaggctgagagcagccaggggggtctccacaggggaaccggcaccgggacagtcacctccagcagcatcctgatgttctggggacactggtgctggggggtcagtggggaagggctcctgggtcctcatgaccctctcccttgggtgagcacaaaacaccatggcactttggggtcttggaaacagactaaaggggatgtcaagtcctcattccttggagctgctgacgagtccagaatgggtcatgttttcttgccccgaccccagcacctcagggcagcggaaggtccagagagaggtcggggaccggggccgctccttgcatcctgggcttgtgtctgttgccccctggctggtgacttgcactctcctggagctggttcttgcagccgaggccgtcacgggggtaagggcacttggggttatttcgggggggtggacgttttgggccaaagaggagaacaggctccaggcaccgagaagtgaacccttcattcccaaggacggtgggtgtcccaggtgagggtgagggaggagacctggccggagaacggaacggctgtcctttaacacgtgtgtccctccctccctccctccctccctccctcccccctcccccccactcccagctgggatgtcgctgctgcttctcttcgtggtgttgaccatttctcagacctccccccgcccctgcaggtcaggtggccctggttcacacactgcacttctgagccccagacccagtcccgcccagtggaactcagcgcctggccccacctgctgtcagcactctgaatgtgcccaggagggggctgccccgcccacccacttcctctgtatgagagataaatgggctcccagagatgccagggaggaggcagagagacctggggcacgagtatgccgcccactccgaacccccctctccattcccagaccccagctggggctcagatcgcctcaccccaggccccggctttctccccacatatgctgtggctactgctcctgaccctcccctgcctgatgggctctgtgcccaggaacccaggcgagtccgccccacccaatgcccctgctgcccaggaccccctccttgccctgccccgggctcagagtgccagccctggggtgggtggggaccatctgattgccggtctctcctggtgcccctgagctctgggaagaccctcgtccgtccccctcatgagcccggcacggggcgtgagctggtgggcatcactgggggctgcgacgtctcggccaggaggcacccctggcaggtcagcctgaggttctacagcatgaagaagggtctgtgggagcccatctgtgggggctccctcatccacccagagtgggtgctgaccgccgcccactgccttgggccatgagtggagcctgctgtcccctcggcgggtgggagtgggggtggggacgggcaggtgtcctgtgtgccgggggcccctcccaggattcagggaaagccccggtcctgagcatctggccttactttgagaggtgcccgttcctctctccagggaggagttggaggcttgcgcgtttagagtgcaggtggggcagctgaggctctatgaggacgaccagcggacgaaggtggttgagatcgtccgtcacccccagtacaacgagagcctgtctgcccagggcggtgcggacatcgccctgctgaagctggaggccccggtgccgctgtctgagctcatccacccggtctcgctcccgtctgcctcccgggacgtgccctcggggaagacctgctgggtgaccggctggggtgtcattggacgtggaggtcaggagcaggaccacttgggtgggatgtggagagatgacccggaatgtcggtgcaggcctgggctccagacgcgtcctggatggcttcctgccgctgccgagacggatggccacaggccaggtggctcagagcagcaggaatgtactatctcacggctctgcaggcggaacgtccacactccaggcgtgggcagggttggttcctttcagaggccctgagggagggtccgttccatgccttccccatgcccctgggcttgcggtcgtgtttctccaggttcccctctccttcctcctctacggacactgggtgctgtatttatggtatttatggtgtctctaatctaactgacctcatcttaattccatctgcaaaggtccttttccagataaggtcacagtgacaagttctggggttatggcgtaggggtgcccctgcccacctcccaacaggcactttgtgagttaactccatcctcagcgtcaccctcagttgcctgctgttcctttgcatcagagaaaccgtgaactaagggaggtcgggaactcctgggccccgcagcatcagcacctggagcgaaccgtctcattcccaccacaacacagtccagggggagtcctggtcccatgcttttcccaaatagtttcttttttaaaaaattttttatttaaaaacttgtttttgaggcagggtcttgctctgtcacccaggctggagtgcaatagtgcaatcacagctcactacagcctcgaacccccaggatcaagtgatcctcccacctcagcctcccgagtggctggaaccacaggcgcgagccaccacgccgggcttttttttctttttgtagggatgaggtttcgctgtgttgcccaggccggtctcaaactcctgggctcaagcgatcctcccacctcagtcctccaagcgtttaatagctgggactaccagtgtgtgccaccacgcctggctaattttattttattttattttatttgagacagagtctctctctgtcatccaggctggagtgcagtggtgtgatcttggctcactgcaacctccgcctcctgggttcaagtgattctcctacctcagtctcctgagtagctgggattataggcgtcagccaccatgctcggctaatttttgtattttagtagagatggggtttcaccatgttggccaggctggtctggaactcctgggctcaagtgatccacccgcctcggcctcccaaagtgctggggtttcaggtgtgcgccaccgcgcccggcccctagtcatttctaagagtgagtcctgaggttccaggctcctgtgcccaggactgcagccttggggctcaccccctggccagggaaggcccagctctgagcgaattgtatgcctcagctctggacaaaacgagaagctgcagccttgtccccgccaggcccctgcgcctcacctcgcatctccttgcagaactactgccctggcccctcagcttgtgggaggcgacggtgaaggtcaggagcaacgtcctctgtaaccagacctgtcgccgccgctttccttccaaccacactgagcggtttgagcggctcatcaaggacgacatgctgtgtgccggggacgggaaccacggctcctggccagtgagaccccagacccacctgtctctcccctcctaggggggacacatggggaggcacatggggagccctcgctgagcgccatctctccccacagggcgacaacgggggccccctcctgtgcaggcggaattgcacctgggtccaggtggaggtggtgagctggggcaaactctgcggccttcgcggctatcccggcatgtacacccgcgtgacgagctacgtgtcctggatccgccagtacgtcccgccgttccccagacgctagctggggtgcagtggggtctgcatgatccaggagggcccgtcttccttgtggacacccctgctgctcccccgtctcagcctcaccctcccgcagatccctgccccgagacccttctgctcctctcggtctctcaaggctctgtgtttccctgccagcagggggctcggggagccgggtaggggccctcaaagatgagtcgggagtggaaacagaatcccagaaatcctagacggctgcttgtgacttgactccattaaacagtgtggaaaccgctccgggtctgtggtgtgtgtctggactgtgggagcagctgggggtcacagagtgtcctggcactctcaggccaggcaggagaagagggatgggccccagggctgggaggggacggcttccttccgtccccccctccacggcccaggtctgtcagcgccattgacattggagtgtcagtcccaggctggcggacttctccctccctctgctttccagagccacctcctcctagaacccccgggtcctgacccaccaccagggtcctcctggtcccacaagatgtggccctgagagcaggtggcacagtgtgggggtcccggtgcccatggggcccggttctttctcccgctgctctgggcccctcgactcccggacagtgtttccagtcaactctagacttcctcctccttttctggcacaaactcctctcttttggatttcaaaagtcgtaagtcaagattctctggtttgcgttctgcaaatgtgaccccagagtcccaaccccagacatgcttcctacaggggctgcgtgggcctgggaagcaggggtcccctgggtgcctccggattttctggctgtgacacgtcctgctggtcaccctggacacctggcctggggcacagggaggtgcctctgagtgcccggagcctgagattcttgggggtgctggtggaagtagagggtcctggaatagtggagagggccctggggtggtggagagggtcctggaatagtggagagggccctggggtggtggagagggccctggaatagtggagagggccctggagtggtggagagggccctggaatagtggagagggccctggagtggtggagagggccctggaatagtggagagggccctggggtggtggagagggccctggggtggtggagagggccctggaatagtggagagggccctggggtggtggagagggccctggaatagtggagagggccctggggtggtggagagggccctggggtggtggagagggccctggggtggtggagagggccctggaatagtggagagggccctggggtggtggagagggccctggggtggtggagagggccctggagtggtggagagggccctggggtggtggagagggccctggaatagtggagagggccctggagtggtggagagggccctggaatagtggagagggccctggagtggtggagagggccctggagtggtggagagggtcctgcaatagtggagaggttcctgggggtggtggagagggccctgggatggggacagcacaatggggaggggtgggcagctcagggcccccatctgtaacctggctggtctctacctgactccaggctccacaccggccccttgtcccctgggaacctctgggacaaatagctttagtggaaagagtctgctgtctgtcctgagtcgggccgtggggtcctgtccccctatcttgggctgcattggcctcatgctgggtggggttggttgtggctccttggctctgcggtgatgcaacatggtggccgggtcctggggctggggtgcagttgagcgacgctctgattaatctctgtttgaacccagagctcagaagcgggtgctggggctgctgagccggcagagcaggggtgtccagaaaggcaggcggggggccacgtcagggccggagagccactccctcccccatcaccatctgtgcacggcctgttggaggtcagccccacagagctggcattccctgcgggcatcctggggctgccctcctgtgcaggccccaagaatctcaggcagagctctgcttggcaggacctgcccccatgcttcagtcccctcccatcagtgccaaaatgtcactttgggagccacgcggccattcaaaatctgaaggctcaacagctgatctccctcccatgatgcggagaaatcttggagacagctggagcttctgcccagagtcagctcccgggggcctctcaggtcatttcctccccagctccacaccccactccctccagattcagtgggaagaggtgggtcacggaggggtgcacagacacccccctacaccctgggcatgggagaaagaaagccccttccccactcctgcaggccatgcccctcagctcagacccctgctgtggtccgaagatttgtgctccccccaaatccagatgttgaagccctaactcccagtgtgatgggatcaggaggtgggtgcttcgggaggcgaacagggcactcatgcccttagagaagggacccccagagagttcactcatccctcctagtactggaggacccagagataaggcaccgtttatgaaccaggagatgggtcctccccagaccccagccacgctggctccctgaccttggacctccattctctggggtcatcaggaatgaatccctgctgtgtgtaaatagcccggttgtgggctgttgcagccaccggagcccctttgggcacgggtgacccaggcctcctcacaggccaggcgaggtgtctccaggaggtctttggtgacaggaagtcctggggctgagccggcttcctggggcgggggagggcaccacacagggaaagagcccgaaattctcccgcccactccatgagaggagccgggcaccacggccacaggtcgagagaacagggagatccgcagaggcggacggaagatttgtggggcccgggggagggggtgacagggatgggaagcgacagccaccagaagggtgtgggcttttcagggcgataaaaatgttgtaaaattgggaatggtgacagccgcaagctgttgaaccctttaaatgggtgaattgtaggtttttgtgaactcaatctcaataatgctgtttaaaaaacccagataaatatgaaaaaataaaaaagaggccgggcacagtggctcacacctgtcatcccagcacttagggaggctgaggcgggcagatcacctgaggtcgggagttcgagaccagcctggccaacatgcagaaaccccgtctgtaccaaaaatacaaaattatacaggcgtggtggcccgtgcctgtaatcccagctactcaggaggctgaggcaggagaattgcttgaacccaggaggtggaggttgcagtgagccgagatcatgctattgcactccagcctgggcaacaagagcaaaaccccgtctcaaaaaaataaaataaaataaaaataaaaaagtcctcatttccccaattctttcacaactgcaaaaccacaacatgaaccccttgagaggtctcctgatcacatgggcccacacacagcccagcctcccgggcactctccctgcacatcgggtgtttgaggggcctgctgatcatatgcgcccacacagcccagcctcccggggaaccctctctgtacattgggccccagggtcttccaaaggacagtcaccagggccctgtcctcccgaggcagggcctgcggcaggaccatcctgagtgtgtgtggttattggagtgtggggagtccccctgaggggtcttggcaggggtggagtctctctgttcaggccgtcactggtttgggtgtggtcccgtgaaccccagcgtgggtggggcccagcagcgagggaaggcactcacaggtcgtggccaggacactggcgcccactggcgtcctccaccctggtccctcacctcccaggttcagtgatcggaggcctctcccaggaacagggaactccctccggtcatggtgacagtccttttttttttcttttgagacggagtctcactctgttgcccaggctggaatgcagtggtgcgatctcagctcactgcaacctccgtcccccaggttcaagtgattctcctgcctcagcctcccaagtagctgggaccacaggtgtgcaccaccacacccggctaattttttgtatttttagtagagacagggtttcgccatgttggccaggctggtctcgaactcctgacctcaggtgatccacctgcttcgacctctcaaagtgctgggattacaggcataagccactgcgcctggcctcggtttgcagttgtcaaagcaagtgatacatttggatggcaggactcccaggggctggccaaagatttgtacccagggccgtgccttcagcccatggctgtctggcctcgctgcccaggcacatctgtgtctgtacttttccgatggaagatccttgggggacagtgggctcctgtttcacttcctggccctgtgctctcaggctgttcaactgtagagtccgtgcttgttctgagaactccctttgtccacatgcctggcgttgaggtggggaaactgaggctggagggcgggggaagggcgtgcccagggtcacggagccacgccgtgcttctcagagaggctcccccctcagccctggctcccggacctgctgttgctgacctgacctgtgtcattggccactcgtagttccgaccttggtaaccgcaggggaatcgtatgctggactcggcccctcagtccctatgaagagccggggctctgagtgttttcctctgggacttacgtacgatgatgagaatttcacgatgtggtttctcttcccaaaaatcctctttacggcggttgtcaaagacaggccactgcacctcgctgctccccagaatcacaagaccccgccagagccagttctggcttattcttttaaagaggtctggcagccaggtgcgctggttcatgctcataatcccagcactttgggaggtccagacaggaggatcacttgagcgcaggagttccaggccagactgagcaacatagcaagaccctgtctctaagaaaaaaaaaaaattagcagggcatggtggggagcacctgtattcctagtgactggggaggctgaggtgggaggatcgcttgagcccaggaggtcaaggctgcagagagctatgatcatgccactgcactccagcctgggcaagagcgagaccctgctgcaaaaaaaaaaaaaaaaaaaaaaggtctgggtttgaggctcccttccaggaggccttcccagctgcaggtgcctcgccagctgtctccaggcccagaatgttgcaactttttttcttgactggtaataaagtagcgagatcttccaaaagccagaaccctgagcagctcagcctccgaccccccggggttcccatagcccaaggatgagctagctgtcctctccccaacacccatcgcaggttgggacagaaggcacagctctcagtgtgacccacggcttcagtgtggctgttgcttcttttctagatggctttttctcctatttgttggagctcccgtctttaattttgggaacgtcacgttctatagcactgcagccctgtgattcccttctggcttccgttggagcttgagtgtgttgtttctgctgagcgggaccatgagcccaaaaggggctgccagcccaggctccctggcagatggacggacggcctgagcccaccaggaccagccatgctcacccagtccctccccacagcgccgctgcccccggcccccgacctgcaagaggccgaggtccccatcatgaggacccgagcttgcgagaggatgtatcacaaaggccccactgcccacggccaggtcaccatcatcaaggctgccacgccgtgtgcagggaggaaggggcagggttcctgccaggtgagaccccggccctctgccctcggcgtcggctgtgggagctgctttgccatggggctgtcccctgactgtcctccccatacagggtgatgctgggaccccccggtctgttaccggctggacacctggctccaggttggcgtgctgagctggggcgtggcctccaggcatggggactaccctggtgtctacacctgggtaatgacctattcatcctgggtccgccagcacgtcccgctagagcgttgaggaggctttgattgctggggagcgggcctcccctctgctcctcctcccgcctccaggccctgttcctgcccaccccgcctggcccctgaagtaccccgtccttccctgacctgggggtgaggacacagcggcaggggagactcagaagctggtgtcccgtggatgtgggcgagggaggatgcacccagggaccttgcctcctgcctgggtccgccatgctattaaactgtgtgaacagcagcctctgagtctctgattctctgatgtgtcctgggccgtggtggggacttcctggtacacatctcaaggttctggagggctcagggccagcctcgagtgactgcaccttcacgcttggttgggggccagtggggagggctccgcttcccggaggcagcccctgggcagctcagcctccccgcccgggttcccagagcccacggatgagctagctgtcctctccccaacacccatccctggtttggacagttgtttgctcatttccctcattcccccaaatctgtgacatcaaacccagccgcgctgcaccccagttcagacccggagccgcactgcggggccagcagcctgagcctgctccctcggccgtgcctcctcctcggacctcctggagtctcggggtcagctgaggacatagcctccctgaactgtggggtctccgtggagctggctgccctggaatttggcggaccccagctctgcccctgagcagctgctccctcacccttcctctccaggcagaggagccactgtgggcgtgggtccccgcagctgcccctaagaccctgaacgggacacagtggtcctgtcacagccacagccacagcctgcgcaccacgaggccccgtggtcccaaagcccctgcctggtgagctgtggccactcccacttatctgggaacaacattctctgtcccccacttttgggggagacgggagcaccccactgcatgggcttcctggagccgcagggaggcccggccttcaccctgctgagcccctcctgctccctgggcccctcggaagcaagggatccacttccccccggaatccactgaccaccccctcccccagggtctcctccacaataggggcctgaggacagcttcctcgggggtctctctgcatcccctcttggccccaccaggattccggattcttctcacagcccaggcttcctgggaccccaggggggcctgcatggggctacagggcccttgaccccgggtggacctggatgtccccagactgcacatcagatcaggtttctgttatcaggggcatgaggagaaacggctgagaaagttcagtgaagaaacgcctgggaaaacaccgtggcgccctctctccagctctgggtagttggctgcctcgtcagctcccccgccagcctccaggctggggcaggacggcttcattctgagatggacgaggcagggggtgcggagagtggctgcctccgcccctgggcctcagcgggagggtccccctgggtggcctgatgctctcaggccccgccgccctgcggtggctgtgagtatcagatgggatcgtctgtccatcctcctgacaggcgaggggccgggggatcactgacctcacctccggcagaggaacttctggcttttagtgccaactgccccaccccaactacatgtgcctccaacttgggaagcccgaggtgtgcggtgggggtggggggcacacagagatgggggaggggcttaaggcttaagactggagaaaaggatttaggaagagtttgggggcaggtgggggcccaggccagagagggagggaggagtagggaccatgcagcctcagggagcacgagggtcaggctccctacactctgggcaggatgtgagcccctgagccccctttcattagctccggctggggtcccagcacccgccggtggggggatgggcctggagctccaggcctttctcagggtgcctgtgacctcttggtggaggggccccagaggaggagcagctctcaccgaggctggggacagacggcccaggctgcaggacgtgggcacgctgaatcctccagcacgggacagccaagtcccagtctcctcctgggtcctccctccctcctccctacatctctcctctccgtcccttccctcactgcctttccggcggcctctgtggttgccggtcctggctctgtccccgaagccccctgctcccttggagaatcacggcttcggagccaccacacctccgaagctcttgcccaagacccagggtgcagccatggcatgtccaggacggcatttctgcccctaggcccctctggtcagcactgcacgggtctctctcctgtctctggggcatagtgctcctatggtcccagctagttgggagagctgagtgggaggatcgcttgagcccaggaagtggaggctgcagtgagctgtgatcatgccactacactccagcctgggcgacagagccagaccctgactcaattgtgtcccgaaggccgctctgaggacggaggacctcaccccaaccacacccaacacggaggtgtctccacgtgcagaccccaggctgagccagccggaggacatctggccagagtgggcttggccagttgtggtgggcaccaccatggtgggtacctcgctcggacaatctgctgggcctgtggcccctgtcccgggagcgagccgcacctccgcacggggctacccgtcaccttcatggggtgctgcagctcatgaactgctggaaactgtcctggggaccccatggtgggaggcagaggcttgccgctgcctcgggctccttcctgagctccagatctgagatttttccaagggccctgccgtccaaaccagccctgtgatgctgtgacgtcctcgtggaggaacaggcaggctggagggtcccaaccccgccccggccgctctctgccctcaccctctcctcttacccctgtcctgccagcccaggctgcggggtgggtggagacttggagggtgggtgggagagagagtggaggagagggtgaagagacctgaggccaccacagggccccaccctcccgctgccctcctcctgtggctgaggataaaggggctccaaggggccgggggagagagcagctgagtcccggcaccgtaagggcaccgtcccctccctgatgcctgcgggcggctcctggcccccacccctgaccccgggtctgagcccccagcccccaccccacgccctccacccctgaccccgggtctgagcccccagcccgcaccccatgcccaccacccctgaccccgggtctgagcccccagcccgcaccccacgccctccacccctgaccccgggtctgagcccccagcccgcactccacgccctctccccgcagctgctgctgctgctgttcctggctgtctcctccctggggagctgtagcactgggagtccaggtgagtcccgaccccacacagccctcccttcccaggggctctgccaccccgtccccaggatccaggggacacgtgcacggcccggctcctgcccgagggcaggcgtggggtgaggctcgggtggcagaggccgggctccctgacctccttctgttgttcccagctcccgtccccgagaatgacctggtgggcattgtggggggccacaacacccccaggggaagtggtcgtggcaggtcagcctgaggatctatagctaccactgggcctcctgggtgcccatctgcgggggctccctcatccacccccagtgggtgctgaccgccgctcactgcattttccggtgagtcctgggccggggaccccaccaaggggaggtgggagtggggccgccccataccaggtcccttgagtagcctgggtctgtcctcccccaggaaggacaccgacccgtccacctaccggattcacaccagggatgtgtatctgtacgggggccgggggctgctgaatgtcagccagatcgtcgtccacccaactactctgtcttcttcctgggggcagacatcgccctgctgaagctggccaccagtgtgagaacaacaaacactctcgcggcagtcgccctgccgtcatagtccctggagttcactgacagtgacaactgctggaacacaggctggggcatggtcggcctgttgggtgagaaccagagggacgtggggcgggcgtgcgggggggtcctgggaaggctcatgaaagacaagcccttggtttgcacattctggggtttctcttgctagggttggggtgcagggttcaggtgagctgccctggggaattcaagctcataaaacagggagcaaagaaaatgagcctttggggtgggtggcaggagccactgactgtgctgtgcgtgtgtgtgtggaacacgtatcttacccatagacatattgcaagacattttcttcattttgtggaaaagaaaatgggttcaaagagggcacgaatttatccatctgtccatccctccactgaaggctgcagagaccctgaagctttcttcctttcctgcttcgggcctctgttctttgaaaggcaatacctggtgctgttctagagcgcgtagatcccgcctcccttttctagagtgtgtgcgtaggtcctgcctcccttttctagggagaaagagagtgtgtgtgtgtggtcccatctcccttttctagagtgtgtgtgtgtgtgtgtgtgtggtcccgtctcccttttctagagtgtgtgtgtacatcccgcctcccttttctagagtgtgtgcgtaggtcctgcctcccttttctagagtgtgtgcgtaggtcctgcctcccttttctagagtgtgtgtgtgtgtgtgtggtcccgtctcccttttctagagcgtgtgtgtgtgtgtgtggtcccgtctcccttttctagagcgtgtgtgtgtgtgtgtgtgtgtggtcccgtctcccttttctagagtgtgtgtgtacatcccgcctcccttttctagagtgtgtgggggtcccgtctcccttttctacagtgtgtgcgtaggtcctgcctcccttttctagagtgtgtgcataggtcctgcctcccttttctagagtgtgtgtgtgtgtagggtcctgtcttccttttctagagtgtgtgtgtaggtcccgcctcccttttctagagtgtgtgcgtaggtcctgcctcccttttctagagtgtgtgcataggtcccgcctctcttttctagagtgtgtgtgtagggtcccatctccctttgctcccaatttaaaaggtattggtggatgggggtggtagggtggtgggggagtgtgtgcggtgactcacacctgtaatctcagcactttgggaggccaaggtaggaggatcacttgagcctaggagttcaagaccagcctggccaacacagggagaccccatctccacaaaaaattaaaaaatatatatattggccaggcatggtggctcgcacctgtaatcccagcactttgggaggctgaggccagtggatcatttgagatcaggagttcaagaccagcctggccaacatggtgaaaccctgactctactaaaaacacaaaaattagctgggcgtggtggtgggtgcttgtaatctcagctactcaggaggctgaggcaggagaactgcttgagcccaggaggcagaggttgcactaagcagagattgtgccattgtactccagtctgggcgacagggtgagactccatcttaaaaaaattaaaattagctgggcatggtggtgtaggcctgtggtcccagctacttggaaggctgaggctggaggattgcttgagcatcgctggagcctgggaggcggaggctgcagggagctatgattatgccactgtaccctaccctggcatttcccttctgggttcctgcagctttagaggtggagcccctttgactccaccttaggctgtgtaggctgagcatcccaggtcctgagctgaggctgggggcagggaggggtcctgccatggtgctggttgggggcccctcctgagctgctcccgccacccgtggcttgtctctgcagatatgctgccgcctccttaccgcccgcagcaggtgaaggtcctcacactgagcaatgcagactgtgagcggcagacctacgatgcttttcctggtgctggagacagaaagttcatccaggatgacatgatctgtgccggccgcacgggccgccgcacctggaaggtgagacctggcgcctctctcctgccatctcttttcctgtctgcggctccgatgctggacttggatgtgcagggtcctgggtctctggtcaagctgggccttctctgctccacagggtgactcaggcagccccctggtctgcaagaagaagggtacctggctccaggcgggagtagtgagctggggattttacagtgatcggcccagcattggcgtctacacgtgagtccagacctatgtgccctggatcctgcagcaaatgcacctctaagccccaggctcctcccagctccccaagaatccagttccttcctcgtcctggcccctccgctccctgcgccttccagcacccaccttctctgctcctccatcgcacatggtcctcactcccctccaccttttcagacctatcaccttcctccctcacactgggaggaggaggcatggaaggtgctttgaatgggggtgaggttagggatggaagtcctggagccagtttgcagtatcgtctcgttaaactgttagcaaggcaaaccagaaagtggccagtgtgttcctgagtgtgggtgcggctggcgggcagtgaccgggggcttcctgacgtgggtgcatctgctctggacagttgcactgtagaaatggctgctccagaccagacattctttggtggtggagggaaatgatgaatggggtggtaagatcaggggaaatattctcagtgatgactctactcttgggggcccagctcccagcccagccctccactaaaagaacaggtcagcctcattaccaaatttcaaccatctaccatctgtctacccatctacccgtactaaatccatccactcatccagccatcaattcatccatccatccatccacccacctatccactaattaatcaatccatccatccatccatccatccaaccatccatccatccatccacctatctattgatctacccatccatccacccacccacgaatctatccactcgtccatctgtccatctgtccgtccacccacccacccatctaacctgcccagctctgcccagccctgcccagtgcccacctgcagccctgcccagccatgcccagtgcccagggcatctccagggtgtggcacaggaggcttctgaggaaacccaagcacggtttacatccctagttgctgggccactgtttgccctggggcattggagcatttagcactgagacttcccatatggccgccctgtgcccgcctcgcagaaggtctgggactagggctgggtcagggaggctgctgggctgtgacggggcaccaggcatcctcaacctgagatggggaagtcttcattctcctttctcttgcaccccccacccccaaggtgagggtcaggtgaggctgagaaggcccctgagcacccagaggggcagctacactctcctgctggagaaaggggcttcacggagaggctggcccgggagggggtctgagtctggtcccttccggcttcacaccgtgagtgaagcagcagggatgttgtctctcccggcaggtccctcccacctcacccggagagaaccacacagggcaagggctagatgtctgggctccccagtagagaggagggggcctctgtattcagacagtggggtgcggggggagatcagggacagatcagaactgtggtgagggccccgtgcctaaagcaggatgcagcctggacaacggcacagagcccactacgcgcaggtcccttttgcagcactgcagttggaggcagagctgggcaggtgctggggtgggtgctgcggcagctggcagtgtgccaaccatgcagaggcccagagaccagctggcagggtgccaaccatgcagaggcccaggaccagctggcagggtgccaaccatgcagaggcccagagaccagctggcagggtgccaaccatgcagacgcccagagaccagctggcagggtgccaaccatgcagacgcccagagaccagctggcagggtgccaaccatgcagaggcccagagacatgggccagggccaggagtgggtctgcaggcccttcacccacgtcacctgctacccgacggccatccccaggcccttcacccatgtcacctgctacctgatggctgtccccagcaccctcacccacgtcacctgctacccgacggccgtccccaggcccttcacccatgtcacctgctacctgatggctgtccccagcaccctcacccacatcacctgctacatgatggccgtccccaggccctttacccacatcacctgctacccaatggctgtccccagcacccttacccacgtcacctgccacccgacggccatccccaggcccttcacccacatcacctgctacacgatggccatccccaggccttcaaccacgccacctgctacacgacggccatccccagcaccctcacccacgtcacctgctacacgatggccgtccccaggcccatcacccatgtcacctgctacacgatagctgttctcaggccctgccacagggacaaaggggccaccctgatgagggacaggaatctcactgacgtcgcccccccccccccccccgctcatagaggatgcaggcccacggatgcgtcctgtacctgtccctgggtcatctcaacgctgtgacccaccctctcctgggtctgacagcctctggacagcccctgggcagagccgtgccccacagggacaggctgagggggtctgccactgtattcttcccactgctctgccgggaaggcctgggatctgtctgctccccatgtctaccacatgtgccctgagcctcatctcgtgaagctctgggccacaccgccatgcccagctaatacttatatttttggtagagacctggtctcactatgttgcccaggctggtctcatacttctcagctcaagcaatcgtcccccactcggccttccaaagtgttgggattacaggcgtgagccactgcacccagccaattacttcaatttttttaattttttaattgttgtgggtacgtagttgtgtatatatctatcttgcatggttttatgtgacaattatactaaatcttcaaggaacaaataatccccatttcaaacaaactcttccagagactagaaaaaagagacgaatgtcctgactgattagattcgatgagcgtcgcctgcagagcaagcctggactaatagagagcaggaaaacttcaggccgaattaactcacgaacattgactcaaacatccaaaatcattaacaagctgactctgaaaatgtgctcagaattacaacaaaacctaaacaggtctaaagcaggtgggtttaacgctcgggaaatctaaccgtctaatttgccagttaacggagcagagataaacaaccatgtgataatctaatcgataagtatttgattctctgggttgatcaattcaaccaccaactgcaataaaactcttagcaaatttggcagatctcacccaagctcaaggcaaacattctacttaacagtggaccgcgggaagccccttctgtgagtgagggatgggtagggacagccacccctccccctgcccagctcagtgcatgcagccccgcgcagcacatacatgaagagaaacaggccaggtgcagtgcctcacgcctgtcatcccagctactcgggaggccgaggcaggcagatcacctgaggtcaagggtttgagaccagcctggccaacatggtaaaaccccgcctctactaaaaatatgaaaattagccgggcttggtggcacatgcctgtaatcccagctacttgggaggctgaaacaggagaatcacttgaacccggaggagcggaggttacggtgagccaagattgtgccactgtattccagcctgggtgagaagagtgagactctgtctcaaacaaaaacaaaaacaccaaaatgaaacaaaaaacaaagagaaatgaataaaaagtgtcagggtcggaaagaaagggacggggttgcagtgtctgctgacaatgcagtggtcttcatagaccatccaaggtcacctgcagacagtgtcagggcacgagcgcagcaaggcagctgatccacaccaatgcaagaccaacagctggtgatacacggggcttctaggccgggcgcggtggtcacgcctgtaatcccagcaccttgggaggctgaggcaggaggatggatggagccaaagcgttcaagaccagcctgggcaacatagtgagtctatctctataaaaacattgttttaagccatgcagagcctgggcaacacagcaagaccccatctctacaaaaaatacaaaaattagccagatgtggtggcgtgcacctgtagtcccagttactcaggaggctgaggcaggaggatcatttgagcccaggaatttcaggctgtagtgagccaagatcttgccactgcactccagcctgggcaacagaggaaggccctgtgtccaaaaaaaaaaaaaacaaaccccaaaaaccgtttttatcaacaattgtattggctccagtgtttgttgaagaaaattgctttttgttcatttaaagctctaagcaatacttctcatcagaaatgaaacttacccactaacttctgaagattcacctactcaccaccctcatggacctcctgcacgtgagctccccggcaggaatatcatccagacgcaaatcgtcttgctggctgggaagacgccgaaactcttggtttagttttgcctccacaccactgcggaggggaaagaaacagattttgtcggatttaagttgaaagcacaatatgaagtctcatgatttcagaggagaaagggccaccatatccaagaccatgtgaggaaaaaaaaaaaaacaaaaaagagagccccgcccaccagaagcggcaacgaatctgtcattggcccaaggatggaaaaccacgcccatgctgggccccacattccacctgcccccaaccccagagccggctccgccctgggctccactgtggctcccgggggctcgattccagcccatcccaatttccagtgatgtttattattatttattattattattgagacagagtcttgctctgtcacccaggctggagtgcagtggcgcgatctcggctcactgcaagctccgcctcccgggttcacaccattctcctgcctcagcctcctgagtagctgggaccacaggcgcccgccaccacgcccggctaatttttttttgtatttttagtagagacggggtttcaccatattagccaggatggtctctatctcctgacctcgtgatccacccacctcagcctcccaaagtgctgggattacaagagtgagccatcgcacccggcctcagtgatgtttattattagtaattattattattattttgagacagagtctcgctctgtcacccaggctggagtgcaatggcacaatcttggtttactgcaacctccgcctccggggttcaagtgattctcctgcctcagcctcccgagtagctgggattacaggcgcccacaaccatcccaggctaatttttatatttttagcagagatggggttgcaccgtgttggccaggctggtctcaaattcctgacctcaggtgatctgcctgccttggcttcccaaagtgctggaattataggtgtgagccactgggcctggcctccagtgatgtttaaaagatcaaatccggccaggcacagtggctcatgcctgtaatcccagcactttgggaggccgaggtgggtggatcacgaggtcaggagatcgacaccatcctggctaacatggtgaaatcctgtctctactgaaaatacaaaaaaaacccaaaacaaacaaaaaacaacaacgccgggcacggtggctcatgcctataatcccagcactttgggaggccaaggcaggcagatcacctgaggtcaggaatttgagaccagcctggccaacacggtgaaaccctgtctctactaaagatacaaaaaattagccgggcgtggtggtgcatgcctgtaatcttagctacttgggaggctgaggcagcagaatcacttgaacccgggaggcggaggttgcagtgagccgagatcacgccattgcactccagcctgggcgacagagtgagactccgtttcaaaaaaacaaaaaagaaaaaaaaagaaaaaaaaatcaaattccttctcttaaattctcttctgcttaaacagtgagtctggttcctgcttcctgttatagagcctgtctccatacagctgcagcataggcagctcccagagggaacagaggatgcctgagcccatgagtggcctgagagatgcaactggaatctcgttccttattcaggtcccctaactttttttttttgagacagggtcttgctctgtcactcaggctggagtgcagtggtgtgatcatagctccctgctcaacctcctggggtcaagtggtcttcctgaggcagcctccccagtagctgggactacaggcgtgtgccaccacacctggccaattttgttgattttttgtagggatggagtctcactttgttgcccaggctggtcttgaactcctggcctcaggcggtcctcctgcctcagcctcccaaagtgctgggattacaggcgtgagccactgctcccggctcccaacagtaagtgttactgacgtttttccactctgcctcatttttttttccttttttttttttttttgagatggagtcttgctccattgcccaggctggagtgcaatggaccatttcagctcactgcaacctccacctcccacgttcaagcgattctcctgcctcagcctcccaagtaactgggactacaggcacgcgccaccatgctcaggtaatttttgtatttttagtagagacggggtttcaccatgttagccaggctggtctcgaactcctgacctcaagttatctgcctgcctcagcctcccaaagcgttgagatgacaggcgtgagccacggtgcccagcctgcgccccatctcttgtcacccgtatcagtgtcctgaggctgctgcacaaagtgctgcaaactgaggggcagaattttattctctctcaatcctggagtgtcagcagggccgcttgctccagaggcttggagggaggggccgctccatgcctgtctcctcgtgtccggcgctgctggctgtccttggcttgcagccacatcactcccatccctgcctgccttccccggccttcctccaccgctctaggtctcaggccccctctcctttctcttataaggatgcctgtcattggatttagggcccactctaattccagaatgatctcatcttgacatcctcaattacgtctgcaaaagcctcatttcggaatcaagtgacgttcacagttcctggggctcaggcttgaacgtatcttttcggcaaatgcagttcaactcaccactgcacccggctcctgaccccggaggtattttcctccttcacctgcacgtcctgtaggagcctccctgtgcagacacagcactgggcaacttgtagaaccttctccacacaacaatgcccaattttggccgacctcacatctgattccaagtataaagcaccgaataaaagataaaaggaaagtgtcacctgcatcctccacgtgagaatccgacgttcctgtctctgcacagggcgagcttggctcacccaacctggactcggctggggcccaagggctccttggcctctcccgggcaagcttggttcacccaacctggactcagctggggctcgaggggtcctcggcctctcccccagccccccgcagcccaggacccctgactgtaggctccaggcctccctggaagccctggccacgctcgccccgcagccctcagactggctgtgcttcgcggatcttggctggttcgaggctggtgccgtccccgccttacctgggcctcctggaccctgcctcccggcagctgggtgggggaccaggagagtcctgcacccgtgacgcagctgccacattatcctcgtgtcccgggagggagaggaatcaccaagaaagcccccaggctaagcagctgtcctctcttctcctcggccctctggctctaaacaaggaacccaggtgatccagacccgagcttccctcccatcagcctctcctggcctcacctggctggcctcccagccctcccatcctccagctgctctcctgtctccttcttgcatcttcagatggagctgcccactccatgggcctgggcagcagcttgaagtgggcgtgggccaagccctctgggagtgaggggtgcagcggctcccaaggcacagagccagaggtcctggcccatgatgggtgaatgcggccaggagggagggacggggcagctgggagtccatctcgggcagcctggggcttctctcctccccatgcagggaggtgcagggctgggcatgcaggtggaagtctggctgcagaggatttcacagctgcaggcccagcctcggggacccactccctcagcctccggggaatcctgaggcatcaccaggaagctgctggtagcatggagaaggctggatttgctccagctggaggacatgcgggcacacacacacactcatacacgcatgcacacacacatgcacacgcacaatgtacaaactcaatgcacactcactcatacatgcatgcacacacatacacgcatgcacacactgatgcatgcacacatgcacacacatgcgtgcacacacatacatgcacacacgcacacatgcactcatactcacaagcatgcacacacatgcatgcagacacacactcatacacacatgcatatgcacacatatgcacacactcatacatgcacacacatgcacacatcacgtatgcacatgcttacatgcacacattcatacacacatgcacacacacattcacatgcacgcacacacatgctttcaaacatgcacgcactttcatactcacatgcacacacacgcacatgcgcacactcatacacatgcacacacatacatgcatgcacacacatgcttacatgcacacatgcacactcatacgcacacacaggcacacaaacacatgcaaactgacgcgcacacacgcacacatccttacatatgcacacgcatacacacatgcacacactcatacacgcacacacacactcatacacgcatgcacacacccacacttacacacatgcttacacttatactcacacacatgcaaacacacgcacacacacgcaaacacaaacagcagcatgcacacactcatacacacatgcacacacacatatacacacgcacacacccatatacacactcatacacacacactcgtacacacatgcacacactcatacatgcaggcacacacacatccacacatacatgcacacatgcatgcacacacatgctcacacacacacatgcacactcacatgcttacacacatgcacacacttatactcacacatgcacacacatacatgcacacagaggcatgtgcacaccccatgcccacacacgtatgcacacacacacaggcaccccccacacccccacccattcacagtgctcccttgtgttcccacaccaccacaatcaccctggttacaatctcatggcaaagcaagacttctggaggagaggctgtagggttgggcctcggcctctgctgcccctgtcagccccagaacgtgtctgccacctgggctgaaacaggcatttgctgccggagccccaaggcacagcagtgggcagctggggcccagggggctgggccctggcctgagaatgcagctccccaccctctgagactcccagcaggtgacggcccctctcccagagcagagtgtgcccctcctgcaacctgaggtttgtactgattaaaacaggttcctggagcccatccagaagatctccctgtgtgggctccacaaactccctccaaggactggagcctgggcctggggcggccaccatggagcaggcgggtcccctggcccaggctccaagtgcctctggcaggccctctggctgatacttttgcacccgtggaggtgtgtacaagtgcccgtcccgtcccgggtggcaggagaggctgcgggagagctggttactaggtgcttccttggcctctgtggcactggccatgagaatgggtagcatggcgacaacctgagcactgtgggcatttggggccaggggccctctgcagtggggccatcctgtgcaccgtagacatttagccccccaaccccggcctcttcccactagatgtgggtggtgtccctatatccctgacaagcataaatgtcccctgggggacatagtcacccgtgggagccactggtgtagacagggaacccgggtacaggacctctgttggcccagcagaggggatgcgaggggctgggggtggcccctatcctcatggtcaccctgtttacagcctgggctaggagctattgcccccaccctgggaaaagaatgtctgactgagccccacccacttcctttgcaaggaagagaaagcagctccgggagggtccgggagggcagctgtggccacagaccacggtgaggacactgaccaccggcagccacctgtggcctccagacccaggtccctcctggctctttccagccagccctctcctccctgcgcagatgctgtggctgctattcctgaccctcccctgcctgggggggctccatgtccaagaccccaggtgactcctggcccaatcccacactggaccctcagggactgggctaggacggagagctgaccccctcgtcgagcagggcctggaagctcctggcattgcaggagggtggggcccggctccctgacctcctttggttgttcccagtgcccgtcccagagaatgacctggtgggcattgtggggggccacaatgcccccccggggaagtggccgtggcaggtcagcctgagggtctacagctaccactgggcctcctgggcgcacatctgtgggggctccctcatccacccccagtgggtgctgactgctgcccactgcattttctggtgagtcccgggcctgggaccccaatgaggggaggtgggagtggggccgccccagaccaggacccctgagcagcctggatccgtcctcccccaggaaggacaccgacccgtccatctaccggatccacgctggggacgtgtatctctacgggggccgggggctgctgaacgtcagccggatcatcgtccaccccaactatgtcactgcggggctgggtgcggatgtggccctgctccagctggtgagccccatgatctgagccgctaatgtcaggacggtcaagctctccccggtctcgctggagctcaccccgaaggaccagtgctgggtgactggctggggagcgatcaggatgttcggggcgtgttgggtggaggctggggaaggactcgggctgtgggcccaaaacgcctcattccagggctccgggggtggtggtggggtgggtgagttccagaaagggaagagacggagctgctcaccgccatgcagcacctccggctgcttttccccacagctctgtgctgcccgggcccagagactcgggggtcctgcgagtgccaatggccacaccaagctccagactcattattcagaggggaaaatacttctcatttttttctacttaggaaaggtttttaaatttttttgctgggtgcggtggctcacacctgtgatcccagcactttgggaggcagaggcaggagaatggcttgagccggggagtttgaggccagcctgggcaacatagcaagaccccatctctaaaaaagaaaagaaaagaaaaaacaccgcaaacgaaaacacctcaaaaccaaaaggcattttttggaggaaaaaaaacagaaaaactcatccctccacttttctctggtccgtccgactgcgagccctgggagtttagagggagacacgagccctcccacctcctggggtcccacacaccgtgctcaggctgggaggttcaggccgggactaggggcccttggccacaagggagccaccttccttcccaacctggggaggtgctggggctgctgggttgacggcaggggcgtctccgctgtgccagccggggtcacctctctccccagagtcgctgccgccgccctaccgcctgcagcaggcgagtgtgcaggtgctggagaacgccgtctgtgagcagccctaccgcaacgcctcagggcacactggcgaccggcagctcatcctggatgacatgctgtgtgccggcagcgagggccgagactcctgctacgtgagtgcccccggcccgccctgcctgcctgccctgctcccaccgcagagctcagcggtgacccctttccttcccttcctcagggtgactccggcggccctctggtctgcaggctgcgggggtcctggcgcctggtgggggtggtcagctggggctacggctgtaccctgcgggactttcccggcgtctacacccacgtccagatctacgtgctctggatcctgcagcaagtcggggagttgccctgagcaggctgggctgggctcccacctgggtcggctgaggagggaccaggaccttcctcctcccagcgatctccgcttcggcctccgctgcaggccaccgtcttgagcccggcttctctggctcctcagcgcccaggacctccctgatgccggggtggggaaggggccggggaagggagggtgggggcctcgctgcgtctctgtctgattaaagagcaagagcagagtgtgtggcgtctctgtgggatggatttgcattccaagctgcagccaggtgcggtttgctcagccacctcctgttggaggcctccacattttggctatggtaataaagatgctgagaacattcatgctccgggctctgtgtggacgtgcgtctctgggctctgtgtagacgtgcgtctccgggctgtgtgtggacgtgggtctccgggctctgtgtggacgtgcgtctccgggctgtgtgtggacgtgggtctccgggctctgtgtggacatgcgtctccgggctctgtgtggacgtgcgtctctgggctctatgtggacgtgggtctccgggctgtgtgtggatgtgggtctccgggctgtgtgtggacgtgggtctccgggctctgtgtggacgtgcgtctccgggctctgtgtggaagtgtgtttcctgtcctctgggggcgacactcacaggtgctgcttcaatgccaggttccagatgaggaaaccgaggcaggaaagtcaccggagatggaggcgcagtgggttggggctcgggggacccaggccggcacgctgcacgctgctcctgtgctggggcctccgcgtccccgggccctggcctcccagggcagtggttaggtttagattcctgccccgactccctcctgtaccgggcgacgccatgggtcccagagctcagacaccaccacgcagggcgagacgggagtggacggccgcgagaggcccagcctccgcatggggtgccttcctggggcgcttcctctaagggccaggccagtgtgggcagggagagcagtgctctgaggggcaggcgacgcccagaacggccccgtccctcctccgccccgtgttcattctgcacctggaccaggcagactcagcgcccagaccccaggctgcaggtcaatgtgtggttctggcgtccgctcccccgggcccccaaaaccaggggcttcctcctctgcccctgtgctttcgggacctctgcagggcagagaagaggtggaaggtcaaaagggagggtctggggaggctcctggctcctccgcagaagtttctgcaggtgagcggctcggggactggccttcaccctcccacctgccctcgcccgccctgcctgtcactcccggggatgagggtcgggaggatccccacagggcaagggcttcagggcaaacccaggctctgagcctccgcgcagaaaccacatctgggtttatactttctcccacgcccctggtctttccagagtggggcagagcagagcagttggggcgccccagctgggggagtcactgcacttcaaggcagtgggggaaagactcccggggtgtggacgggtagggcactgccctttctttcccggggagctggctgcctctgacactcctcatgcttcccttcctgggagaaagcggggagccccaggccaggttgccggctgctctaaacccagggtgagacctgctggacacagcccagggcctcaggggacgtgaccacagcccgcgtcccagggcgctctcggcgggggtccagggtccagctgcaccccgccacctcccagggggctcctgggtctcccacactgccctggctccctgggctttctaagacaggcagcgggcagtgatcagtgccattcccaagtcctccgagccacgtccccgcccagccggaccccgctggaccctgctctgccctggcagcgttcagagtccctcccttgcagcccctgatctgtgcgactcacaggacaccaagacccagacgggaagccgagcactcacaccctcagtgcggccacggcaggcttccgtgtttgacggagaaatcacctcccgctgccgggaggagaccgaaattaattgctcctcctccaaaccgggagccacctgtgcccccactcgccgaccagggcagctgaggaggccccaccccacagtgactagttgtgcctcggggtccaggaccccgcagctcctgcagctgccccgagacatgcctagacccttcctcccccgtgacacccacgaccagaaacacagtgacggccacacctgctttccatcatgcactttaatgagagtcagcactagagaggatgggcgtccaccaccagctgcctgggcaggggagggccggaggggccgggaggggcggattcagggttggggaggaggctcaggatggaggagggggcaggatggaggagggggctcaggatggaggaggggctcaagaaaggggagggggctcaggatggaggagggactcaagaaaggggagggggctcaggatggaggagggactcaagaaaggggagggggctcagggtgggggagggggctcaagaaaggggaaggggctcagggtgggggaggggctcaggatgggggaggggatcaagaaaggggagggggctcaggacaggggacagggctcaggatgggagaggggactcaggatgggggaaggtgtggggggcagtcaccacctgggtaggaagcagtggtggtttggacaggaggggctggccctccagtgacccgggtggacaccccaggcctggctcagggcttcttggggacatagtggtggatccagtccaagtagtaggtgacacgggtgtagatgccaggccggttgggctgggcacagctctcctcccagctgaccacgcccgcctgcagttaggtgccattcaccttgcagaccaggggccctccagagtcaccctgggaaggtcagaggtcagtgctcgctggccaggcttcgggggtcaggatgagggatgcgctcgctggccaggctccggggattggggtgggggacgcgagggcccacctggcaggagtcgtgattttcgctccccgcacacagcatgtcatcgcggacgatttgaaagctgtggcccgtatggaggccggtgtgatattccgcgttgcaaaggtggttttccactacggggacttccacctccttcagcgggtatggcggcggcaggtgcactgggggcggaggggggcgtggagccgggtctggggccggctgggtgctgcttcgtggacttggtggcagagtcacgggcaggggagatggcaccatgggcccagtgctgttctgtgcctgcagccccggggaaggggcggtgaatgcagtccaggcccctccgctgaggctggtcctgggtccctggcctcatttaagccccatctggggaagggaggggagggccctggaggttgccaagctgggctccatggcacgggggtgcagagcccgacccgtgtctccccctgggctcagctgactttcgtctgggctaggcccatggtccacggttggccctagccgaggggaacacagggcgctgggctcagcttccccgctgtgtggggcggaatagcgggacagtggctcaggccccttctgagtgacccagaggtcacagcccagggttgccgctcaggctgtaccccaaagctttgctctgaattgtggataaaatggggacaagaccttctagaagtgaaaatgtgcctcgtggagggccacagtgagcttcgtccagccccccacagcactgccacgaccccgattcccaggcccctgccttgtctgtagcacagggatggagggcaggcaggtctcatcccagcaccggtctctctccttccagcaagacccccgtgtgatttctctctccacatagcaagtccgtgacgtacaaacttttgatgcaccctttcaggcaaggggaaaccgaggcacggaggtgctaagggactctccaaacccctggggtgggggacgcccaggccctttggactcaccgtctctgctcagggcacctgctgcctctcgccaccgcctgctccatccatcctggcctccacagtccccctccctgagccgccctgagggaccctgtcaccccacggactggcctgtggctgtgacttggtgcccacctggcccggcctcccgctgtccccaacacccaccattattgtccacgtcgccccagccagtgacccagcacggcatccccggggggaaggtctccgaggcagggggcagcgtgaccgtgtggatgtggctggagatgttcacgggctcctccagctccagcagggcgatgtccgccccggtctggatgatgtagaactgtgggtgcacgatgatcctgctgaccggcagcagctggtcctggtagtagaggtgctgctcccgcagttgcaccctgagggcggccagatccttgatgtccctgggcagcggaggatcccactcagggccctgggcagcccccaggagcacccgggagccagggctcacatccagcccttgcccacccctccaggccccaggagactcacggttccacgcagtgcgccgcggttagcacccactgggggtggatgagggagcccccgcagaagtgcatccagtatgggccgcggactctcaggctcacctgccagggccacttgctcctgggggcctcctgccccccaacaatgcccgtttgctgcagggcctggcctggggctggggcaggtgccaggtcaggaccaagaagccgccccacgcctgggaccagcccttccctgtgtgggggccagcccggcctccccagaacccacccaggccctgatctgtggaatgtggtgaggggcagggtggaccccggctgggactcaccaggggccacgtaggccgggctcgccaggacgggcagcgccagcagcagcaggctcagcatctggggagcaaggaggagcatcgtgggcctggccgggcctcacagggcagggctgggggctacagattgtggggtgaagaatggagctgggacggggggaccggggtgggtccaggcctgcgggcctgggtcttggtgctctgagtctgaggctgggccactctgctccaggtgacgctgatgtcagggtctctgagagtagggacttaccctggccactccctgttccttctacccagcgggctctcccctccccatttatgcttccagatcaggagggggcggaggaggggcgctgggtcctcccatccagactcggaggaagtggatgactcagacccagggcccccgtgtaacacatgcccccgccaccccgatgccctctgtgtgtggggctgccaggcaggccccgccgagggctgagcactggaggctcgcagctccacctgtcagctggtggatcccagcactggaacccaccaccttcccgctggtgggatctgctcctgcccctgtctcggtgccaggaggccttcaggcatagctgcacccaggtggcctggctgccccaggctacaagacccgtcgctcctgaaacctgtttccccaagagggacacggggtgaggaactcatgtccatgggccaccctccaagagacgggaaggtgcccacggggtggggacatgacgggtgacacccctcctacggactccgaatccacgggggtggggccagccctcctcgactcacttggttgggggctcacatgagacccctttgtcagatggggaaacagccttgagaggggacagcaccaagtgtcctcagccaggaaggggccctgctccccacctcccgtatgagacccaagtcctccaacgattcctcaatgtccacctctggggctgtccgtgcaggtcccctggtctgcaggtgccttcttatcatgggatctgagcttcatccgcagagggaagggcagacaggagtgcaggtgcaaccccaggagacccagcccagctccccatggactcacccccagccccagcccagctccccatggactcacccacagccccagcccagctccccatggactagtcccagccccagccccagctccccatggagtagtcccagccccagccccagctccccatggactcacccacagccccagtccagctccccatggactcacccccagccccagcccagctccccatggactcacccccagccccagcccagctccccatgaactagtcccagccccagcccagctccccatggactagtcccagccccagcccagctccccatggtctcacccccagccccagcccagctccccatggactagtcccagcccccggccccagctccccatggactcacccccagccccagcccagctccccttggtctcacccccggccccagctccctgtgctctccatcccattcagcgctgacactgtccctgcagctccgtccaccccacctcctgactcacctgggcctgttggtcactggggcctccagcccacctcctctgcttctgagccccaggaccccctgcctgccccccgacccccaacacagggccactccggggctcctcctgcccccaccctgcctgggaccagcctggtttgaggctgactctgcactgcggggccatatccatctggactccttccgggctgcaccccccgggggacaggcaggggtggcccagaccgctcctgctcatgaccctgcttctcctccattctctggacaaactccccagaggcctccacctgccccgtcctggttccatgaatgaggcccacaagatgggaccttcaggagcccaggaggtgaggggatggggtgacgggggacaccagggatgagggtgtggcagggacacgggagacaccagggctgacggtgaagaagagactcaggggacaccagggctgggagaacccagggacacacggggacaccggggctgtggtgtgcagagggctctgggacccccgagtcaggggctctggggccgctcctcctaggaatgctccgattgggtcaggcctgggaggcggaccaatcagcaccatggggatgcgagagccttgattggctaacactgggccaatcagggcgcgtcctgggcaccccgccccgatccccggccgctcccctggggctgctgcagggctggggtcccaggccattgacagacactgggcaagaggccacgtggggcagtgtccccgagagaagggtggggagtcgggtgagacgacagtggccgcgcccagactcagggcagcgatgggaaactcagccccaggagcttgctgggctggggagacgcacctggcgcgtgcagaggccccggcagccatgactcacgaggcggagaactgcacggagagctccgggcatccgcagggggttccccccggcgtcctcggccgagtgccggagatgcagagagacgtgggagccgcgtcggaaacgagaaccaccagatgagaggggcggagtccgggagtgcgcgcggggctggggatatcgcgtgttcccagcagctgagtggagaaaccttgtcagaggcaggcactggagagtcctcggaagggtatggaagggtacgaggggagaaagtaatcccgaaaccaaaggcttctccggacccaccctcacaaagctgaaaagcaaagcgcagacggatccaaatgattgcaagtgacttaactgcctgtgagaacacatctcaaaacgatgtcaaggaatagaacacaacccagcacgcaacaaaacactccagagagtactcacgagatccgggggctagtcaagaacgagcgggtggccgggcacggtggctcacgcctgtcatcccagcactttgggaggccgaggtggcagatcgtgaggtcaggagaacgagaccagcctggcccacatggtgaaaccccgtctctactaaaaatataaaaattagccgggcgtggtggcacgtgcctgtaatcccagctactcgggaggctgaggcaggagaatcgcttgaaccagggagtcagaggatgcagtgagccgagatcgtgccactgcactccagtctggtgacagagcaataccgtgtcttaaaaaaaaaaaaaaaagcaggcatgaaaaaggatgacctcccaataaaaaaaatcaatcatgttcgggcgtggtggttcacgcctgtaatcctagcactttgggaggccgaggcggctggatcacctgaggtcaggagttcaagaccagcctggccaacgtgatgaaaccccatctctactaaaaatacaaaaattagctgggcgcggtggctcacgcctgtaatcccagcacttcgggaggccaaggcgggtggatcacctgaggtcaggagttcgagacccccctggctaacacagtgaaaccctgtctctactaaaaatacaaaaaattagccgggcgtggtggcgggcacctgtagtcccagctactcgggaggctgaggcaggagaatggcgtgaacccgggaggcggagcttgcagtgatccgagatggcgccactgcactccagcctgggcaatgaaggagactccgtctcaaaaaaaaaaaaaaaaagaaatgtgaaaggaagttctgcaggaagaagatgataagagatgaacatctagacctagactaagggaagataagctctggaaatggaaacagctgtgactgtgtaagacagttttctctctcaaaaaatatttgaaagagaattggcagtttgaagcaacaacagcaaagcgagtgcaggtatcgtgtggtttatggaatacacaagggtgcggcgtgtgctacagtaacagaaggatccggggagactaaaagcaggctgttgcaagttgaaattgcacgtgaagttgtggtgttttggaattaatgcactttattttttagagcagttttaagtttacagacaactgggcagatagtacagatcgtatccccccacacacacatccccacacacagagtttcctgttatgaacattttgcattactgtgggtgcattgttacagctgatgaacaatattgatacattattactaacgaactcccacagtttacatgagggttcactctgtctgttgtacattctgtgggtcgtggcaagtgcacaagtcatgtgtccaccattaccgtattatgcggaatacatcccctgccctcaaaatctcgtgctccactgcctctccctctccccatcccctggaaaccacggatattttcattgtctctgaagttttgacttatccactatcaacgatacactattaactttttccgactagcttctttcactgagtagtaggcagttatggcccctgtatgtcttttcaaggcttgatagctccttgcttttatttatttatttatttatttatttatttatttatttattttgagacggagtctcgctctgtctcctaggctggagtgcagtggtgtgatctcggctcactgcaagctgcgcctcccgggttcacgccattctcctgcctcagcctccgagtagctgggactacaggcacctgccaccatgcccagctgtttttttttttttttttttttagagatgggttttcactgtgttagccaggatggtctcaatctcctgaccacatggtccgcccgcctcagcctcccaaagtgctgggattaccggcatgagacaccgcacccggccagctcattgctttttgtctctgaatgatattccattgtctggatgtaccacagttgttctacccattcgccttttgaaggacactttggttccttcaactttttggcaattatgggtaaagatgctatcaacatcatgtgcaggtttttgtgtgggcataagttttcaactccttgggtaagtaaatacctagaagcacaattgctagatcatatagtaagagtatgtttagctttgtaagaaactgccaaactgtcttccaaagtggctgcgccattctgccttctcatcagcagtggatgagagttcccgttgctccacctccttgtcagcacttggtattgtctgtcttggggactttagtcatcctaacgggtgtgtagtggtatctcattgttattttaatttaattaataacgtttgatgctgagcatcttttcaggtgcttatttgacatctctgtatcttctttggtgaagtgtctgttcagatcttttgcccactttttttttctttttaattctttcaatctctttgttagatttatctgatgcccactttttaattgtgttgcttgttttctttttcctttttcttttttttttttttttgagacggagtctcactccgtcaccaggctggagagcagtggcgtgagcttggctcaccacaacctccgactccctggttcaggtgattctcttgcctcagcctcccaagtagctgggataacaggcgtgtgtcaccacacccagctaatttttatatttttagtagagacggggtttcaccatgtgggccaggatggtctcgatctcctgacctcgtgatcctcccaccctggcctcccacagtgctgggacgacaggtgtgagccaccacacccggccaggttgcttgtgctgggatgacaggtgtgactccctgcccggccgggttgcttgttctctttaatgttgactttaagggttcttggtatattttggataatcatcctttatcagatatgagttttgcagagatattctcccagtctgtggcttgtcttttcattctcttaacaatgtctcttgtaaagcagagttttaaaaaaaattttttttgagatggggtcttgctctgttgcccaggctggaatgcaggggtgcaatcctagctcgctgaagcttcaacctcccaggctcaagcgatcctcccacctcagcctcccgagtagccaccggtctgtccggtttgggggcagtgctttgtcccgtgagctcggttctcagaaggctgttcagctgcgtttcagttggcccagcgtttccgatgtggttgtgaggttggcttccagtcccttcgtatgtccgagtgggaactgaatgtatagatatatttttttattgagagcaaattaaataaacagaatgcacagacctgaaatgtccagtccaatgaattgtgatgattgccaaacctgtgtaaccatggcccaaagcaagacgtatcaccctagggtgtctactccccgccccttcaggcaggtgaccgagaggtgaggaaacctctagggtgatgaaaatggcccgtgctcctgtctctccacctacgtagggctttgaaatctcctcccagcaatgtttgtactttttggtgtagagatcttgcatgccttcccttaaatgtattcctggtgtttgatttttttattctgtagcaaagggtatggatgttcgcgtttatcgtccaatattcatggctggcgtttagaaacacagtaatccttttgcatattggttttgtatgtcacagccctgctaagtccattactccagggtccattattcctggattttctacgcagcgatcaccgacttttctctccctccggagcgctgcacttccccgcgtctccagcagagggggcccctgaccatgcaaagcggagcccgggcgcggccgaggcaggcgctgggaggaaggcggggcgtttgcgggagggcggggcgggggcggggagggggcagggcaggtgcggggaggggcgaggaaggggcggagaggagtcagctgccccgcccagcccacctgcccgctgggtcgggtctcagagccctggagcttccagggctgggataggccttgcgtgtgaccgtagcaggtcacggcgccctctctgcctcagtttccccacggggagaagaggctgcactggggtgcgagccggggctgtgcaggcctggagcggggtctgcctccaggcctaggctgtggccatcgccctccacccctctgggaggagggagctggaggggctcatgcaggtcaggggccaagggtcagaggtcgggggaggaagagccactgcggctggcccagaggtcacttagccaccagatgcaggagacagccaagaggaggacgagttggaggaggaggaagaagtcccccgggagggggcctggggagccgcctgagcccccgatgctgggatgcggcggtggggccggctcacccaggcagagaggagggtgtagacccctggccagcgcccgcagctgtagctcttgacccagctcatgacgccaacctgccctcaggaaccatgcgcctggcagaccagaggccctcccgagtcaccctgagggcagagaaggcaaggactaggaggtggggggtcccgtttctgggctccggcacccccacgctccgtggccagcctggctcatcaggttgctctcgtcggggaaccgcagagtgaagccgcagggagaacccacttcacacccaccgaaacggccagaagctttttaaacagtcaagctctgctcacatctccaccccaccccttccctttccctccaatagattctgtcctaaagcctagcatggggcaggtcccagggtggacctggggcgccacagccacactggcccagagtggggggcacacgggggattgatgagatcagtgaattgggggtggaaccagctccccgctgctggagaaggcagcccgatgggagaagagaaacgcagagtaagccctgtggggtggaatcacagctgaggcactgtgagagctcatggttttcattatagatatggccgtgtagatgtgcacgtgggagtgtgtgtgtgtcagtgtgtgagtgtgcctgtgtgagtgtgcatgtgtgtgtgtgaatgtgtgcatgtgttcgtgtgtgcatgtgaacatccgtgtgtgcatatgtgcatgtgagtgcacagatgtgcgtgtgtgtgcatgtgtgtgtgcatgtgtgtgtgtgaatgtgtgcatgtgtacatccgtgtgtgcatatgtgcatgtgagtgcacagatgtgcgtgtgtgtgcatgtgtgtgtgcatcaggtatatgcatgtgtgcatatgtgtgcgtgtgtgcacacacatgtgtacatgtgtgagtgtgcatgtgtgtccgtgtgtgcatgtgaacattcgtgtgtgtgcatgtgcatgtatatgtgagtgtgtgtgcatgtgagtgcattgtgagtgtgcatggatcaagtgtgtacaggtgtgtgcatgtgtgagtgtgcatctgtgtgcacgtgtgagtgcatggatcaagtgtgtgcatgcatgtgcatgtgtgtgagtgcacggatcaagtgtgtgcatgcgtgtgctctgtcccctgaggagggctgtgagcagtaacacccaagagcgatgggcaatcccttcacctagatcgtggtctctaaataccgtttgctatcgataggagctgggcctcctggaggactgcctggcgcagaggcggatatgagaggagcccagaagaatcttgtaggaggaaaagttcagagacggagacatgtcagatgacacagaagccagctcgcaggagctcccagtgtccgcatcagagcgagtttgcacattataaaatgattgggaaaaagaaagaaattaaaataactgaataaaacaggggaccatgagtctatacagttataaataagcaaatgaatacatagtctgatgagaacttggctagttacagggtgtcaaggaatctccccacaaaacacgcagtcatcactaaggggaaggagtggcttcccggggagaagccgggcagatgccccttgctcaagagatgagagtggatgtcccagcaactggagaagtcggtcgtgcacgcccttgacaggaggcggacctcagagccgggcctgtgatgctcctgccaaacgggtatcccctcaatctaatcgtgaaaaaatatcagcccggcttgaggagcgctccacaaaacgatggcccgaaatcttcaagggtctcagggtcagaggagctgaggaaagaccgaggacccgttccagagcccagcgtgcctcctgatcctaggcaggacattttccatccaaggacatttttgggagagctgatggacttggatttggcgattgagaattacatgtcagtaggatgcccacagctacttcagggctgactggctatacggcagagctacgggataaccccctctcccttccttccttccttccttccttccttccttccttccttccttccttcctttctctttctctccttccttccttccttctttctttccctccctccttccttctttccttccttccttcctttttttttttttgacagggtcttactcactgcagccttggctgtgagtcaagggctcactgtagccttggccccctgggctcaagcaatcctctcgcccaagaggttgaagctgcagtgagccgagattgcgccactgcactccagcctgggtgacagagtgagaccctgtctcttagaaaaataaaaataaaatcttactggattatggctgggcacagtggccgatgcctgtaatctcagcactttgggaggctgaggcgggtgggtcacctgaggtcaggagttcaagaccagcctggccaacgtggtgagaccgcatctctataaaaaatacaaaaattagctgggtgtgttggctcatgcctctactcccagctacttgggggactgaggcagggggattgcttgagtccagaaggtggaggttgcagtgagccgagatcactccactgccctctagcctgggcaacagagtgagaccctgtctctaaacaaataaataaaatgttactggattataaccaaagtataagataaatatccatgagccggccggcgtcacacctgtaatcccagcactttgtaggctgaggcaggcggatcatttgaggtcaggagttcgagaccaacctggccaacagggtgaaaccctatctctattaaaaatacaaaaattagccgggcatggtcgcaggcacctgtaatcccagttactcaggaagctgagacaggagaatcgcttgaacccgggaggcagaggttgcagtgagctgagatggtgccactgtactccagcctcaacaatgtgagactctgtctcaaaaaataaataaaataagatagagaaaaaaatccatgagtcaatgctgatataaataaatagttgaataagtaaataagtggggagaagagacaaatctccacgcagaattcaaaataatgtcacagccctcccctctcatggaggcagggcacagtggaacccccaacccccacctggctgttcaggggaacttccttccaaacactgaagcactgaggccagcagggaggggctgcacggtgaggaaccagctacgcctgaggcaggggtaaatcaggttgatggctggcgaccccacctccacgggcactgtggtactgaggctggcagggaggggctgcacggtgaggaaccagctacgcctgagctgggggtaaatcaggttgacggctcgcgacgccatgcaaccccacgcgaccccaccacacgggcgggaaggcactttacctccgtgcccttccttttaaaacccacggcctcaggccaagcatgagaacaacgtcagacaaatccccattgattggcactctacaaaatcgctgaccaaccctcctcaacatggtcaaaagcaagggaagccagagaaacggtcacagccaagaggagccggaggagacaggaggatccggggtgaggtcctgggacaggaacgggaggttaaggagagtaaggaaacccaagtaagctccgggcttcagttaatgtaacgaatcctgctggttcgtccgttatggccaatgagcctttcctgaggaagaatgggaagcgggcccggggcatgcgggtagctctgttatactatcttcgaaacttttccataaatctaaacctgtcctaaaataataagtgtattttaaataaaaagacacagaaatacttccaggcccagcagccctttggagacagctcaggccctcgtgacaaccaccctttgagaagtccctgtccccacatccggcagcaggtcctgtggtcgcgcggcagatcagatgggcaccgcttcacggcccagcctgggttggcccttcctaaccgtcctggctgccccagcctgatgactcagctgattaggggccctgggcagcgcccaggactttcctgccgccctccccagatccaaatcacaggccaggctggagggtccggctgagaccctctaggtcagggatccctctttgatgtggggaaactgaggcactggtgggggggagttgcctgaccacccaccaggatgtggcctcccgggcacagacgtggctgtctgcacgccagcacgtggggtagccaaggctcagaactggaggttcagtgtttttcctggtgaccaataaggacaacaccagcatgcggggccagcagtgcacccacggccggacaccctcctccctcacggcagccgcacacctggagggggcgcctcaggggaggcaggacagtcccaccccacataagggagcgaggtctgagtcacaagtctccggcccagggtgcccctcacagggcgatgtcaccagtggggagggagcctgaggggcagggtcttcatggaaccaggtcctctagtcctgacctctagggctgtccccaggtccccacaggcggggacttcagggccctcacctgtcccaactcaattcacctgcagcactggggaccccgtctttctgcctgtgccccagcacgccactccccgcagagtgctccacacgacccagattgcaggcctgctggggaggaagaagctccaggcaccatcccctgagccccagcagtcctgtgacatggtgccgttcccccccaccattggacaggagagccaactgaggaaccgggaggggggcctggccctggtgattgcccccagcttggtggggtctcctgttgtccaggaccctgggagacctgggattgcttctgtccacggtggcctggccacctgggcactgtcctctcggtgggaaccctgtcgccaccactcgccctccccctcacacccccctgtgacggggaaccagggcctcctgccggcagccacgtgggtgaccttggatcaggtgtccccgtcccagtcaaaacgcaggtggctgcagccctggccagcagcctgcctgtcacgtcctgagagacccttcctgctgaagctgacgctcacatctgccagtgtcactgcgctgagcttcactgagcttcccagggatcttagatctaatttgggaagctctggggctggagcccgccctccccctccacccagtgaccggcccctgctgtccacctttccttacaccggcagccctgtcctgaggggccgtcttgcttcccttcggggtctcatccctccgactcccaccccgcaaaacctccagtgggcgtgtggaagtgcttctaggggctcagtgttccctgggggtcaccccgtgctgtctctgtgatccctagaaggtgggatgggccagagggaggaaggagggcccgagttccaggtccatcttcatagacaagacgctgggcctgcagaacaggagccgagggatgggccttcaggggctgcagaggcagaggtcacgtggggctggagagggcgctgggagtcgagtccaccccttgtgaggacagaggtcatttgcagagattggagagactaaatgcacatctctgcatctgacagttggaaggaaagagtgaatgtttctttagagagttgttttcaaccagaacagccccgcatttcattcctgggtgtaatcatgttcaaataaaaaatgcaaacaagagcccgggataaaatgcaacactcgccagacgcagagggctcacctattgatgtagagaaagacctcaaaatgaatttgaaaatgtcaaactcaggccgggtgcggtggctcacgcctgtcatcccagcactttgggaggccgaggcgggcggatcacttgaggtcaggagttcgagaccagactggccaacatggcgaaaccccatctctactgaaaatacaaaaattaactgggcgtggtggctcacgcctgtggcccagctatatgggaggccaagatgggaggatcgcttgagcccaggagttaaggctgcagtgagccctgatcacaccactgcacttcagcctggatgacacagcgagatcccgtctcaaagcaaacaactaggcaaagcacaagcagtggacagaggggccgggagaagagctcgtgggaagcgtggggtaggggctcatgatgggcagccctggggctcccggcgaccattctctgtcttgacccggttgcagggacctggctgtcctttataatcaactgagttgcccgagtggctctgtgtgacccgaatgctggatgcatcgtgtggggagaagccagcctcggggaccagggctgcccaggaggccccgtcccacggtgactggctgtgccttgagggctaggacctcacactgtggcaggtgtcctcagcacacctggaccccttctctcccagtgacatccacaaccagaaacacagcgatgcacaccagtgatttccatgcactttaatgaggtccagcactcaggaggattagcgcccaccaccagctatctgggcaggggagggctggagggcccggtgcaggcgtcaggcttaggacagggaagggggctcaggatagggaagggtcctcaggacaggggaaggggctcagaagagagcagggggcttaggacaggaaggggcactcaggacggggcagggaaggtgtggggggcagtcgccacctgggtaggaagcagtggtgttttggacagcaggggttggtcctccagtgacccaggtggccaacccaggcctgactcacggctttttggggacatagtggtggatccagtccaagtagtaggtgacacgggtgtagatgccaggccggttgggctgggcacagccctcgccccagctgaccacgcccgcctgcagccaggtgccattcaccttgcacaccaggggccctccggagtcgccctgggaaggtcagaggtcagcgctcgccgaacaggcctgggagtgggggttggggggcggggggcgggggacaggcggggcccacctggcatgagtccctccgggtgttcccggcacacagcatgtcgtcacggacgatgcggacgtcgtctcccgtgtaggcgccaaggtggtattttgcgtcacaaatgtggttttccattatggggaccttcacctgcttcagaggaaatggcggtgggaggcgctctgcaggtggggaagagggtgcagcctcaggagggggccgggcaacccccacctggagcccagagggagcccaggggctgggctgtggctaagaccctggccccacctccactgtccccagacccaccatcattgtccacatcgccccagccagtgacccagcacggcatccccggggggaaggtctctgaggcagggggcagggtgaccgtgtggacgtggctggagacgttcaccggctcctccagctccagcagggcgatgtccgctccgatctgggcggtgtagaactgtgggtgcacgatgatcctgctgaccggcagcagctggtcctggtagtagaggtgctgctcccgcagttgcaccctgagggcggccagatccttgacgtccctgggcagcggaggatcccactcagggccctgggcagcccccaggagcacccgggagccagggctcacatccagcccttccccacccctccaggccccgggagactcacggtcccacgcagtgcgctgcggtcagcacccactgggggtggatgagggagcccccgcagaagtgcatccagtatgggccgtggactctcaggctcacctgccagggccacttgctcctgggggcctcctgacccccgacgatgcccactcgctgcagggcctggcctggggctggggcaggtgccaggtcaggaccaggaagcagccccaggcctgggcccagcccttccctgtgtgggggccagcccgacctccccagaacccacccaggccctgacctgtggaatgtggtgaggggcagggtggaccccggctgggactcaccaggggccgcgtaggcgcggctcgccaggacgggcagcgccagcagcagcagattcagcatctggggagcaaggaggagcatcgtgggcctggccgggcctcacagggcagggctgggggctacagattgtggggtgaagaatggagctgggacggggggaccggggtgggtccaggcctgcgggcctgggtcttggtgctctgagtctgaggctgggccactctgctccaggtgacgctgatgtcagggtctctgagagtggggacttaccctggccgctccctgttccttctacccagtgggctctcccctccccatttatccttccagatcaggagggggcggaggaggggcgctgggtcctcccatccagactcggaggaagtggatgactcagacccagggcccccgtgtaacacgtgcccccgccaccccgatgccctctgtgtgtggggctgccaggcaggccccgctgagggctgagcactggagactggcagctccacctgtcagctggtggatcccagcactggaacccaccaccttcccgctggtgggatctgctcctgcccctgtctcggtgccaggaggccttcaggcattgctgcacccaggtggcctggctgccccaggctacaagacccgtcgctcctgaaacctgtttccccaagagggacacgggtgaggaactcatgtccatgggccacgctccaagagacgggaaggtgcccacggggtggggacatgacgggtgacacccctcctacggactccgaatccacgggggtggggccagccctcctcgactcacttggttgggggctcacgtgagacccctttgtcagatggggaaacagccttgagaggggacagcaccaagtgtcctcagccaggaaggggccctgctccccacccgccgtatgagacccaagtcctcctacgagtcctcaatgtccacctctggggctgtccgtgcaggtcccctggtctgcaggtgcctccttatcatgggatctgagcttcatacgcagagggaagagcagagaggagtgcaggtgcaaccccaggaggcccagcccagctccccatggactcacccccaacttcagccccagctccccatggactagtcccagccccagccccagctccccatggtctcatccccggccccagctccctgtgctctccatcccattcagcgctgacactgtccctgcaggtccgtccaccccacctcccgactcccctgggcctgttggtcactggggcctccagcccacctcctccgcttctgagccccaggaccccctgcctgccccccgacccccaacacagggccactccggggctcctcctgcccccaccctgcctgggaccagcctggtttggggctgactctgcactgcggggccatatccatctggactccttccgggctgcaccccccgggggacaggcaggggtggcccagaccgctcctgctcatgaccctgcttctcctccattctctggacaaactccccagaggcctccacctgccccgtcctggttccatgaatgaggcccacaagatgggaccttcaggagcccaggaggtgaggggatggggtgacgggggacaccagggatgagggtgtggcagggacacgggagacaccagggctgacggtgaagaagagactcaggggacaccagggctgggagaacccagggacacacggggacaccggggctgtggtgtgcagagggctctgggacccccgagtcaggggctctggggccgctcctcctaggaatgctccgattgggtcaggcctgggaggcggaccaatcagcaccatggggatgcgagagctttgattggctaacactgggccaatcagggcgcgtcctgggcaccccgccccgatccccggccgctcccctggggctgctgcagggctggggtcccaggggaggtggatggacctgtgcggccctgccccggcgcctctcaggaagccccgcatcctatctctgccgtcccgcagcaaaaagctgaactcccgtcacgtacaaccagcaacgaacaaaaacgataacaaacccataattcacagtggaaaggactctgcgctcaggaaggttccatccagttcagaatgaagacgcagaataaagattccttgagaccctgtaactagccaagttctcatcagactatgtattcatttgcttatttataactgaatagactcatggtcccctgttttattcaattattttaatttctttctttttcccaatcatttttctaatatgcaaactcatcctgatgcggacactgggagctcctgcgagctggcttctgtgtcgtctgacatgtctccatctttgaacttttcctcctacaagattcttctgggctcctctcatatccgcctctgcgccaggcagtcctccaggaggcccagctcctgtcggtggcaaacggtatttagagaccacgatgtaggtgaagggattgcccatcgctcttgggtgttactgctcacagccctcctcaggggacagagcacacgcatgcacaaacttgatccatgcactcacacacatgcacatgcgtgcacgcacttgatccatgcactcacacgtgcacacagatgcacactcacacatgcacacacctgcacacacttgatccatgcacactcacaatgcactcacatgcacgcacatgtgtgcacactcatgcacatatgcacacacacgaatgttcacatgcacacacgcacacatatgcacacacatgcatgtacctgatgcacacacacatgcactcacacatgcacatctgtgcactcacatgcacatatgcacacacgaatgttcatatgcaaacacgaacacacatgcacacacattcacactcacccatgcacacacataacacatgcacactcacacacaggcacactcacacactgacacacacacactcccacgtgcacatctacacggccatatctataatgaaaaccatgagctctcacagtgcctcagctgtgattccaccccacagggcttactctgcgtttctcctctcccatcgggctgccttctccagcagcggggagctggttccacccccaattcactgatctcatcaatcccccgtgtgccccccactctgggccagtgtggctgtggcgccccaggtccaccctgggacctgccccatgctaggctttaggacagaatctattggagggaaagggaaggggtggggtggagatgtgagcagagcttgactgtttaaaaagcttctggccgtttcggtgggtgtgaagtgggttctccctgcggcttcactctgcggttccccgacgagagcaacctgatgagccaggctggccacggagcgtgggggtgccggagcccagaaacgggaccccccacctcctagtccttgccttctctgccctcagggtgactcgggagggcctctggtctgccaggcgcatggttcctgagggcaggttggcgtcatgagctgggtcaagagctacagctgcgggcgctggccaggggtctacaccctcctctctgcctgggtgagccggccccaccgccgcatcccagcatcgggggctcaggcggctccccaggccccctcccaggggacttcttcctcctcctccaactcgtcctcctcttggctgtctcctgcatctggtggctaagtgacctctgggccagccgcagtggctcttcctcccccgacctctgacccttggcccctgacctgcatgagcccctccagctccctcctcccagaggagtggagggcgatggccacagcctaggcctggaggcagaccccgctccaggcctgcacagccccggctcgcaccccagtgcagcctcttctccccgtggggaaactgaggcagagagggcgccgtgacctgctacggtcacacgcaaggcctatcccagccctggaagctccagggctctgagacccgacccagcgggcaggtgggctgggcggggcagctgactcctctccgccccttcctcgcccctccccgcacctgccctgccccctccccgcccccgccccgccctcccgcaaacgccccgccttcctcccagcgcctgcctcggccgcgcccgggctccgctttgcatggtcaggggccccctctgctggagacgcggggaagtgcagcgctccggagggagagaaaagtcggtgatcgctgcgtagaaaatccaggaataatggaccctggagtaatggacttagcagggctgtgacatacaaaaccaatatgcaaaaggattactgtgtttctaaacgccagccatgaatattggacgataaacgcgaacatccataccctttgctacagaataaaaaaatcaaacaccaggaatacatttaagggaaggcatgcaagatctctacaccaaaaagtacaaacattgctgggaggagatttcaaagccctacgtaggtggagagacaggagcacgggccattttcatcaccctagaggtttcctcacctctcggtcacctgcctgaaggggcggggagtagacaccctagggtgatacgtcttgctttgggccatggttacacaggtttggcaatcatcacaattcattggactggacatttcaggtctgtgcattctgtttatttaatttgctctcaataaaaaaatatatctatacattcagttcccactcggacatacgaagggactggaagccaacctcacaaccacatcggaaacgctgggccaactgaaacgcagctgaacagccttctgagaaccgagctcacgggacaaagcactgcccccaaaccggacagaccggtggctactcgggaggctgaggtgggaggatcgcttgagcctgggaggttgaagcttcagcgagctaggattgcacccctgcattccagcctgagcaacagagcaagaccccatctcaaaaaaaaattttttttaaactctgctttacaagagacattgttaagagaatgaaaagacaagccacagactgggagaatatctctgcaaaactcatatctgataaaggatgattatccaaaatataccaagaacccttaaagtcaacattaaagagaacaagcaacccggccgggcagggagtcacacctgtcatcccagcacaagcaacctggccgggtgtggtggctcacacctgtcatcccagcactgtgggaggccagggtgggaggatcacgaggtcaggagatcgagaccatcctggcccacatggtgaaaccccgtctctactaaaaatataaaaattagctgggtgtggtgacacacgcctgttatcccagctacttgggaggctgaggcaagagaatcacctgaaccagggagtcggaggttgtggtgagccaagctcacgccactgctctccagcctggtgacggagtgagactccgtctcaaaaaaaaaaaaaaaagaaaaaggaaaaagaaaacaagcaacacaattaaaaagtgggcatcagataaatctaacaaagagattgaaagaattaaaaagaaaaaaaaaagtaggcaaaagatctgaacagacacttcaccaaagaagatatagagatgtcaaataagcacctgaaaagatgctcagcatcaaacgttattaattaaattaaaataacaatgagataccactacacacccgttaggatgactaaagtccccaagacagacaataccaagtgctgacaaggaggtggagcaacgggaactctcatccactgctgatgagaaggcagaatggcgcagccactttggaagacagtttggcagtttcttacaaagctaaacatactcttactatatgatctagcaattgtgcttctaggtatttacttacccaaggagttgaaaacttatgcccacacaaaaacctgcacatgatgttgatagcatctttacccataattgccaaaaagttgaaggaaccaaagtgtccttcaaaaggcgaatgggtagaacaactgtggtacatccagacaatggaatatcattcagagacaaaaagcaatgagctggccgggtgcggtgtctcatgcctgtaatcccagcactttgggaggctgaggcgggcggaccatgtggtcaggagattgagaccatcctggctaacacagtgaaaacccatctctaaaaaaaaaaaaaaaaaacaacagctgggcatggtggcaggtgcctgtagtcccagctactcggaggctgaggcaggagaatggcgtgaacccgggaggcgcagcttgcagtgagccgagatcacaccactgcactccagcctaggagacagagcgagactctgtctcaaaataaataaataaataaataaataaataaataaataaataaataaaagcaaggagctatcaagccttgaaaagacatacaggggccataactgcctactactcagtgaaagaagctagtcggaaaaagttaatagtgtatcgttgatagtggataagtcaaaacttcagagacaatgaaaatatccgtggtttccaggggatggggagagggagaggcagtggagcacgagattttgagggcaggggatgtattccgcataatacggtaatggtggacacatgacttgtgcacttgccacgacccacagaatgtacaacagacagagtgaaccctcatgtaaactgtgggagttcgttagtaataatgtatcaatattgttcatcagctgtaacaatgcacccacagtaatgcaaaatgttcataacaggaaactctgtgtgtggggatgtgtgtgtggggggatacgatctgtactatctgcccagttgtctgtaaacttaaaactgctctaaaaaataaagtgcattaattccaaaacaccacaacttcacgtgcaatttcaacttgcaacagcctgcttttagtctccccggatccttctgttactgtagcacacgccgcacccttgtgtattccataaaccacacgatacctgcactcgctttgctgttgttgcttcaaactgccaattctctttcaaatattttttgagagagaaaactgtcttacacagtcacagctgtttccatttccagagtttatcttcccttagtctaggtctagatgttcatctcttatcatcttcttcctgcagaacttcctttcacatttcttttttttttttttttttttttttttgagacggagtctccttcattgcccaggctggagtgcagtggcgccatctcggatcacggcaagctccgcctcccgggttcacgccattctcctgcctcagcctcccgagtagctgggactacaggtgcccgccaccacgcccggctaattttttgtatttttagtagagacagggtttcactgtgttagccaggggggtctcgaactcctgacctcaggtgatccacccgccttggcctcccgaagtgctaggattacaggcgtgagccaccgcgcccagctaatttttgtatttttagtagagatggggtttcatcacgttggccaggctggtcttgaactcctgacctcaggtgacccagccgcctcggcctcccaaagtgctaggattacaggcgtgaaccaccacgcccgaacatgattgattttttttatcgggaggtcatcctttttcatgcctgctttttttttttttttttttttttttttttttttagacacggtattgctttgttgccagactggagtgcagtggcacgatctcggctcactgcatcctctgactccctggttcaagcgattctcctgcctcagcctcccgagtagctgggattacaggcacgtgccaccacgcccggctaatttttatatttttagtagagacggggtttcaccatgtgggccaggctggtctcgttctcctgacctcacgatctgccacctcggcctcccaaagtgctgggatgacaggcgtgagccaccgcgcccggccacccgctcgttcttgactagcccccggatctcgtgagtactctctggagtgttttgttgcgtgctgggttgtgttctattccttgacatcgttttgagatgtgttctcacaggcagttaagtcacttgcaatcatttggatccgtctgggctttgcttttcagctttgtgagggtgggtccggagaagcctttggtttcgggattactttctcccctcgtacccttccatacccttccgaggactctccagtgcctgcctctgacaaggtttctccactcagctgctgggaacacgcgatatccccagccccgcgcgcactcccggactccgcccctctcatctggtggttctcgtttccgacgcggctcccacgtctctctgcatctccggcactcggccgaggacgccggggggaaccccctgcggatgcccggagctctccgtgcagttctccgcctcgtgagtcatggctgccggggcctctgcacgcgccaggtgcgtctccccagcccagcaagctcctggggctgagtttcccatcgctgccctgagtctgggcgcggccactgtcgtctcacccgactccccacccttctctcggggacactgccccacgtggcctcttgcccagtgtctgtcaatggcctgggaccccagccctgcagcagccccaggggagcggccggggatcggggcggggtgcccaggacgcgccctgattggcccagtgttagccaatcaaggctctcgcatccccatggtgctgattggtccgcctcccaggcctgacccaatcggagcattcctaggaggagcggccccagagcccctgactcgggggtcccagagccctctgcacaccacagccccggtgtccccgtgtgtccctgggttctcccagccctggtgtcccctgagtctcttcttcaccgtcagccctggtgtctcccgtgtccctgccacaccctcatccctggtgtcccccgtcaccccatcccctcacctcctgggctcctgaaggtcccatcttgtgggcctcattcatggaaccaggacggggcaggtggaggcctctggggagtttgtccagagaatggaggagaagcagggtcatgagcaggagcggtctgggccacccctgcctgtcccccggggggtgcagcccggaaggagtccagatgcatatggccccgcagtgcagagtcagccccaaaccaggctggtcccaggcagggtgggggcaggaggagccctggagtggccctgtgttgggggtcggggggcaggcagggggtcctggggctcagaagcggaggaggtgggctggaggccccagtgaccaacaggcccaggggagtcaggaggtggggtggacggacctgcagggacagtgtcagcgctgaatgggatggagagcacagggagctggggccgggggcaagtccacagggagctggggccgggggtgagaccatggggagctgggctggggctgggggtgagaccatggggagctggggccgggggctgggactagtccatggggagctgggctggggctgggggtgagtccatggggagctgggctggggctgggggtgagaccatggggagctgggctggggctgggggtgagaccatggggagctggggccgggggatgggactagtccatggggagctgggctggggctgggggtgagaccatggggagctgggctggggctgggactagtccatggggagctgggtctggagctgggggtgagaccatggggagctggggccgggggctgcgactagtccatggggagctgggctggggctgggggtgagtccatggggagctgggctggggctgggggtgagtccatggggagctggggctggggctgggactagtccatgggcagctgggctggggctgggggtgagtccatggggagctgggctggggctgggggtgagtccatggggagctgggctggggttgggggtgagtccatggggagctgggctgggtctcctggggttgcacctgcactcctgtctgcccttccctctgccgatgaagctcagatcccatgataaggaggcacctgcagaccaggggtcctgcacggacagccccagaggtggacattgaggactcgtaggaggacttgggtctcatacggcgggtggggagcagggccccttcctggctgaggacacttggtgctgtcccctctcaaggctgtttccccatctgacaaaggggtctcatgtgagcctcccaccaagtgagtcgaggagggctggcgccacccccgtggattcggagtccgtaagaggggtgtcacccgtcatgtccccaccccgtgggcaccttcccgtctcttggagggtggcccatggacatgagttcctcaccccgtgtccctcttggggaaacaggtttcaggagcgatgggtcttgtagcctgggacagccaggccacctgggtgcagcaatgcctgaaggcctcctggcaccgagacaggggcaggagcagatcccaccagcgggaaggtggtgggttctagtgctgggatccaccagctgacaggtggagctgccagtctccagtgctcagccctcagcggggcctgcctggcagccccacacacagagggcatcggggtggcgggggcacgtgttacacgggggccctgggtctgagtcatccacttcctccgagtctggatgggaggacccagcgcccctcctccgccccctcctgatctggaagcataaatggggaggggagagcccactgggtagaaggaacagggagcggccagggtaagtccccactctcagagaccctgacatcagcgtcacctggagcagagtggcccagcctcagactcagagcaccaagacccaggcctgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggtcgggctggcccccacacagggaagggctgggcccaggcctggggctgcttcctggtcctgacctggcacctgccccagccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccgtgagtctcccggggcctggaagggtggggaagggctggatgtgagccctggctcccgggtgctcctgggggctgcccagggccctgagtgggatcctccgctgcccagggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttcccccccggggatgccgtgctgggtcactggctggggcgatgtggacaatgatggtgggtctggggacagtggaggtggggccagggtcttagccacagcccagcccctgggctccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcctgtcccccgccccccgccccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgttcaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgtgaggtcctagccctcaaggcacagccagtcaccgtgggacggggcctcctgggcagccctggtccccgaggctggcttctccccacacgatgcatccagcattcgggtcacacagagccactcgggcaactcagttgattataaaggacagccaggtccctgcaaccgggtcaagacagagaatggtcaccgggagccccagggctgcccatcacgagcccctaccccacgcttcccacgagctcttctcccggcccctccgtccactgcttgtgctttgcctagttgtttgctttgagacgggatctcgctgtgtcatccaggctgaagtgcagtggtgtgatcagggctcactgcagccttaactcctgggctcaagcgatcctcccatcttggcctcccatatagctgggccacaggagtgagccaccacgcccagttaatttttgtattttcagtagagatggggtttcgccatgttggccagtctggtctcgaactcctgacctcaagtgatccgcccgcctcggcctcccaaagtgctgggatgacaggcgtgagccaccgcacccggcctgagtttgacattttcaaattcattttgaggtctttctctacatcaataggtgagccctctgcgtctggcgagtgttgcattttatcccgggctcttgtttgcattttatatttgaacatgattacactcaggaatgaaatgcggggctgttctggttgaaaacaactctctaaagaaacattcactctttccttccaactgttagatgcagagatgtgcatttagtctcccgaatctctgcaaatgacctctgtcctcacaaggggtggactcaactcccagtgccctctccagccccacgtgacctctgcctctgcagcccctgaaggcccatccctcggctcctgttctgcaggcccagcgtcttgttaatgaagatggacctggaactcgggcccttcttcctccctctggcccatcccaccttctagggatcacagagacagcacggggtgacccccagggaacactgagcccctagaagcacttccacacgcccactggaggttttgcggggtgggagtcggagggatgagaccccgaagggaagcaagacggcccctcaggacagggctgccggtgtaaggaaaggtggacagcaggggccggtcactgggtggagggggagggcgggctccagccccagagcttcccaaattagatctaagatccctgggaagctcagtgaagctcagcccagtgacactggcagatgtgagcgtcagcttcagcaggaagggtctctcaggacgtggcaggcaggctgctggccagggctgcagccacctgcgttttgactgggacgggggcacctgctccaaggtcacccacgtggctgccggcaggaggccctggttccccgtcacaggggggtgtgaggcggagggcgagtgggggggacagggttcccaccgaggggacggcacccaggtggccaggccaccgcagacagaagcaatcccaggtctcccagggtcctggacaacaggagaccccaccaagctgggggcaatcaccagggccaggcccccctcccggttcctcagttggctctcctgtccaatggtgggggtgaacggcaccatgtcacaggactgctggggctcaggggatggtgcctgaagcttcttcctccccagcaggcctgcaatctgggtcgtgtggagcactctgcggggagtggcgtgctggggcacaggcagaaagacggggtccccagtgctgcaggtgaattgagttgggacaggtgagggccctgaagtccccacctgtggggacctggggacagccctagaggtcaggactagaggacctggttccatgaagaccctgcccctcaggctccctccccactgggtgacatcgccctgttaggggcaccctgggccggggactcgtggctcagaccccgctcccttgtgtggggtgggactgtcctgcctcccctgaggcgccccctccaggtgtgcggctgccgtgagggaggagggtgcccggccgtgggtgcactgctggccccgcatgctggtgttgtccttattggtcaccaggaaaaacactgaacctccagttctgagccttggctaccccacgtgctggcgtgcaggcggccacgtctgtgcctgggaggccacatcctggtgggtggtcaggcaactccccccaacccgtggctgagtttccccacatcaaagaggggatccctgacctagaaggtctcagctggaccctccagcctggcctgtgatttggatctggggagggcggcaggaaagtcccgggcgctgcccagggcccctaatcagctgagtcatcaggctggggcagccaggacggttaggaagggccaacccaggctgggccgtgaagtggtgcccatctgatctgccgcacgagcacaggacctgctgccggacgtggggacagggacttctcaaagagtggttgtcacgagggcctgagctgtctccaaagggctgctgggccttgagttgggaccctcctgaagaacccccaggactgggctcccagaggatgaaggagagggggtggcgtgccccgagggaaccagggagtaatttttggagggggcggcactcagaggaacactcacccctccctcagccctggccccggagcagagacaaggtgagaagtacttttgccttctgtccttccccgctttcccttgacggagccggccacttggtgccagggctgtggcgtccacacagggataaatggaggtgacgacccttctctgaggtgcagaaggaacaggtggggccgtctgtggagctccggcctcctcctccgtcctcccgccctgcctgacagcaggtgtgtggccacccctatcccccacgcccagcaggtccaagggtcaggctggccctccttctccctacagtgggcagacaccatggcccttggggcctgtggcctcctgctgctcctggctgtgcccggtgggtgacctggcctgggtgtggggatgggggggcatctgcttcctgcctggacccctgatgggggtgaaactgggggctggtctgagacggagaaacatgctgagtccccaccctgtggggccccgtgtctcctctgaagagactgcacccctggctggaggcccagctgtccgtgctggggagaggcaggagggatgtgcgggtgggagttgggggtgcaggagttggcagggcgggtggtagttgggggtgcgggtgggagttgggggtgccaggagtcccaggccctagaacactggtgatttctttcctgagcaggacctggagggcggggaggaggcccaggcctgaggccaagctcccggcctccagctgccgtttatggcctgtggcttgtcccacccagccctgggccagtgagacagcagttgacccagcctcaccaggccgggcccctctgctcaggaccaggccccaccccagtgccgccctgaggcctggcaggggcctctggagcccgcacacccctctccttggcagccccctccatcctgggcccttcgtctttcccacaggtgtgtccctcaggactttgcagccaggtacgtctctgacaggtgtggggtgtgggggagggtgcaggcaaggcctggcaggagggcctcggtgaccctctccttccctggggtcccaatgggggcccggggaggtcatagtttgtcgccgtggtttctgctcgcatctctcggttgagtggggctggtcggggtgtgctgcagggctgtctcccccaccaccactgtagtcagtctgtaccttgggagatgctctgaggccatgaaacaacctggccctcctcgaactttctccccacagcgtccccaccgtggccctggaaccagctgggggctttgccgtgtgggagagccggtgccccaccccacacccgctgcctatctataaacatctctgtctgtctacatcccagcttcccttccattcagcccagtggccacactccatcaccagcacaattatccagctcaggcagacccaggtgtggccagtgggtctccagctgacttcctcttaatttcttcttaacttactgaggtgaagtttacagaagataaagttacattatcaagcgtccaattcagaggccccgagcaccttggacagtgctgtctgccccccgccccccgaattttatccagcttcgaatatctccaccacccctgaaggaaaaccggggcccactaggcagccacccccagcaccccgggccttctcgggggctccaccgttctgagcccctttctagccgcctaggggccctctgcagcctttccaccgcctccgggagccctggttagtttgtggagcatggtgcttagaaaggacgacctgagccccaggcgcgctcactgctcctgagacgtcatttctgctgcacccacgatgcttctggggagagtctggcagacgagagagctgaagagcaaagtccccaagaaggcagggaggtgtggtcagggaaggcttcatggaggaagtgcagtgggtttcttgggatccccaccaggcaccccttcctccttcgacttagggtgtggccggccgcaggtttcggatgcaggcggccggatcgtggggggtcacgctgccccggccggcgcatggccatggcaggccagcctccgcctgcggagggtgcacgtgtgcggcgggtcactgctcagcccccagtgggtgctcacagctgcccactgcttctccgggtgagtgtccgggtgggcaggggcagtctcaatgtccaggccccagtggggcatgcgccagcgcagaggcctccacttggtcttgactcactccgaggcttgggaactctgagcctacttccttccaatggaaagggaggagctggttgcccaccttctgtgaggttctgcagctctttgctcacctctagggatggacagctccctccctccttccctcccctcggtctcttcacgtggagctgagcttgcaatctgcctcctgaccagcccctgctggtgtcgggcatgctgctggcttttccaggggctggcaggaaccccaaggtgctgccgtggtccttgggccctgcagggtgaggccactgcccaggctttctgcgtcccaagcctaggagggaagagctgggcttcggatgcctgcaagggtagggtctgggcggggccgacactgacctccagcctccgcagctggcccctctcacccagccaccttccctcccaggtccctgaactcatccgactaccaggtgcacctgggggaactggagatcactctgtctccccacttctccaccgtgaggcagatcatcctgcactccagcccctcaggacagccggggaccagcggggacatcgccctggtggagctcagtgtccccgtgaccctctccagccggatcctgcccgtctgcctcccggaggcctcagatgacttctgccctgggatccggtgctgggtgaccggctggggctatacgcgggagggaggtgaggagcccccgtggggatgctgggatggaggaaggcaagggcggcaggaagagagctggcttgagggatgctgatgctaccacctgctcctggtggcttccacacccagccaaggccgcccctatcggctgtcccttttcaaagcctgtcgtgtggatccaaagcagcagccaaacgtcagatcacaacccacgtgccgtgacgagggtcgtggtggcatgggacttgtgtctggcaaggtctcccatccccccagtgcagggcctggtgccccaaccttctctgaagcctgttccccccaccccagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggtgagcctgccaggccgtgacagaggatgggggcggctgaagcccagggaggggctccccatcttctcggctcccaatgctcgccttctctgtcctcaggacgactccggggggcctctggtctgccaggtgaacggtgcctgggtgcaggctggcactgtgagctggggtgagggctgcggccgccccaacaggccgggagtctacactcgtgtccctgcctacgtgaactggatccgccgccacatcacagcatcagggggctcagagtctgggtaccccaggctccccctcctggctggcttcttcctccccggcctcttccttctgctagtctcctgtgtcctgctggccaagtgcctgctgcacccatctgcggatggtactcccttccccgcccctgactgatggcaggaatccaagtgcatttcttaaataagttactatttattccgctccgccccctccctctcccttgagaagctgagtcttctgcatcagattattgcaacatttaacctgaatttaaaagcacacgaaac

SEQ ID NO: 36903 - DNA, 8152 bp, Homo sapiens
cacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatcggcccctctggagaggaaaagaaaacttaagagtcgggtcgcgctagcctccagcagccgccgcgcccaccgactgctccgccccttctcctccccctcctccaggctcgcgctcggggccgggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtgagcgggggcgggcggccgaggcgggaggaaggcggcggcggcgggtgggatccggcggcccagctggcgggggcgggcgggacacgcgccggccctcgcttcccctggagaggacgcgcgctcagcggcggcgatcggggagcggccagctttagagcaggcgccgcgtgggtctacgctgtgttttagggggacgattagttcgcccttccgccccaggactttccgaggcgggctggcccctgggttgaaccgtggccgacattccggtcctcctccgtctctacctcccttggcagccttctcggctggtctcaccaacagctgcgcctccgcgcgctgtccgcacccttcctttcccactttgccagcctcctgtttctcatcggacagggtattttccgacttttgattcagagcagacttttctcccatttgatctttcccaaacctacttcctttagtattaaattcttaccttcaacttctcttgtccgttgaacacatacttttaagcgaattattgcataacttaaactgtggattgaataagcatttttcgaaacgatcctggagtgtaaagttccggtcagtgccccgtacaacctcgaacaaagcgtgcatttcatacctatggcacagtttgctcatatttgaccttggggatatcgactggtccgcatgccggagaaaatgattattgtgggtaattattggtcttattttggcgtctggttagtattggccttgtcttggggtactttgggagaaaaagccttttgtctgtgttgatagaataacttgacattcaagtgctgttctaagtatttcctgatttttacagtcctaaatggattggcttctttctggtacaataggtcaggctacatgtgaaacacttctgcagttaaaaaaagaaacaagaatgtaaatcatgtgccctgttaaaagcagccagttcctaagatgatttgattttatactcatcaggctagtctttattacttgccgaaatgttttgtgaactgagagggtctctaagctttcttaactagaagtgtcagagacctagcttactcagttgtggtcacctcagaagggaagggaaattctcattcgtcttggtgcaggatcctcctgagagagagtctcccatttagttttgttaactagaaatgtcagggacctagcttactcagttgtggtcaactcagaagggaagggaattctcattcgtcttggtgtgggatccccctcacgtccagtccttgaaatgctgtagacctcactgcagtttggaatccatttctctactctcccaattcttacctcatcacagtggtttctagtcagtcttggctggatttggctctgaaactcgaaatcatttatttcgtaaccattaaatgtcattcaggtgtgcctttatcatagataggatggaccaagaaaaaaaaatgggggtgggatagtgaaagcaataaattgtacatctttagtctccaaagaaaatgacatgaggttctcaggctaaaatactccaagagctttactttgaaaaccctagctgctgctcccctaattccccaaaactgatcctacctaaatcttcagtagacttctggttctggtcgggatcattaaaggcaccagacatgatttggttttggagttattgcctgatgttaaggctgtagcaagaaggggagcatccccttttgtactttttaatgagcttttctttagacatgttgctaaatgtggtttaacgttgtgtatctgttttatcaatgactgggctaggtgatttttttgtgagatttttaaactagcacaatcttacttttaacctttatgtgtgagtacaattgatagaacttaccataagtgcttgacaaactgtcataggtaggtcaggacatttttgagagtgagaaggggcactaataggccaggattacagggtttcaacctcctggatggtgattgttacagtgccttaggggctagcagcttgttccagttttagagtctttgtctcagctttcctcactgtttggaatgctgtttctcactgatggttatttggctggatctcttgtcattgagatctcagcttcaatgtcacctcagacaccttcccttaggtgggcacccagtcaccatctaaaagattattcattttactacagagcaccttgtctgtcattttctctgaactgttagctccataacaacagggctctggctgttcttatgtattcttagtgcctgtaagtatatgcggcacatagtggtgcttgaaaattgtgaaagcgagttacattggaccccacctacactttaaacagaaaattaacaggtactctttatgcttcctgctggttaatatgaatgaaaacactaaacactattacaatatttggtgaaaaatgacaccattgttcccctactttagctacacttcttttggaaggcgggggatgagggggtgtagtcatttgtaaaaatacttcttttacataggagctaataaacctatggaactcattactctggactgctgtataagcaaaacacacaaatagattcgataagcgtttagattcatcttaggatgaagaattattaggttggaggtacagctgtaatctgcaggggttcttggtatagagagcatttgtgatgctattaattccctgaggccacatatccagctggatggactggacacctgctcccagcctccttgcggataaagactgagaataaaataaatgagtatttctcccactttttaaatctcagttcaagacttcagatattagatgcatttggggcatgttttagtcattcatgttccacgtctgaacgggtccgttaatgttattaaactagacagtgacagatttctgcccagtgtcacgtgactgaaaggctgctagcaaacttcaatttaacagtttttctgagcagcctgcctttaagaaactattgccttaaatatgatttaagtgttaatatacatatacagagccacccaaacaggacttaaggaacttcaatggctttatggttattttgtttatatcctacatcaccttagcagaatatatagaaatagtagatgtctaagtgaatgaatgcatgcctcttttaatttgttttagtttaaatgcaagacagtataagggtctgataaatttgaggatcagtatactgaatgcattcttagtgttggcttttctaaattatgtgctagttatcccacattatgttcattcacagtagcatttttccagtaatactgctttcaagacaaagtaatagtttgctagaatgttattgctttttgtttaacccttaatgtttttaataagatgttaagtaccctcaggtttgcacttgaacagcctattattaataagcaagatgtgctacgctttgcaaaaatcaacataattctactgtttgtactcagtcatctgatgcttctagtaaccaagcaaaagaaaacatacttaattaaatcagtcttatttgcaagcactagttttaagtattaagagctcactaggctgggcgtggtggctcacacctgtaatctcagcactttgggaggccgaggtgggcggatcacgaggtcaagagagagagaccatcctggccaacacggtgaaaccccgtctctactaaaaatagaaaaactagctgggcgtggtgacgtgcgcctgtagtcccagctactcaggaggctgaggcaggagaatcgcttgaaccgaggcggaggttgcagtgagccgagatcgcaccactgtactccagcctggcaacagagtgagactccgtctcaaaaaaaaaaaaaaaaaaaaaaagagctcactatttgacttaagtcttcaattattatatagtatcttcttttgaagcaagagaagtactgttttattgtaagtacaatatttccaaagattgagaaaaccttcattaaaatgttctcaccatctggcacttccccccctctttgttatgtataggtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtaagtttccttaaatttaaaacaaaaacccacactgtaggaataactagtcttctctttctttgcagcacttaaaagatcatcccatgccctttcctttggccctccatttccagtatttttctgttttgcaaggaaagtgaggattcatgaaacttgctgacttagtagccatgaaggctaatcgtttctattttaccataaagaaggttaagtagaggatttaataaccataaagagggtataggagagttactacaaaatcccactgccgtaacaagccatgtgttactttttagagcattggcctaatggagtccccaagtactagttttgtttttgtgtacctggcaaatatttagacagtttttaaaaaatctgcaatgtttatggggataacttaaagtactaccaactgatttggattaactcttgatgttattgctctaactgaacccagctgtagagcagtatagcaaagattgggaattggaaatgcaagagaaagtcagatgtaattgagtaagccagtgtggtagaggcgtttggactgaggtagaacagactttatattttgttctcatttgttagattaaagataaaacatgaaggaaatgcagtatataagttcttggtggcaaacagacagtggactgaatttcagagaattaaaaactaaagaccctgttggctttattaaagcatgcttcagtacattaatttgtgccttccagatcaaatgtcatgtgtacaaaatgtatgttaatctaagagatgtgaccaaaaacgttttggatcatttaaaatgtaactgaagggtgctgccttttataaattcttagtactttagttagggaatgtactcattagtattgacctatgagaagcaaacttaaactaatagtacttttttaaaaaagattttgtatatggcacacaccccttactaactttctgacttctccaaagtccaggaagctgcttcctaaaataccttgttacatagttgtgccctccttaattaagcttcctagacctgggagtgtccaggaagtctgtataagtacatgtttccagtaaatacaatgattggttaagatgtttaagttttttgaaataccagggggaaaaaaagccctttgaaaacaggtgtcatgtgcacaaaaatgcacatgaagaagtaattcactttcatatttaacagtttattataatatcctttgtttctggtactattcatttaattcttcatggtagtttttggaagtttcatatttttatggtttattaatgattgtttttttaacctcagttcttgtattcactttacagtggtttattttcatttgaataaaatactgggcagctgttaatagttttacttcataggaatctacagataagtgtttaaatgaattgctcaagtttaaaaatatggctgggggtaagaacccagaaggtaaaataatgtctattaatcccagcagtataagaaaacagctttgtggatattaagatttgcagcagtttgggctaggagaataataattgggcatcaaagcattgcttctcaagcttgaatatatgcaaatcactttgttaaaatgcaaattctaattcagaaggtctgaggtgagtccctagaacttgcatttcttacaactgcccacctacactgatgctgacagtactggacctacactgagtggcatgaatgtaaagaatctacattggagttatgtatataaatacagttttatcactggagtgcagtggcgcagtctcggctcactgcaacctctgcctccaaggttcaagtgctcctgcctcagcttcctgagtagctgggattacaggtgcacaccaccacgcccggctactttttgtatttttggtagagacagcgtttctcgaacgcctgacctcaggtgatctgcccacctcagcctcccaaaatgctgagattacaggcgtgagccaccgtgcccggccctgtatttccttttaagaggaaattttactattttttttgagattccagcttttgaaatttttcctcttttacacaaaacaaaatagaataacacaggattaaaaactgttaatcagtagaacatgtatgcacaaaaaaatgcagataagacgacaggcttattgacagtattcgccgtttttcattctgccttttttaaatgaatttatttcattaaatactctttgtaaacaagatatttaatggttgtactaaactatgatggaattatacttcactgaatatttaagtttccaaaatttgaggttacagtgaggtgaagattttggtgaacatctatatatacttagtacctctattaagtttctagaagtaaaaaggagtgaacgtttaacatttttacaacgttgtacttgatatcccctgccaatataatactttggccttccactagaaacatgagaatgttttttccttgagtcctaacaaaccttagtcttttctgtcactattttaggtgagattaaacatttttcacagcattctgtttatgccttttcaacatttttgtcacagactatctcagattaacacttttgtacctttccatatcaataactaatcctaaagttagtatgctcatgttttaattttttagtacactgtttttcaatttaatgttttcattttttaaatcttttagtttatactctattaaactgaaatattatggtttgaaaacataacttattttttaaggcataacttataatagctttgtattccatcatatgtagaaaccttcgtttatccattctcctacggagttatatttaggctgtttcagttctttgctgttaaaatactaatacagtcagtatccttgtacatgtttctctatgtctgggtttatctaggtaactagaagtgtggttgcatcctttacttcactagatactgccaaactgccctgctaaatatagtcttgctcatttttctaaggatgtttggatttttgatttaagagagttttattaaccttttttattatatacagaatgtattttggcagtaatcttagcaagttaatctgtaagtctgtttataaaacaggaatgacttatacatcagagtggttgtgaaaattaagggaaagattttactgttactggaccataggcatttcccatcctgcttcttttaagttattcatgaaaaaaattaaaaactatgttctttgatactttaccctaactcacctttttttttttttccccatcttaggtttcccaaaccactccttatgatccagtgaatattcaagagagctacatttgaagcctgtacaaaagcttatccctgtaacacatgtgccataatatacaaacttctactttcgtcagtccttaacatctacctctctg

SEQ ID NO: 36904 - DNA, 65507 bp, Homo sapiens
actgtctacattagtaattcccaacttgggtccgaaagtgaacttttgctgaagcgaagtagctaaccgcttccatgtgcaaggcaggttccagacttcggggtgaggaggattaactgaaggaccccaggggaaccgggtgcgcagtaattgatcttggggcagaccagggcttggcggtggcctgtatctaaagacagcggggtctctgaggcggggcaggggggagttggcattgactggggagggaagagcgatcgctggtaacagccattgtgccttcccactgggttagtgggaaggttcctaaagatgccgtggcagcgacagtcccgtgctcagagccaggcacacagtaggcgttcactcgagacgcagagtctgggacgcgccctgaagaagctcctctccaggggcctggcccttcccaaggactgggctctgggcgtccccggggtcatgggtcagacctcgcgtccggggtgcgggctggtgcctgggcgcagagcggccggcgtcaacgggtagggcgcgggcccggggtcaaggccggggcgccgggcggcacgggcgcggaggccggacgctcggggccgcgaagggatgtgacgagcggcgcgctgtgcattgtgggaagccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgcgtaagtgccgcgcgggcccccttgccgcactccctgtccccgccgctcgggtccggccgcgggtgcccgggagcggcccggcctggcgcgcaccggtgtggtgcgggccgggctcgggccgccgggttcggtgtggcccacgccgggtcctcgcgcgtgcactacgtcctcccaggccttgtcgggccgcgcgggattccctttggttttgttcaaaaaagaaacctggaaaccaacttctcttcgaaacgcatccccctgcccgcgcctgggcgcttttgtgggaaaaaagcggtgctggcgcctaccctggcgacccttcctggggcgggctcacgggccaggcccgaggccgcaggaggccccgcggcgctggctaggcagtctgggcctgggcacccgggagctgctgtgagcagagttgtacttggtgaggcccccgccggcccgcgagttgccggccccggcacaataagtcgggcccgagccccggggggccgaggtgtaggcgtctggctcgctatctgcagggaggggaaggcgggggctactcgcgggattgaagccgggctggtgcgggggaccgggttggggagtggtccaaggatgggctggagaggggccacgggaacccccgctgctcccgattgtctcggtatcagccttttgtttgctttgtggtaggaagggtttgctttttttaaaaggtaactccggaaggctgtaggcttccccgggtggagaaggccagcaggaaagagcctcgctgggggtggggtggagtggggaggtgagtgtgcaggatgctgctggcagtgtcacctgacaacaggtgtgcgacatggcgctccctacccccactcctgcaggggccacagatcactcaaggagttggtcagtacattgcttgaaaggttcttttagacaagatgttaggggaaatgtttctgagtttcaaagtgagagacttctgtacaaacaactgggacaaaccttgaattcaacaattacaatgactataaaggccttgtaagattttaatgacccagtaaacagcacataagaatagacaattagagggggcactcctgctagcttccctcttttcttccacctttgtggtttgaggttttaccgttaaagtagggggtaagggaagtgttttgttccaaagctccctgctccagggagtcgggcattttttaacagtcttaggtttgaatgggagactcgagttgtaaattaggtggaattcacctactgcaggccacctttaggctactagcctgttgtcagaggtgttaactctgaaatggacacctcttgcctgcaactggaattaatacccattgtacacatttaactagagttgggcagcagcatctcagtcttgcacaagagactctctgatgaggatgagtatgttttcaaacttattttttcttaaacacaacaaaactcttgaaagacttcaaattcttcccccttctagttttacaaggagagagaaatctttccagtctgttctttggcttcgatctgtcaccattgttaatgctgatccctagataaggcattaagagggttgtctaaatgaaaattgtttgaggcaggcctttagaaggaggcataatttaactcacattttattaaactttaagaattgtctggaacttcacatgtgacattctagtatacaaccatgccactggtttagtttttaccaaatgggccagtgtcagggagtgacacatctccatctgatgtttcttctggtccctgagagaggcgaacttgaggagcgcctcgcattccttccccactgagaagctcagagggcatgtgttctgggacctgccttcagagctaatgcggccccaagtcacctaaaggagatttatttaaataaaagcataaactgaaaacctcaagccgaagaacccaacaagactctatatgtgttgttcatcagaactgcaacagcctctggttttatttgagtgtccccaaggatttgtgacagccttttcagagccccattcctagaacatgggctgggaaggggcaggagtgattggggcccagatctctgtgggtccttcccatattctgtaggtttagaggtcttttgggccctgcctcagtgcttacaagtgagcctgagtgagtcaactcttcattccaaagagttgtatagcttgtttgcttggaccaaacctgtcaggtcagtgtctcagagtctttccataaagatttcctgagaatcagctcctgttcaggcactggggacacagccgtgattaagaaatgcctagcccctaccttgggggagctgactttgggagaaggcaggcaagtagctgttgtaaaatcagtgcaaaaggccccacgtagccccccagcaggtacagtaacctagccaggagtgagcccttatctggcttggaaaggtcaagcaggagatggctgggcaaaggagggcagatggggacaagtgtttgaggcctggggaaccccatgtgtgcatcttagaagaaaagaacagaggtcatgtggggaactgccagaggctcgggatggctgagtcctggtgcggagtcaggtgaggcttcagggagggacaaacaggacaaatcacaaaggattctggtcagacccacactttatcctaagagcaactgaagggttttgagcaggagagagacaggatcaggtgttctttttattcttattgggaacacgtctactcggcaaataatgagtggattctacatgctaagccttatcagagtcctgtcctgtgaagcccacactttaacttttctctaaatagccttccgtgagactggttatcttaagagtttggcacaacctttaaaagagagaggagtatgtagaaaagtttttttgtaaagcaggcaggcagtaacttgctgttaaaatgtagcaagctgcacagttccttcagtgcatctcgggaagcgcatcaccgaatgggtttgcagaggtgaaatttcaatcccagactagcttccccaaaactgtttcttgcttgtggtaaatgacatttgtgtttgtgttttgtttcttcctgccactgaaaacataacaggagtaagacacatctgctggaacaaaatgcatggtttatgatttatttactatctcagttggtctgtctcttctgtttgcagtcccctagttcactgagagtggactgtaggttctttaatcatctggctcactttttgatatggtgttttatgaatggagagagatatttttcctgattggctagaatactagaacaggtctctgatccaagccaatcagagtgcagcttgtgaaccccagctctgtgagcaatggttgtctagtatatccacatgcctctggggacatgacagcgggtgacaccgttaatcatttggtgtgataggagtaaacggaagagggaagagaatgctgtaaacaggattagtgtcttgtccttcagaattaagtttctcaggttggcctttgtgattggagttgatgggaaggtgacaaatgcatgtggatatgcgggcatttatccagctgccagaatggatggcgtggttcttcctcatcagcagttatttgagcactgatagctcagactcctctatcctcaggggctggagatagggctctttgactagcaactccccagcagttctaatcaatattgcatgggatcaataggcatgtattcattgcttagataataaaatacttcatgattgactattccagcggtttcatgagtgccctgattgtttaaggggtttctgtgctgtagcttaaacaggagtcaatctcttatagatgtgaggaaggttaagtattttcctgcagtctatggtactgagccagaggcaggaggagaggtcactggaaccatagaactgtcacagagtcataaggcctcagtgtgccttatgcccagctatcagggcaattggagtgttcctttcctgagaatccccaaggtagctctacaagctccctgaattttgagtgtctgggctcctatagggattttgccaggtgtatgtacatgaatgtccaagagaaggtctctgattggtgtcccactagccatagctcccagtcctgtgggctttggaaatgctgccctctcctttctccctatccactgtcagtgccaactaatcagctaccttgtagctggcatgtgcatgtctaccgggtgccaggcagggtggtgggtgcttggagatacagtggtgagtagagcaaattggttcgtttcatcaagacagacaggtaaataggcaatgatgataccatgcactgagtgctaagaatgggatagctggtttcagaacttatatgtaaatgggatctagagtgactggcaatcatgatggaaggaagggctggaaactgcatttgcagagtactgtatataagactaagaaaaataattgagtatattaaagaataggggcagcctgagggagattgtgaggcacttttagctgggccctgggtctgcagctgccacatccattgagggaactgggagggagaaattcatcccggtggatctctggttgttgcaaatagagagatgtgttggaggtcaacagggcctgtgcacaaggttggagtctggacatgcagctgccccaaactagactgtgactgacagaaggcatggccatggcaggaatgcagaagagggagcacattgatggatcattgccagggaaggtattgggaccagtaggcaggattactccagacaaagggctagagagatgttcagactgagcatgctgggtgtgctgaaggtgccagtgggaatgaaggtggtttgcagtgcagggagcagcctgttaggatgcctgctgggaagggataggagggtgtggcagggcctccatggcactttggttctttgcccctactgcccctcctagtagtacacagcttgttgttctcatgtccaccttattcatggggtctacatagccagccttctaattagtcctgtgctaaaagaactgactgcgttgctccagtcgcatctcgattgctgaggggcctgtggtcagactctgttgcttctcactgtagcctgactcatctctccatccagctcctctataaaagtttgtctttgggtaagctttgaggttttataaacaaagttaatgtttattgtgatttataattggaagagttgcagaaataaagaccacagagatcccttcaagatcaatcacagaaccttcattttctaggccaataacagccaaaagggcagtcaagctaatgtgcaatgatgaacagacacagttgcctgaggacctatcattgttttcaaagcatgcagagccatgagtgaagcctcctggtttactgaaggaaggaagaacacatctttgtcaagtttgaccagatagtatagctgttctcctgtgaccagcttcactgccctgcagaggtgatgagtgcttaggaagctgctttgtctatgatgtagggctgtctgtttctcaaacaaggctggatgcagaacatgggtcaaacagggcccaacaggttttgggtggtaactcattctggggttagggtcagcgttcagattggtttatcatgtgacagagactggctgtttcctcttttcttctgagtaaatagccagagtacatttcccaacctctcttgcaattagttgtgggcatgtgactaagttctagttgatggatcatggtcagaagtgatgtgccccatttgcaggcctggccccttaaaaccctcataggttattatccatggtctttttctttccatggcaaccctgggaatcatgtattgaagatgtgagagtaacaagatgggaggcatctggatccatgaatcactatgtggacaagaaacaccagccaatcatggaaacccattttggatttttcgggagtgagaaataagttgtagagacttatctgttacagcagctagcaatgtcttcagcgcaaatgtccaagatctgttctgcaagaagatggccttttttcatcttattcacattattgtttttgttaactactgagaacttgcccagtgagtgagtatcaggcccttacatggatgctttgattcacttctgccaccaactctttgaggcccttactagcatcatctccacttgaaagataagaaaataggttcagaggggttaaatcacttgctcaaaaatgcacagccagtaagcggcagagccatggttataatcaggtcagtctggctttggacttctagtttttaattataatgcttaattgccattggcctcacagtcactctcccccttgtcatgggtgcctgactggagctacccacacctgcataaacctctgaagagcaggatggacctggcacattcatgggtttatctggagactgcacaactatgagttggttttcaaaagggtgttttgaaaaccaccacacattgctggatgtcataaggcttcatggcttagtcagaattctttcatagctgtggctgcagcttggggaactatagttagaagtgcaggaagaacatggggagggataaagtacagaatctctgcaagacaaccccattggtggggagacagacttgaggccgctttattggacaggagcctgactcagaatgagaagtgaagatgttcttctgccagcagggtggcactggaggagctgtgatatttcagacctttcttgggatgagttgactacagtgcttcacatcgaatggcttgcagttcagtcaagttggagaggcatgtgctgggatatatatactatgggaacatggagcagtgagcaattccaggctgtggtcatgtccacaaagcctccatggcagagggaggctgtgagtgtcagttcagcaagttgacaagaggacaaagggcattccaggcaggagaactgcgtgttcagagacatccttaacacagtgtgacaggctcaagaagtcaggggtggcctgaggcatgtgagccagggctggggtgacaggaagcagtgccaccaaaagtagctgaagtatgctgtttgtggctagctcagaagctcaggctgacagggaatcatcagagtaggcagagctgcttctggtgtccatggatgaagactggtgcggttgagaataggtcagaagtaaagaggctgaaccaacgcagggagggtgatgagaagaggcctgagaggttctgcaggcggttcagcagagcttggctaatgcttgggtgctgtggggtggacagagaagtctgggccaggttcactgctgtttggctagtttggtgcatgacattgccactgatgaggctgagagacccagaggagttcaaggcacccatgggacttgtaagtgggcccttgccatcagcagtcagaacagagctctgaggctcagcggccaggtgttgcactggcatagagacctgggagtcactggcatgttgatgtaaagactcagctagagtcagaggagggaaagacaaggagcaccacttttaaggagtcagcgtgtctaggacctgccaggtctctgagtgctaacggatcctttctggaggagaccactgtccagttcccacataggcagccccagacatgcccagcaggtcagctgggaaacaaagctgaagtctgtgctctagtaggaaaagggctgagctgctgttaatcatcactgaccacaggcctcccctgctgaaagggggagacattccgatttaaaagctcagtccaaaggcatcaggttgttggtctgtgaaacacatttgtagtaaagcaaaagactgctaggaaacccaatgacagccttgcctgaaaacacaggcacacatacatatacacatatcatttcctgctcagagtgagcacaggcacctttttgcaaggaatgttttaaaatggagttcattgcagcaaggaagggatccaactaattgttttggaaaaacccagacccttctgggtctctctagccctcagtgagcagttaagactgggtgctccttgacagggcgctcatgacagaggcctttactcttctaacatcactccagagccagggcctctgccatcttacctctgttgggcctgtctacacagtagccccagagtgcccagaattctgttttctgtcctcacagccatctctgtggctcatcccagatgatttgagatgcacctgggattagagaggtgttaagtgtggaccgtggcatgtcctgacaatgtccctagtataggttgagcatcagagtaacagggactcctatccctgtggcctccagtggtcacagcattgactgctggtgctggaaggccccaaacaccatggagtgtgacgtcagtttatcagtacatgggagacctgcccagttggttcagtgagcaaacatgttcatagggaagactttagggggccccagaacaggccaaggcccctcatatcccctctcccagcaccctgcactggccctttgaagcatgcattacgtttatcttttaaatgactagggggttatttattgtctttttccccaccagttccacagggaccacatctgcccagcataatacctgaagtgaatgcataaatgaacaggatgctccaagtaaacattcgagaccttggatggtgctacagtaggaatacagttaggggcacccctccacccacctgcagtctgatgggagaatgggcacacgtgcatcaatgctgtggtgtgcagcacatggggccctgaggatgaaacagccagatctcaacatttgggagggctggcagaaggcagaggcaagtgtgagagataatggaggtcccagccaaagggaacagctactgcccaggcagggagaaaagaagtggaagggtatttggggggaaccttgtgtggctccctgtttgctagtttagaccacaggtggcccaaggcaaagctggacatgtgtgccaggcctagatttctagggcattacatggcaggccaagagtcctggttctatcatgagaattgtggcagccacagaaagctttcaggccagggccggggcatgttcaggtgggtgtgtacccagattgccccacccatggggtagagggtggattagaggagagggggctctggtagggagaccttttcaggagacatttgtgaccacttgattaaaatagtgatgaccaggatcccatcactggaggtggagagaaagagccccacaagaggtgtagaggagggttttcctctggactgggtgactggatggggattgggagcaaggaaggaaaaaacacctctctctctcttctctaaagattggcccatctggtggactagaagtgctcagagggcctcttactgcaacctgactatacactgtactgactcctgtaagctgttcttgcctctcacagataaagaatctaaaatagagacactgctttcatcagagaatctaggtatctgcctttacatcatctttttaggggagggtgtcatagctgtttttcttttatgaagcctttggtaagtttatcagccccagtctcaagtgtatgaaaatgcaattattaaacaagtgtatagaatgtggccaagaaatcccatttcctttttcatcatgtggcataatggcaaggcacttaagtaaaattgatgtcatggtataaattgtgcaaagccaagcctttcttttcagggatcaaactgctccagcggagtgcatcacctggacccggagggccctgcagctacagacagtggcatctgcaggcaggcctggggccttccaggggactagagtgtacctggaaaggggacatgtgctgtccccagccaccctgaccggtgtgcctctcgccttcacagtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacaggtgagtgtacctcagtcaacccagacaccactggcttaagatgcagaagttctcatagttctccaaagaccacttttgtttcttttattttgaaacagctcaaacctacagaaaagttacaagaagagtacaaggaacattttcacctagattctctagttgttaacatcttgcctcatctgccttatctcccctcattgtgtgtgtgcatgcaggcatatgtgtagatatttctgtatttatttttggctgttacatagtccattttgaaatttcctcagctgtcccaataatgtactttataattttgtttggttttctttcctaatccaggatccatttcaggatcatatattgcatttgactgccagtttgttagtcttatttaattttgaacagtttgccagcttttaaaaaatcttccatgacattgatacttttgaagagtccaggctagttgtttggcagaatgtcctccaatctgggttggtttcaggattagattcaggatgagcattttcttaggagaatggcatcagagatgctgcatccttctctgtgcatcacgtcgggaggcacctgacgtggtttgtcccgtcactggagatgttctgcttgctcattcagttaaggtggtatctgttggatttttgcacatcctgtaccacggtatttcacccagtggcttcagcaacccttgatgatcttacctgaatttgatattacagtggtggttataaaatagtgggttttttcatttcttggtggttataaaatagtgatttaaaaaatttatttctgcatctcttagttggcattcttttgtaataaaacctttccctgtgcccttcctctgtttttttttttttttttgaagtatcaatgttggtttacagattttttaaaatttagtaagttatattcatttcattactcgctttaatggtcacatcacctcaaatttgatcttcaagctggttctgatatccttttgccatgtctccatcagtttctgtacatttccttgccttctaacacaataaggtattccagccttaccctggacttcccttgccccagtctgggactcagccttctctccaaggggtccttggtcctgttcacagatacaatcttatttgtggtttcacagcaattgtgcaaggccagctgggaagggagggagactaaccccatttttagtgatgagaaagccaggcctcaaagcataaaggacttgtctggggttatatacagcctgcaaggggttgagaagggacccaaatcctgctgtcctgtcgtaatgctttcactgtgtattgcctgagacatgatcaggtgggtctgatcaggaaagagtactctgattcttgcagccacctgtgctacagccagaaaggacgactcagtaagacagggtacctctcccaaagcgatacaaccaggcagcggaagggctgggttgcttcctgcactccctgctctctcagtaaggcaaggccgagggtttccccatagcaaacacagtcatcaggaaggtaaagtttttgtgttctgttgaaagcatctgggcatgaaaagtaatagtgttagatttaagtatttgtacatattttgggacttctgactttctgcttagcaaagactcttataggtggcaggcctggtaatgtgaactaagcatgattcttctgtgtagatgaggaaacaagcccagaacttaggtgacacacccaggaaagctatgtatagcattggcagtcatccagggagactgggagaagttgctagataggaaacagaagacattttagttcttgcctagttagtgtacgtgctctgtgacctagaggaagccacctaacttccctggaccccaatttccttacaactcaaatggagtcaactgtccctactccaactccaggctgctgtgaaggccaaaggtgctgtgcacataatgggaaagctaatgtgctacacaaacccaggcagcccctggctcgcgaatgccatgatgcccattcctggggtgttcacagacaccatcattaggtcaagtacaacctcagtgtcatttcttccatctagctttctcttcttttttgaagggcatgaatggggaataccattgctttgtcatatctcaggcaactactaccggtgctgcatagaaatctgtgttttcctggtctgggcatagctggttctgaatctgagcccagtgctcctgaggtggatatcagcagtccattcccatgggggctagagacgttgactcagtggctcacacatccatcatccctatccccagctattgtgggtgtgtaggagaggtcacagcagggcataggactggccaggagagcccatcactatcactggaaaagtagctcagagcagatccttactctggcatcagccacatcagctcttgtatattaaataataatatgtatttttaaattttatgaagaccttacagcagggctatagttggctgaatctgaagcatttcctctgcctgcatgcggcactgagtcattggcatgaccatgcctgcccctaacatggaaccaggcccaattgaccttaggaggatgttctgagcagttaatgcatgcccagtcactgctgtggttacttatgtcctgttttgtgatgggagaggagccagactctggggccatgtctagtgagaatgctgctctgttccacccctcagaacagtgccacacacccacactgactgtcctcagaaggtgaccagcccttagccgattgggcagggatgtgggagcacgtggatgttagacattctgggtctaacttagacattctgggtgacccacttagaactttgttttttggcccttgagtgagaaggaagtgtgtccaggccctctttctgctctcctcttcacttttgtttccctaaaggccttttctcattcactccacatgctgtctgccaggcaccgtgctaggctctgtgtgagagtgcaggagtgatcagggcagagtggcctctgcttcatggagctcacactcttgtctggaaaagacagccagccaacctagatagtttagagactgaaagtgttgcaaggagtaaaagcaggccaaacgagggcccaggctgcttgggggcttggagatgagctggccagggaaggcttctctgaggaggagaaatcagctgagccctggagaggtgccagccagccccacaagaactgggaaaggggatctgccaaccacttatctgtcttgatgcgcctgctgggtgccaggccagccccttcccagaacatggggaagctacagagagagggagaaactggagtaccagccttcaagcagcttagggtctggtcaaggatgtgaccccgacattgtgctccaacactaggcagacatctgagggaagtcccacccactcaagctctccttgctgagagctgtgatgtcccttgcacagctacacaccaacccatccccacccccaaagggcttcctgtccagaaacaggtataggcaagagaaaagctgtggtgatgcaggaccacctgtgctgcaaggggggagacaggactgcaagtgggtgtcaggaaatgctttctggagaatgcttgttaaccagttaccagagctgccctgcttgtttaggtgtcactgaagttcctaagaagggattgttttcttctctgcatggcccagactcttagaggtggcatgtagtcaagcccaacacctggcatgacaattgcaggcatggtgatgggatgtgccacatggaggcccatttgaagtagctgggccaggccctctgccttccaaaggcccctgtgggagagatgggaggggtctggatgcccagggattgctaagaggactgctgagctgcagtgccaacctaggactaggtgcttctgaagcagggaactggcatctccttggtgaccagctctggggaccacttggggtccactgtgttctagagctgggtggtttagagtatgggcattggtgccagagttgccacttcttacttgtggcttaggcaagtcactcacatctccatgctatagttttatactccgtgaaatgaggatcacagtaactgtctcatcaggttcttatgaggctgatgtgagagcatgcatgtgaagtccttattccatgcctggacattgtaagtgcccagatgttaactattaacattagggttaaagtatgagagaggaagggagtctccagtaatcttgttctttttcctgtctcttgtcaatgaccagagccttcacactcctccaaaaggcacccagcatcctctgatagcagatgtcccaatttgaagctgcctgttggtacttggccaatccttgtgcagtttatggagccagctcctgacctggggaagaagcagggtcccatgagtgatctttatccactttacagactggatgaggcccagccattgggcttgactatatcctgaaataaaaccccaaggaaaagggacggttgttagaaatacatcttgtttgccatctggttttggctaacaaagtgattgtcctcatcccaagtttcagcttgtttgacttccagtctctaactcaggtcagatgttgcatatccctttggtggtagtcatagggccacaacccatccctgcctccatctcctagaagtgggtagagagagcctgttcctgtcagcagcacatcctgttacactgatactcatttcagccagcatccacctcacttggcatttctgatgtgggatggaatcctacaagcttggaagattgaggtaggcagagcctgcagttggttctgtcacttaccttgaaaataagtcccaaatctctttaccaccttcctatccgggacactcaaatgtgtcctggactcagacagctaaaaatagagcaggaagaagaggacagtcaggcttggctctttgatgctccaaggctctaggagctcccacatccttgcttgtttgcatgagtgcacctcccttagactaactgacgcttcaggccagaacccagctaatgcttgctagtaccttcttgggcactcatgctgcactggggcttatgccacagcatttgctgtgttctgcaaagcccttccctcaccctgttttcctaaaattaaaacacacacacacacacacacacacacacacacacacacacacacaccacaccacatcacacaggaaagggacaattaagaattttatcttaattcttaaagaattcttaaagaattttatctgaattcttaaattaaaattaagaattttatcttaatcacacgggaaaggagccaggggcttacagctagagaaaaaacactgaagttgaaactccagtgggtactcacagtgtgcagactatatttaagtgcatgttcccttttctggttatgtgagtaatttgtttgaaaattgagaaactaaaactcattcataatcccactacccagatttagcagctgacacttaatgccttttgtgtatgtgtaaaagacagaccttagtctaattatttgttgttattaacatacgctattgatgaccttcattgacggccagtcacagaaacatcacagtgcatactcttacaaagcaaattgtgaagtactttaggaggtgctccccacataatctaagttaccaagcttccttcagtctccctggggaatagatgattccatggtggataaacattcactgagcatttgaaaaagaatcagttcaacactatgtgcctttgacatttccctgatgatgtggtattatatggccagcaagttaacagacccaagtgggtcaggcctcagggtttgagactagagcctggaagccaccaggaggtggaattccaccagtacttctctatcttacccaagacgtgaaggtgcagcatagcttgataacatgcttctcccagggcatgtgaatccagctgtagagctcaaaaacagtttttatctggttcttcatggtcctcctaaagagtccatgaaattgttcaggagagcgtaaacatgatctgggcctactttgtgaagcaatgggcccattttcctctgctctcccaaggccagcggtcagactataatacttggatctgagaggggaaagacctcattgcttcttgatgcaaatattttcttccaatctgtggcttgtcttctcattcccctaacaatgtcctttacagagtagaaatgcttgattttcataaagaccagcttagtaattatttatggtatagattgtacccttggtgttgtgtccaggaagttactgccaaacctgaagtcatctagattttctcctatgttatctaggatttttatgggtttgcattctacatttaggtctatgatccattttgagttaatttttgtaaagcttgtaaagcctgtgtctagacttggcttttttgcatgtggatgtctagttgttctagcaccatttgttgaaaatctcattgctatcttgaagataagccatggtgcctggaaatcttcaaaagtcaaaggagtgtcactgctgtctcatgatatcactttgaagggcaaaatgcaactgttatttttaccatcagggtctgcagataggtagacaagttccacgtggagggttctgcttttgcttgggccaacggacaagcacacaacaccacaaaacctgtttctggtagacaagttccatatgaagggttcttcttttgcttgggccaacagacaagcacacagcaccacaaaacctgtttctggaatcaggcaaggaaaaaggtgtgaccaaaactaagtgtgccttcttttcatctagaccttccatttgggatctatttacttcttattgaagtatatcctctagaattttatttattgagggtcttttggtgataagtgtcctccacttcggtttttgaacatgtctgtcacatctataaagttttcagccatcatttcttcaaacagtttatactagtcacttcttatggaacacagattaagcatacgttagtattttactctgtcttctgtatctgttaatctcagtcatgttgttaattcatgtctttctggactactttctggatatttacttttcatctgtcttctagaactatcttcgtgtttactctttctccagctgtatctaatctgctgtattaaacagattcagtcactgaattttaaatttcagtcatattttcatttatagaagtcctatttcattcttttttgaatctgcttggccttttttttgaaataggatctcactctgttgtccaggctggagtgcactggcatgatcatggctcactgcagcctctgtcttctgggctcaagtgagcctcccacctcagcctcctgagtagctgagactataggtgcatgccactgtgcctggctaatgcttggccattctttatcatctttttttctcttcattttaagttttatttaaatatatttcacatgattattttatattcattatttaaataattctaatatatggagtctttgcatctatttctgctgaattttgaatcattgttaggaaagcctacctccttccaaaactataaagacttctcttcatgcttttgctcaatatttttatattttttcacatttatactttgacctatttggaatttaccatgtgatatggtgggagatagagatcaagttaattttatttcacatggttatccagttatccaaacacaattgaatatttcatctttttcctggtgatctgagatgccacctttatcagacatgaaatttctagatacaattagtgctatttctggacttttattttctgctttatctgtttgtcttgttgtatacttatttcccatatccagtaggtctttgtctttttacttttgttgaacttcttttctctaataagtaataacaccaatggtaaaatccacatgctgtcaaaggatatacagtgagacatgcattgccctttgggctcttttgcattttcagttctcttcccaggagataatccatgttactagttcttatatatgttatatatctctttaatcttttccctttttatttaaaaataaatctagaaaataaaatgcaaaaatacaggaaatcaaaaggataatgggcacatgtagtatgcagaggctgtcttatttatatttgggccaagatcttgggagaatatgaggatctttgatctgcccttaatccctcaacacccctagacccctcagctaacctcgaggctgacatgggactgtgagttgaggcctgcctggatcctgggcccagcctgaggctgcgctccctgggatgatagctttatagttcatgctgcctgctacggaacccaagtgtgtgttctaaaacatgaaactaggcctgggcgttggagaaccttccttcactgccatccttaatcaccactgaccactgcagtgcttggttcacttgtttagtaattcgtttggaatgattgattaatgaaagagttaggtgcaaagtcccaagcggggtgctggggtcaaaagaatcacggttgatttccacagatttgtagggtacctatgacgtgcctcacatcagagccacattagtgatcccaggccttccccacccctccctcacctttgtatacagctcccagcacaaggccagatattccgcagctacatggtaaatagttttttattgaaggctaagaagaccagttagaggaatgatgagtttcagggggagggagtattggtaatgtcagatactaccaggaaattgatgaggatgaaaattaaactagacccctggatttttaaatgaaacatgattaggattaacacgggggcagagtgggccacacctgtgtgaggggaggtatgcagcagggcagctgttgctggcaaacagtagggcgttagaaatgtagcaagggctgatcctcatgtctgccaaaaaaaagccacagaggaggtctcggcaataccttgaaaagcagaggaagtcaggagctgcccagctgattagagatagcagtgtcccaggagtgggacccagcatcccaggtgtcctccgtggatgaccatcaggacgggcttctaaaagagctattaacactttgtcactgaaaggagaaggaagaaggtaagaattccacaaatgtcttttctcccactgtcttcctgttaaaataccagcaaccgatagaacatatttacagtgtttctgcttgctttctcctgcctgaaggcttctatgtctagtcaagtcaacccagagtaaaatctgaaagcaaagagccactcctcagagctataaataaactctagcaagaagacaaacccaaagggtattaatcattgtcagcctccgtctcttcccaccaccctcttccagttctggttgccaagaagatgacataaaacctctttgggtttgccaggctgctccactcagcctaactctctgaccctggatccctccctttcttcctcctcttcccaccccacctgcttcctttttaggcaagtgcatcttccatttagtggctagaacatgtgggttccctggcacccagtgctgggctctttaaaggccgatagtagcgcctggtgctgagataccctctcacggggttgacatcaccccatctgcctacaggggacactctgggattttatagaaggcgcgttccctgcagagctgtgggagccatgtggaaacaaacccaaggcctctggaaatggctaatgtgttggtttcccttgccatcgatattctgattgatgctccttgtggtaactagtagctgaggtagtctttggttcacatttatgttgcctctataaatctgagtattgactgctaaaagtcaatatctgctgttcattcagaaaatgagggtacttaacttgagtagcattgtttttcttgccctttcactcccaccccaggccctggcagtctctagttcatattctaactgtggcttgtaatactagttttagggacttcgggggaagtgctctgaattctaggtaaaggtggaacagttaagttccaaaacatctgccgtatgttgaacagttactgtgtgctaggcactgattaaatgctttacatttggtaattcatcgaatcctcaaaccacctagctttcttaggagtaaattgaggttcagagtttaagtaacttctccaaaatcacacagcacagaaaccttagcagtcagaggaattggaccccagagcacttcatccacttggcatttcctttgtcttgaagcagccaccgtacacctcaggaagactggtaaatgcccggtccccaaggctggctcgatgaagacacagcctgaggggacagactctgcaacagtcatgggtgattgccagagacattcctgtggcctcgtatgggcagggaggacaggggtcctgcaagataggccttgaaggataggcagccctggacagggatgaggaaagtctagagcgcacaggcaggaggtgggtgtgagcacaggaggggcgaagtcccctggagtgacatgtgctggcccgccgggaaggggcggtctggtgcatgttagagctgctgctgtagcagtggcagagcaagcgaggtactgggcagagagctgccctgaggagccacagcaggcgtcggagagggcagtgcccagtcaggtatggggagcttgtgtcactcagtggcactgaggagggctggagagtgggaagctttttggccaatgtcctttcattgtccccttagcgaagaggaggtggaatcctaggtgttggagcttaggcaaatccttagacaagcagtcctcagcatcgggaatccacaccggcagacagcacagaggccaggctggtaaagacctcaggagctatagtgccctctcaggggcctccctttctatgacacactcacactgctctaaaaacagccatgaaaaaagaacctagaaagtcttcgcatgctcagaaccattttttgggagaagcaggattaagcaggctgggacagagtgtctgagggtaagggggcttgtgacctgtggtaccaaaggccagctggggcagccgatagcagaagtgcctgcagcttctcatctatccagtgttataattattttcattttgaaaggaaaatatgcagaagataaattcaaacagcacaaaagggagtagagcaaaacgtctccctctgaccaagtccctgattctgctcccagtgggcgaagctgctcccctgtcttgatgaacatgtgtagcccgattgcagacgtcgcctcctcccccaacacagtgcagcccacgaaactcactgttctgctcctcgctctttcgctttgagtccatctgggaaaccgtaccatgacagggctccttaaatgagtttcctctttacattatactcttcaaatcatttcatttcagcagacatcgctgattgttcaccccttcctgagatgaattaagaacaaatggctgtggttttccctatcaaaacaaacatacatattaaccatttccttgtaacttaattgagagtccttgacagcaagtgattggtgggtcagaggtcctgcccagctgccagccaggccttggagtagaacaggtttctcagggcctccccaggcaccttctccttcccagggccttgacttctactgcctgagccactggctctgcacgctctgctgtggtcagacaaaagccccagacctcattccaaggtagagatgcctgtgggggcgccctgggtgctgtgttccatcaaggcaggtctggcagcaccgaggttaatcgagttcaagtgcatttttcaaacatatgttaactgttaagcataacagcaaagagtaaactattggcagaggaaacaccaggttttctgttgcttttttcctccttttggcacaaatccatccatcgaaatcatccagttatagatagaggaaatcgaggcaaaggaagtgcagttttctcctggtaatcaagcttgtcgcacttttttaacagtgcagttgtagcctcaacagtagtagcttgaatttactgagtatactaagcattttacttggtaactcattaatctcataagcctagaggtaacctcaggtatcactccccctgtacagaataggaaactgaggcttagatgcacttggccacatcttacagataattacaggagctgggatccaaaccccgacggtctgtcagcagaccccgggctctcaccacagtgccatttgcgattgctgccctcccctgcagacagagcgggcagctgaaacagcaccagaggtgaggaaggcagaggaaaacttcctgacaaggaagatattcgggcactgagttgggttggtgggttagattaaggtaatgtttgctaagaatcatagctcccctgtgttattatgtataatgtaaacttatttattttttactttgaaatagggctgaaagttccagtcagtggaacttactttacagattcccaaattaagctgcatttccatcttattgggagactttgtgggaaggcagaagactggaccaaatgctgtctctgagacccctggctcctcctggacttttcggaggagtctgcagtgggcttaacaacagtagaggagtttgtgtcaggcttggaaccatctttggaatactactttcaatcactgctgtaggttttattttctctatggaattctggttcctttgaggcccctgggacaagcagatggagagctttgctgtggcccagagctcccagctgatggctgggcaagcttcagaccctgccactcaacctcctgaaaaggtgggatgggggcaatggattctgggatgcggctgcaaacactcagagccaccaagggaattggaggaggttgtggtgtggtcagaatgcaggaagctcttagcagtcaccttccgattggggttgattgggttaaggccttctgggatggtgtaaaacagttctgaactcaaaggactgctgatggaaggatgatgaatcgaaagaaatacaataaacagattccttgtcatgttgttggccttgtagcaaacatgttttctccttgggattacgtgaacatttgcttttctttgatttctggttgttattttcagtatttcttttgttaaatgagctctgttttacagagcttcagacagctccgttaaagcccctgactctttcctattgcaagggttgtgtttagagtttggctcagcctcaacacatcacctgttagctgttaggagtctaattctgcaaaccatgacttcatcttgctgaaggaagatagacaaaatgcttcaatacaacagatatgttttagttcaagacatttggaaaaaagaaaaaggaccctaagcctttcgtctctgggtggacttgcaaagtagacctgtcaaaggtattcatgttcagacggctggtctgtagtcaaaaaggctgccaaaccatgctgttatccaaggatgtgggaattttgtcaagcggccttaaaacagtcatgttcaatgaagctggggaacgtttggcccaggatgtccctgcagggcttgcagctctgaggagagggaatatggttgcatcatctaggccactacagatgatggtgccagccactcactagttgccagagactggccctggccaggagtgagaaccagaggcttatgtgttttgaaaaacaaaaatcttagaagagttaatgagctggccagtttgctcaccattcaacttgttccctttgcaccatttataattgggaactttaccacacttacagtcctcttcagagcagaccctaagcgccttgggccccaaatcagtctagtattggtcattggtaacaaaacttagactgtcaccgactgagaatacttggcttgatggggtggagaacctggtaaggggttctgtttcttctcctaattgttcttttccgtttcttcctgtggtttcttatggattccatttattttggttacagcctccaggctgtggctcctgaaaatttccttcaagagagaatccaagggctgagctctggaaactctggagaaaaggatttttgtgtccatagatctggtgttttcctggttatctttctcagaatcgcttttcttttagaccagccacagacaaaacagagactcacaaaaccttccaaaacatgaaatgaattgagtgcaagaacccaccctcccccttgtaggaaggcatcggctccattcactttgaggcagaggcttaagttggctctgttctagcctaggagaaagccctccttgctggtgggaatgtgagggccatcccagtgtgcatggggggcaggcaggcattgctgtacagccctgagcctggggcctccatgactttgccctccatattattgcaaagcagaggatcacttacagggaagaaaactacatcaggacatctcctttggtgacgtgtgccctgtcccaattcctcagcagtcagtcaccctctccgctcccccctgaataggaacatgccctggagagcagatgggaaccgttccatcttgttgagttgctggcattttgcacctctgctgtctctgcagcaggcaactctttcttagccaggaaagccctttacgatggctttttctaaacctggactaaggatgagagggtgagtattactgatggttggcaggggatgagtgtgtattctgggttactgcttttgttaagtcgggcaccctccattttccctggccatggtgaaatgccccggccctctgctgctgcagcacaggagaggggtgggacactgaatatacttctcataaaaggtgtgtttctgaggtgctctgtcttgtgtgtcccttaacgatggggttactatggtaactatccatctgaaaaaaatgcaagagtaaacagaagataaagctcttgcttaactagctggaaggtggatctgtgcccctctttgttatccctacttgacacagctccctcctccctacccacagggctgagggcccaccctatggtggtaggagtatggagaggcagtaattttggcttgtgcagataaaagatgagctggggttttgcaaaaaggaagagtcttggattctggggctccttggtaaagaaggcaacagaatgacatccctgcccagctctttctaaggagctgagatgctcctccttctgcccctccttatccaccttgctactcactgtcacttacaggttggtccagtgtggcatccctgattcccagttgaatagcaaaacataagcatggtccttcaagtttctctaatggagaaactgaggctactgaacttttcagtcacaaagtaagagcataaaggggtaaagcttgcgaagccagggataatgtcctctagctcctggagaatccattttcaggtttctcaacccgatgtgcttacttctgggctactctgttgctttctgttctttacatactacctgccctcacccaagtcaggggcccaaccacactcttcaggtctttttatccatcattctcatttttcctgcacaaaaaaaaagtgaaggcagcactgcagaaaatatagaccacatccctcccctcctccccgaccaccaacggccactgagccttctctcagggagggccttcctccaacgttttgggcaggaagaggaaacaggccacctccactttcctgagaaactgtaccttcaaacgattttcttgccaaagggttgggcttaggacttagcaaaacaggtcaccactgtgggcattctccttctgcctcccttcctctctgttaatgagggggcagataaagcattcttggcacattatggtcagaagattgtaatccatcagcctcctcctgtatattctggctctgcagataccgatggcccaaaacttcgttgtggcctccaaaaggggaaggttgtggaagggaggggaagccagcaaagtgggctacagctcagtggtgcttgatatgcctctcaggccttcctgccgtgaggattctgcccagcacccatcgtggctgactctccttcatgttccattgctcccaggctctgtgttcttgttgggcttagactcttggtttggcatcctcttgggccgtgggcaggacagtggcattacggatgtgctctcccgcccatgaacacaggagaatgaaggccaagctgggctggccaggcaggcgcttctgcattcacagtacccagggcccaaggtcacataggcatcacaggcacctttttggcttggccaaggtgggcccatcactgctgggcattgggacactaccacgatcaatgatagggaagcttcagtgaaaatgctgggtggccatctccctcctccactggtaaactaaactgtgctgacactggtacagggaagggaatagcgttgtggagactgatgggtgaaagtgggaaatgtgagcccctccaccagattccatgtaagcactggctatcttgccttccaccctgccttagttttgtggctctcacatgtataaagcccaggtaagggaccctgtggcattctttatcactctctgtatcactggcatgtgtagccctgcaggcctgggaacactgagaagacaggggcctcctggtgccttgggtccctcctgccaagcacagagttgtgtgtcatcagtatggtgattactgagcaaaggaattcctgccttggatttagggggaaacctgctatttcaagtgtgtctgatctcctcccgcccctgcccccaaagctaatatgagagtttccttgagtagccaagcaatttttcagctttacacacatacagcaggttatttgcattgggtggagctgttagtacctcttaaaaatgcatgccctgtgtcataccgtaaatttttaacacacgatttttatgcagctagaattttcttcctagttatttcataatgattctgagtgctggtgttgctggagaaatctagtgtttacaacataactaaatattagaaattctttagtactgggaggaggtcagatttgagttgggcccagaagggtagcctagaatgacatcccagtgtgggcagaattgcagaagtggagaatataagatccattctgggtctatccgtatgcctcactaagaaaacaaggagacagtgatgaggttgacaggttaccaagagaactgtaatgccaaggagaaaaccaggttttgccaaagggtacttcctagttcccaccatctttggtgctgtggaaaacctgtcttgtcttgtgagactgtgcccagatggcaggtaaatcagctcttaacttagtactaactatgggttatgctcatagcccttctagtttttattttcttgcatacattttattttgaaaaatttcaaacatacagaatgtcaagaatacactgatttcatcaccttacatatttgtttccttgtgttaagaacttttaaaatctattattttagcaatttttaaatatacatgattgttaactatagttactattctgcacaatagatcattaaaacttcttctaactgaaactttatgtcctttgaccaacattcgccccgaccccacccccagtccctgattccacatagaaatgaattcatgctatatttgtccttctgtgcctggcttatttcacttagcataatgtcctccaggtttatccatgttgttgcaaatgacagaatttccttgaaagaggaatgttcttataatcatatacctagatttaacaactgttaacattttgccatatttgctttattccttagagctttttcagaatggagggcaagttgtaggcatcaagatgcttcacccctaaatacatcagcatgtatctcctaagaacaaggatgctccctacagaatggcaataccattattacacttaagaaaataatcccgtgtgtctgatacccagtccacattcagagctcttcagttgtctccaaaatgactttcctagcttttattaaaagaatcagaatttcatcaaggagtgacacattatatttggcttttacatctttttcaccttttgaatctacaacaacctccccccacacacacacactttaaaaaatgtatttgtgatgttgactttgtaaagaatccagtcacatccttccagttttgcatccagatgtgcaggcattcagcattgatgtaatcaacaaagatttaacaggcctcctcaatagcaagccatcctgtccttgaaactctaagcaggcatggtatactctcagggaccacactgaggactttgggtttggccctggtgacatctgcagtgctaactgcaagcaccctttctgggaaatgagagctggaactgggttcagatctcagccctcccactcactcactcagtgatcttcagctggtcccttctccctcagcttcagttccttcatctcccaaacaagggcattggacctggggcttcctaggtcccactcagctttgccattcagcacctctgtgactctgcccacagcttttcacctcagggtagctgcttcctgaagcagctgcctctgcccattcctggcactgtgaatgtggggaccggggcggggacacatggtcctctaacatgaccatacactcatctctgctccccacagcggagattctggagctggctggcaatgcagcgagagacaacaagaagggacgggtcacaccccggcacatcctgctggctgtggccaatgatgaagagctgaatcaggtatgggcctctcccatctcccactgatgtttgagcaggtggtcatactgcccaagaaacatagctgagaggctttggtgttggctggttatgaaaggtgtggactgccttttggattaattagcagcttctctgcctcccatggcagtttttccccaaggccttattgggagtgttgggggaagcaggataatacaaggtatttggctctcccgaaaggagagagatgatctaaattccatttgagtgagggactctggggactggatccctgagcagtgagcttgagtcctggcagcatcctcatggaggatgccatggaggaaggagctgcaccaacccaaagcaagactgtcctgggcagggctggcttcttgaaggttagaagcagggtatctggctcactatctgctattctggttttcctgaaagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaaggtatgtgatttggccagaatgtatgaagtgggataggatggggtacggataaacagggttaccagggcacccccctcattccccctgtgggctcatcccactgatgggagaataaaggaggaacatgtaggagctgattactctccagaggggctagtccaacacaagtagccagagtcaggaggccctcccagagtctggacccagttgaaggacagaacctctgtaggcaagggggatgggtggtgggctttcagggatagtgtcaagctggaaggactcccaagctggcccttccagggagatgcacacacctgtgggaagggggcttccctgtgttaggggacagccactgtctagtcctgtggccagctacctgcatgccctgatgctcagttgcagaactctcatgttgccatggctgcatgtcttccatcagggcgctctagacagttcactccagaatggttgcctctgtcaaggaggaaaatggatgtattactcaggtgcttcttcctgggcctaacttggattggctgggtcctaggtgctggaaaccctctcattagtgttatctaatgtcatcttgggtggagaaggccagcagactccaggtcatgatcctcagtgtggaggagcaccctccggaggtccaggcctgtgattgctgtgctcacctgtctgagcatgagctggagactacaaggcaactgggatacattttctttgttccttctttgcccagtcctacttgtcagcagttgtcacagcctccagagccaacaaacaatggacagtgccaccaaatcttggtctctaagaaaatggaatcttgaggctgccctgctctgaggtaccccttaaggagtcctccttctggcctccagccagatcaggaggaaattacccatggcagaaggtgacctctgtattttgcaagaccctcaataagaagtcctggaaatgcatctgtggaatctaatgatgcagtgtcaggaagttcttcctacatgagcccaaatcctctcacctgagtgagacagtgaggacaccttcccaggacaggctcaaggagctgtgaccaggtgaacagagctcctcctgtcctgtcagcatgtcctctcctttgagcctgcctgtgcctcaggcagactggctttcacccgcatgcagggacatcttctgtgaaccccaaccttcttgcatccacactgtttgtggcttttagttgaggtgaaagaggctgtatttctttgcatgcacaaaatctaaattcctcttgccaacatgccacccacccttaggcccagaatcactcccagctctttgagagagaaacccaatattgaggagtgtcctataagttatttccagacacttgcattccatctagctcacaagtcctggaagaggcttgaggccaggcagggatttcacagaatgcgccactgctcattcctgctaactatagaattagcagattggaaagtttctttttccctttcaacatatgcatttgggaggagggcggggaagggaaggcaggaggaaagtgcttgtgcaaccctttctaaatgttaaaaaggcaacgaagatactgaatctatcatcttttgattatgagccccagagacctggctgcccacagagcagggcccttggtgctgaggaccagcaggggcaggaccacgtcctcagcttagcctttgccctggctgtgtcctgagccatcaccctccttcatgcgttcactgttgatacttgagtgggtctctcagatgccagtgtctgctggcaaacctgggctgaatcttgttcctgttactctagtcttcccctagtagtttttgttctatgactttctgaactttccaatttagtaaacactaggaattcatcttactttttggacttgaagtatttggagtgggggtgtctttagctcctagtagctatatttggaacttagtgtttctaataaccatatgccaataatcactcgaccactcaaatttcccttgattacaaaagcaggaagcctgttatggtggtctgtttttcttccacacaataaaacacattgtctacttactgtaccagtatttggctaacattaaaccctgggggaagctgaaattggaaccgtgaacagctaattttcaaaacatttgtttaatgtaaattgtggtgtcagctcccagaaacagcagaaaagcctgcatctctaggtttaagtggaatgttctgaaaataacctttccagggacatgcagagaaagccttagtaacatgctaaagcacttgtagtgagagttggtatttttcaggtgtcaacacttgaattccaaatcataatttttcccacaattctacataatttggaggttttgaaaatctccaattgtgacagctgagtcagctgtagtggaaatggttggagaaggcaacaaactgcaccaggggctgggtgtccagagcctgactgtacactagggctcctctctacttgggtggcttcaggcaagtctgttccctctctatgcctcaatttacctccatctataaaatgatcaggtccattccagccttacaattcagtaaccgtatgcatattacataatgtttttgagtagggcacatgtatgagtttggacaaaagagtatgcagtaaaaaaaattttgctcccactgtagtccctcaccctacttctccccagggcacactcagtgagtttttatgtctcctttcagaaagtctgtgcatataaaagcatatagagatgtaaatccctccccatcctacttgctcttttttttttttttaaataaaaatcgtatgagccccctattttagcagtgtggcatagtgattaggggtgcaggctctggggttagctatttcctagctgcatgatcttggcaggttgcagaacatctctggtgttcagtttcctcatctttaaaaaggagatgtaacacaagtggttgtgaggcttaacagaattcatggaagtgcatagaaccatgtctggcacctgtgttcactgcccctgtcatattctgggcagtccttccatgtctctgcatgtagagctgctttagtgttgcataggatgactggtcacttatgtgatatataaaaacagtgtagccagctgaattagtccattcttacgctgctgtgaagaaaggcccaagacagcaatttataaagaaaagcagtttaattgagtcacagttccacatggctgggaaagcctcaggaaacttagaatcatggcaaaaggcacctcttcacaggacagcaggagagacaggagcaagcagtggaaatgccagacacttataaaaccatcaaatttcatgagaactcattcactgtcatgggaacagcacaggggaaaccatccaccatgatccagttacctccacctggtctcacccttgacacatggggattatggggattacaatttgaggtgagatttgggtggggggcacagagccaaaccatatcatcacccttctacaagtggacttttagattgttgtagcgttcattctgacaaacagtaactgtcattgtttgtggatctctgtcctcacatgcaagtaaatgtataggataaagtcctcaaagtgaacttactgaggcaaagagtgagtatatttttagctttggctattactcacttttagggcattttaactacattaatctcaaaaactgcctcatctttttaacatttaatactgagtttttaaaaaatgaatattcattagaccaatttgtatctagtctgtatgcactagttactattctcagtagtggagatgtggcagagaacaaagtccctgccttccctcagtgttcagggaggaggtgcagattcattacagaaggcaggagggagtagctgctatgacaaaaataaagtggcgtgatggcagagccagtattattttacataggcagtgaggtgaggttactctcatgatactggagcagagccccagcagagtaaggtatttggccattgaagtgactgggggcagagagctcctggcagaggaatggcaagtaggcctgaggtgggagcatgcctggcccctcttaagagaacgtgataggacttgcctgtggaatccctaacgtttttgtaacatggatacttttggcagtgagggaagcctggggacccttactcaagataaagattccaaatgcataaaataaaatacctaaaattcaaaggaaactatgcctaattttgtccctcaggttaagatccatcagatgtacgctaagaatcataggataactttcaggggatctctaagaagccagtttttgccaaacttttggataaataatgatctcaccagggattttttcaaacacaaaccatcaacaaacctcaccctatccccatgtgaaaactaccctcctagatcataaatataggcttgctccttaccacctggcaaaagcccaaggtgattttagtagagtgcctctttctcttgttgaggaataaatatttaaactgcaaattgagtgattaacgttctggtaagggaagccagagaaaggaattggttcgtttgagaagctactattagaaaaatttgctggccttctattgaaattttaggttgttcaaacattagaataagagactaaacataggtaaacatggggtgatgattttacataagtctttctggatgctcagttctacagtttcttaaatgtctcccagctgactctgacctaacaggttttctgctgctcagaacaaagctgggcgagtgtccaatacatggaaatttatgggtttgtaggacaatataaaattataacagtctttctggagctgacagaattgcttgctaacttttatttcccccaaactgagatatgaaaataatctaccacttagtagattccatttcatagaagaaagggcatttttttttattatactttaagttctagggtacatgtgcacaatgtgcaggtgtgttacatatgtatacatgtgcacaatgtgcaggtgtgttacgtatgtatacatgtgccatgttggtttgctgcacccattaactcgtcatttacattaggtatttctcctaatgctatccttcccccagccccacaccctcccacaggccctggtgtgtgatgttccccgccctgtgtctaagtgttctcattattcaattcccacctatgagtgagaacatgcggtgtttggttttctgtccttgtgatagtttgctgagaatgatggtttccagtttcatccatgtccctacaaaggccatctgacaaagggctaatatccagaatctacaaagaacttaaatttacaagaaaaaatcaaccccatcaaaaagtgggcaaaggatatgaacagacacttctcaaatgaagacatttatgcagccaacagacacatgaaaaaatgctcatcatcactggtcatcagagaaatgcaaatcaaaaccacaatgagataccatctcacaccagttagaatggtgatcattaaaaagtcaggaaacaacaggtgctgaagaggatgtggagaaataatgcttttacactgttggtgagagtgtaaactagttcaaccattgtggaagacagtgtggcgattcctcaaggatctagaactagaaataccatttgacccagccatcccattactgggtatatacccaaagggttataaatcatgctactataaagacacatgcacacatatgtttattgcagcactattcacaatagcagactcggaaccaacccaaatttccatcaatgatagactggattaagaaaatatggcacatatacaccatggaatactatgcagccataagaaagggcattttaataccaaaacattaggaagagacatgatttcagacaataggctttatgaaaaacttgggcatagttgctatgatttgaatgtgttaacacctcacaagcaactgtaacgaccttaagcacctgccctgttgtcccgttgggtgggtaccttgaagggaaaaggcagaagttttttgccaagtgggcaggctatataggaccaggcagtgatggcttgtctctggagtgctttactactttctaaggccagtcgtttaatcaggaactctccagtcttagtctcattttctttctttctttttttttttgtatttttggtagcagtggggttttgctgtgttgcccaggctggcatcctcctgccttggccccccacaaagtgttgggattacaggcatgagccaccactcccagacccagtcttattttccaaataaggaatctaaggcttagggaaagggagcagttttcgggtcatgctgttgggggagccaggacccaaatacagaacttcagagttcaaacttcagagtactatcacttttatgtcctgtgactgtttttaacagttggaaaatttacattattttctccttatttctcttttgcttgccccacaaactttcatcttaatgtaacacatttctattctattttttagttctgcaacaaaaataatgtatataaatttcaattttgaaaaagtgttttttgacttttataaaagcattaagtagtagattctacaagattggatagttagcacatttattaataatatacaattgatcaaactgacaaatgcattacaaattctaataactgttaaggaaaaggtaaaattttattggaaaaacatcttgtaatgggctgggtggattttttccccctaactagttcaggtatcctcagatgaatattacttattgttgaaatgaaacagggcttagcatcctatttttatatatttctaggtatgaatgtctggaaaatcttgttcactaaaaaaaattgaaatggaaagggttttgttatagcaacatcattcagtcctctgaactctttgatatatgccaacaatacatagtgtaatctcatcaatttgttttaataaacattttagaatagtgttagatttacatagcgttacaaagatagtacagagagttcttgaatatccctcacccagtttccccattgttaacatctcacataaccgtggtacacatggtcacaacaaggaaatcaacactggtccattactgttaacttcaccagtctattttctgaagatctatcagctgttaactcaattaggtattgcttcagttttgttgaaagcacaggattaaaaacacctgacttgtgaaagtctgttatgcagcctttcctattcttggctcctgaaaagtatatcaaaaagggcttcactaagatttaccatataattgttgattatacctgtttctctttcactcatcaaatgttaaacactcagtaggaaaatcaaaatagtgataatttgtaatgtatatttgccagtactatatttcttgataaagtgctttttctcttacttatagcataaccttggaacttgagatttagctcactaaatttagaaaaaatgtttgccatataacctaattgctaaagcagcccttattgttaaaagccattagcaaaagtagaccttacttttcattgtaagtaaaaaatgttaatatgctcctgttaatgaatttgaatcctaaataggcaaatggataggacacaggccttgcccagagtttattcagatttatccttcaggaaagcatggccatctgtaatatttctcaccccttctttctggattttctcccactagaccctccctcaggagtgaagtactttttattaataatttggggaagggaaaggtgaagtgtctaaatgaaaaccaatgttgttctcactatccttactctacaatttatttgaatgcagaaaatctccaaattagccaaagtatccatttctaatacaggctttgtccttaatagaaatatgccaaaaacacgcatccctactcccacagtggtgtgccatattagtatttactctgggaagtgggaggagggtagttatgaaaggagctctggcgtggcaccttgaccacaggtgtacttcttacggcagatcagttgtaggaaaatgttaggaagtagaggatcggaaagttgttttcttaaactctccatgtcatgtacctctctcagaagttccttgggaactccagggcatacatatttcagtcttaataatgctgaggaagaagctgaagaccaagccaagaaccatgggtcaaggggtctgcagggagacagatggttcatcacagccaccacatgcgtccttctctaacactggctttaaggaaggaagggtggaagcgagtctgaccttctggagtcaggaaggttagagggttatagtccttagtcggctttttgagaattagtgacctagaacagtttttcttcttaagcttgaatagtattacagacatctagaaaggaaagacacttaaagatccttaattaagagacatttacttggtctgaatttatgaaaatggttctattctaaatgatcactgtaaagtgaagttttacctttaagtggctggtttttttttacgatcataaagtgattaacatataacttaacacactccacagaactcttgtacctcaaaatgagtctgagctcccccttggagaaacgctgagaactggttgtggtttagtttcctgtttccccttgggtgttatgggtgaggcttgggagctgcctctctattaggatgcctgtgtctgtgtggcccacattctgacccttccgtctgtgcaagaagaagcagggtgaagtcagtaaggcagccagcgccgacagcacaaccgagggcacacctgccgacggcttcacagtcctctccaccaagagcctcttccttggccagaaggtaggcagatgcgcggcctcagtctactcgagggccccaagggacaggtgggcacaggctacttccactggaaggctggggggatcccgggggccactcccagcctcgtgggtagacagagtgggctgtgagctttgggagtggcctcagggagggctagatgctggggaggccacaatgctgagggaggaccctggcagctggggaagggagacagtggtaaaaaagaagagggcaggcagctcctgtgggagatggggacccttggttagtctggaggaggagctgcttctgtgggataaactggtcatcagatagcaccagccagggaatcaggcagaagtcaagccttggtggtggaaggtgaacaacctagccggcagcctgcttgtcctggggggcactaacggtagagcctcaggtctgattcagggctctacaggggattgttttcagactgtactgatgggtgcactgggtttcttcactgaaccaccagatgactcttccagctaattgtttgtttgttttaaccatgggcaatatattttcagccgccccagtgatgcaactttgccaggacgccatggttttgtaaaagacaattcacttttattgaaaataaaaatgatgcaaaggcttttaagacctgagaatgagagttaactaatatttctttattgacatcaaaaaggggtgggaagaaagaattaaactcttcttaattttttaatcctatacttaaagaattaaaggaatgaatttgacgttccaagttaatctgtgtttagtttgagtgtggtaacaaacttggatctgaagctgcatcatttttaaaccctcactgtcaatttcttttgcatcacagtgacacggttccctcgctcacgtcattgcaagttctcctcctacccctttccctctttctgtcactaattgcactctctctcatgatgcaattcctgtggtggactctgtgttccagaaaataaccattactgtttacatttttaaccattctttgtattttgtatgcatttttcaaaagaaaaagtagcactagttgtcatcttaaggtctggggatttgaaagtttttgttttaaaatattttttgttcctttaaaaatttcgactcagcagtgaagacaactgcctgggtctactttcacccctgtaacatattccttgggtaatgtattgaaagttaacgtgacccatccacattacttccatttgaaatacagagcagttcagcccttggggtcaccttctccctcttttccccactctgcccttaggcactcccaccctggcctctcccctgcctatgttcttgttacctcctgccagccactccaaaggcagcctcagatcagaattcctcatacctcccttgctggatgaactaaaatatttccaaagtagcagcaaatatggctgtaaaaatgtccatgcaaaatgcagatgcccttcttgttgctgtgatcttctgaaagaaatgggatcacggcctcctctgggctctgtttgttagccctggaggggagggggcaaacaccacagacatcttgctagcttctcccaagagccaggaacatgtcagctctcagcaactcaactcttccttttcagatacatctggtctcagggccaggcatcacacgaataaaaataaagtacagtagagtaaaattttggctaataatgactgttccctactcagagttggtagggtgaggatacaaaaagccatagaaaagtattgatactctataataaattacaaacatatcatttaatgttatttttaaaaatggagaatgaaagcagtgaacttagcttaacagtgaaattaatgtgcttatcttgacttttggaaggaaaatttgaaaggaatggttaagctgccacccagtataaaatggtcagccataagaggggctgaatgtagacccagacagaccacctagccttctttcccatatcaccccctttttagtggtgaaaacaaaacaccaggctaccaagaaactgcccttcctgtttaatgtgcttgtgactttatgatccaagagtcacatatccaggaagaggtacccaaaaatctagtgctgcagacactgtttagcagaataaactccatgtttccaaaataaagcagcatcttaagtcagcctaagcaccagtgttagaaactagggttccaactgccctttctggaatcctacacccctgcagcatgagacggagtgagcattgatacattagagcattattttgaagcattactttctggctttttattggctattactgtcaggtgaaaatcatggcatatagtgtaaaaaaggcaaaaatcatgaaactaacacacagtttttacaaaaagcacatttaaaatattatagacattaattttgacttggattttaggaaatgtttcaaaaggggtactttagaatggtgactatatggtaccctgtgtcctatgaatctcatttttctatctgtgacactgaaaccagtgcttgaagattgcaagcaagctggggtggagaaaggtgatattgtgcatgctacagccctgtaaggcatggttgctaagctactcaggaagcatggcccaggcttaggagcctgaccattgatgttaatgatgtatttcacatactgaagtctcaggagtcatcatagccattactctctgattttgcccaatgttcacacacattgttgaattgttttaaaaaagaaatcagtgctgtgaatctgagtcaactaaatgcttttgctttgtgttcagccaagatttgcagccttttttcagaggttttaaaattttcagaaaaaacatttctaatgtgtctaatgtgtcagtggtaacactgacttaatggtaaatggtaaatgatttaagtttccttgtcagagtcagtattatttgaaggagttaggaaggcagtctgaggctgtgatgagtctccttacctcccaaatgatcaagatggcaaccccagctcgcaagccattcaaggcgggcataacgtaccatgggttttctccctttgatccacatacccttctcccgggagctggaagaactgtgaggagaaagggagctcttgaagttgaagcatcagtgaggagaaaaaccattcaccccttccccccactatggctgaggactggcttctgagacagtttaggaaactgacaaagccatgaaggaatggctcagctatcgaccatctggacatccagcagtatctatccatgtccttatctttgtggggctctttctagctggacacactagattctgcccggcccaaggcctctggagaaatccagcttgggcatgcatgcatgcagggagagccacacagcacagctgtgagggcaggagccagccctggagtgtgccccagggaagacacagctctcaggaggagactggaaagggtcctatggaagacattgcccttcccattcccctcgttgaagtgaactttggggacaggaaaataactgcattttaggtggtcagccaggcttccttccttatctgttatgagaaaatgagagacaccaaaatctgacagttacaggctagatttaacatactactcaggcactatctttaacagccactttcattaactaaaattgggtttctaatcatatttttttaaaagaaccaagaaggaatgtactatttcctgtagccaagtaggtcaggtcaggcagtctgcatgtccatccagacactccttccctgtcatcatcgacagaccgcctcctgccctgccctaaatggtgggggccagcctcccatccaggcgaggacagcttggctctgagccacctcagatacaagccaggcccagggctcaatttctgagctctggcatttccattaacaatgccttaaaggaaagcaagcaggggcagtcattttatgagttatatctaaggatgtttgatgttcagttctaactctacatgcccaggggaaccccagcactggcttaggcactgtgcagcactcagggttagggggccacacccactcctgccttcaaagagattatactctgatgagcatataccatgagtaaagaacaagggtttccacggacatcctcaccacagggaagactcgggtactgcttgtatcagaagctggcccagcagagccagtgaggttaggattatcggatcccagtgctggaagggatcttgaaggtcccttggctacgaccctttctgccaactgtgcagccacgcggggacccccttctgctctataactggcagtgccctatgattactttcctcagtggctaacagtcttcatagctgctttaaattcctcatgctgtggtttaaaacttagttttccatctttcctaacgacggtacaaagaagcagtcaccttattcaaattctgaaaccattaatgatccttattcctcccagaaaatcagactaattttgggaatttttacagttcccagaaatctgatttcctaacccacaaggaccacttctctgccatgtacttcagatggacacacacccctctggctgataaaccccactggatctgaccctggctggtgggaggggaccctggggcctcctaggactggacctctgtcttggctctatctcgcttattcatttgtgactggacagtgggagcctgtccagacacatgtgtacctggtccatttgcacgctatgctcatgggctttcttctgtatagtggagctactgtcttcgttcatgatcatctcactgtcagcttctgcccactggcccacctgccaagctgattacccatttgtccttccaaagtacttgaattaatttgtcttctccccttcccattctcttcccctgatgcacacatcccaagcacacactttctagtcaagattgtttaaaaatacatatttgtacacattttacagcaaaaaaacttttgtggctcagctgcataccctgaggacttctgctgagccccagtgcatagcagagcatagttggaaaatcacagctctagcctcatccacagatgtgaagagtgaaacagcacttggttggcaggaaatcctcaatgctgagtagtagtggctccctgaggtactgtagtctgcacttccaagagtggggatgcctctggtcagaagggaaggtagtgagtccaaaggaagctgagaattctccatgagcttgagttctgttcgcaactgctcccttccttcagcaaatccaagtttcccccagagaatcccattcccctagacagagcaggtggttctcccgcgaagagagtcagatacaggccactgagggggtcttcctggctagctgaagcagagcccgccaaaatagcttcttttccaatgaaacatttctgaatataacaccagaagcatctatacaattggaaaaaattgcgtgaattttaaggattgaacatgtattgttttaaacataggaatttataggtgccttaaaagcatacacatccacattacactgagtagatcgagtctttttctcctttgcctgccttcctcaccaacctcctgcctcttcacactgtgtggggtgtgttttggtggtgtgtggtggggagtattggcttaatttgagtttttgtaaatagcatttgcttggagccaaatgcagaactaaataatagagtaaaatcctttgccttgttctaaatcctgagagttcacttgccttaccctaaggcccccgactctgtgcccacccacacccctactccccagtggcagcagtcaggccccagcccccatgctgtctcttttctgtgcctctgtcctggtgccagggctctgagctgctgagagcttcgctttgtgagatcacccccatggcttccttcagcttcaagggtgtgggtggcctctaaatcactctatagtgcgaggagcaataacccagaaagtccatatgaataatacttggtcctcttctctgagtctttaaccaaaaatgaagtccactgccctggccagaattcttccttggctgtttgacaaaacttaattccacaactgtttcctcccagaggatgactcttagtgtaagcacatccctctttgagaatctgactgtttctgggaatcaaaaatgtgggtttatatttccgatacttctggagtgccaggttgtttggttttgttttcaacaaaatgtttggccctagaaatgcagcaacttgctctgttgccaggagcttccctgccaagtgtcttgtgcacagccctctcctgggtgagctcctggacaaagcctcatgccctggtaaaccctgcagactgcagccactattctggcctaggtcatagtcttgagcaccagctctgctagggctactcaggcattgcacttgtctgcaggtgttaggaatttatgttactgaagagtgagcaatgtcattgtgagagcatgtgcaagagcaagctttcctgcaatacctaaagaaaagcaaggggaatagtaggacctgggacagcagtcctaggcccattaattccccttgcccctctgacagaatttcgaactcagtattcttcgaatactcagatgccagggttgccattgtaacagaataacagtggctgggggacacccattcagtggctcttcagaaagaacaaattcactgggtggatataacacttaaggaaaatgctcaataagccacccattgagtctcagagcaacctgaccaacaaggtgaaaaccatttaaaagacacattgtcttgctggagaaccttcctcccctgggtttcaccatggaacttcagcattacatgactaatgggcacgtaaattaaatgttactaagcaagagactattctcacttcttgccaccctgagcagggcagggaagccagccagcagtcacagtgatggggacagccttaaaggcccatagtcacttggaagacaatggcagagcccttaggggtttgcccaagccaggtaggatgttagcaccagcctagtgctcaaggatgaggacagtcacatccaccagcccccaaccctcagcaatgagtactcattctaggtcctgatagctgccttactttggcccccagatcacaagtccctttaaaggaaagctgatctcctcgtccactgtggcttgtgcttccttttgtcccaggtgccacccacgggctctgaacattcatcctagtttgcttgctcccgcatcccgagcagcatttgagtcttatgtttgaaatgggttcatttgagccagcaactccctgcttcccttttgtgcctcgtgcacttggagtgtccactgtcctttacctgtatcccaaggctccttctctgagacttcccagctctcctgttatttcccacctcatgcttttctttgcagctgaaccttattcacagtgaaatcagtaatttagccggctttgaggtggaggccataatcaatcctaccaatgctgacattgaccttaaagatgacctaggtaattggggacggggttcggcaccaccagctgtcagatgaaaagttatggaacccagaatttaggcatttcatcttcccagactttacagtggtcaagccaaatttccaaatccaagattgatatttgagtgtagacgctgaatatcaacttactccaggccattccaagtgtaaacggtctgtttcattaagtgtgattggctactctctcctcaattgcaaatacattgccatctgaattctcttccataatgatcaaactgactgctggttacttggggagggatttttaaacgtgttggtttttgtttgtttttttgtttttactttagaactgaaaaatctcaggtaactacaaaatgatagtttctccatttaaaccttaattagaaatgacaaagcttgaaagagaagacaggccacatcagtatgctattaagctgtctttagtccacaatttactaccatcacttcaacttttctttagaactgaaaacagtatatgactgaatgccaccttcttgaattatttggctagaggatggtattaaacagaagggcaatatctccaagtgagttcttatggaggaaaactgccccagagccatggtgtctccctgttcaagatggcagatggttcagggcagactgagaggtgcccctcaagtgtcctgcctctatggctttatctttgcatatgtggcactgtcagctcaatggcacgacagggctgctctgctgctcttcgatgtagaggcttgccaggggaaataggcacacagatgcagcctccttcctaaccctcaactgcaatctattttgtatcccttgagctctcagcttctgctgtttttgtcagatagcagacttccttactgggagatacactcattccatgggcccaggcctgacccacacgaactgggtgcaacagtgggctgaaaacatgaggactggactcaagagtgtccagcttgaacttgttttccaactgccttatacagatacttaaaaaaaaaaaggccacaagctagaaaaagcaaggattctatccaaagcacattttatactaaaatacaaaggccaggtgcagtggctcacacctgtaactccagcgttttgggaggctgaggcaggaggattgagtgaggccaggagttggagaccaacctgggcaagatagtgagacctcatctctacaaaaaataaaaaacttagctgggcttggtgacacgtgcctgtagtctcagctactcaggaggctgaggcaggaggattgcttgagcccaggagttcgaagctgcagtgagctatgattgtgccactgcactccagcctaggcaacagcaagatcctatctgtaaaaaaaaaaaaaaaaaaaaaaaaaaaaaaaaaaaaaattaaaccataaaaataagataggctagagtaagagatgggcctggaaaaatattgatagagatcggcccatatgttgaggggaaaaaataaaggcagtcctctacatatatcaatactgttctctgggttttcaagagaaatcccttgaaggtagacaaaatggtaaatgtcacaagaataaaaatcaaagcctgcaagttgactgctgcagacagaatggagaaacttgttgttttggttggcctgatggtccactttttttttttttaaacagatgccatgttttagtagccttctcagtgggatgccagctttataggcttttgcgaagtgaaacggggcattcattttatttcttttaacctttggaaatgatctcatgtgtgtgtttctctttttttggacttctcattcaaatgtttaatttaaacatgtcacatttgatattcctcctcctcctgtcctcacccccatccacatgtgcgcacactgcgtggactgattgccccttgggctcatatgttggaatcgaccaggtaggccagccctgccattggggcattagtaaatgtgcctgtgcgtgggtctcggtccaacacagttgatatacatttgtttacctgttatagttgcaagttgtacaggctgacattgcctcgatcgacagtgatgctgtcgttcacccgacaaacactgacttctacatcggtggtgaagtaggtaatgcctagccgggtgctgccgagtgtgtgtgtgcatggtcagtcggccgctgcagacagcttgatcctttgacagctatgcagggctgcattcatttcacacttccagctgtcctgaccctgtctcctgtccctgggttgtgaacctgagtaataaagctagctgtcagccaggatgtcatgcatcctggctgatgcagctcacaaatggacatttctggtttgaaaactggttcagcagaatcgtttcttcacctgccccacaaggcacagctttgttggagactgggttcacagatgatttcagctgcaggaacaatacaggcacatggactgagtgacaaccaagaccatctccatgcactctgaagagcagacagacacatatgcctgtgcacaggtcaccacccccactcccctgacccccgccaatctgtctccatgtcagaagcacacttgttcctgaaaatggccttaaagcctcaggtgcacaaggaggaccctttccaaatgcttgcccacacttagggttctcagacttcaggtacatgaaaatcacctcaatctgacatggtatccttagaccactcatgagaaacatcatcctagacccagaaagcaccttcctttcccttggcagctgataaggcattgttggttgattcctggtgtgctaaatagctgagggtggccaagaaagagggcacttgagatgccatatcctgaggctgcagattcctggcaggagtatcaaatagtgtcctgctttaagaacacactgagggacctgagggggaggcacccatgtgtgatagaaaaaaagcacagctttagagctaggtggaaggaactggaatcctactgtcaccatttactgatcatagggcctggtcaagtcacttaactcctcagtgcttcaggttccctatctattaagtaatggtaatgatgggaattacattaaatgtaagcaaagcaccttgttttgtaaagcctggctcatgattggtgcctgctgtaaggtatcactcatgtgtatatataatttttatagtaaatgtactggtcctgagagcagccctctgagtgtggattcaaataccagcttccaaagagaatggttacatttccagtcagcagacagtgaagtcatctggaaggatgaggagatcaggattttcacaagcgtcctggatgctagatgtgcagtagctcacaatctctggctgcctggctctgcttggcatcactagcaaagactgctgttcagtcttccccagccactgcaatttggactaatcactctcctgggcactttggattttggacatggatggaaagacaaactggatggaaagtcagaatttgccaagtctgccaggccaaaatgaaatcgggctgtaagcagttaaactcccctttcacaagactttggaggagttaaagagctccaaagtcaggcagcttaagggaaagatgcttcctttttaaaccaaatgaaaatttgatagaaaggaagtacttatttagagaaaaataaatgaacagctaagggcttgtctttgtcatagctgggagtgactaaggcctgggttcatcctgccattcaggacatttggtgaaatgggaattatgaaactttccaggcaaaagtatcttacccaggtccagggagaggagaaagttggcctgcctgctgcagcctgaggaaggccgtgcccagcaggattagccatgccaggaggcagagttgcagctttgagatagggctgaagccttgaggaagtaacaggcagacccagctgtgccacccagaagagcccagtccttcctgaattgtgactggaatgggtctctttggaataaggatggtgctaatgcttttcctctgacatgttcacctacaactcattgataggcacagggtggggaattattagcttccaagccacaggagcaatctgggcccaggaccctggcacacatcattcaccgacactgtaacacctgcagaaatcctcagcaggttcagacaccccaactggccaaggcagaaagactgccaggtcagaacccagtcttccaaagcccttcagggcttttctgcccagcggaccagtccaaaccagtattgaccccagatatcttttacaatcccaatgataaaccagattcctacatggcctcaattggttccagctcccactttgatgtgtgagaggagaaaagaggaagctagtaatcactccatttctcatatttggtgtgaagtcctgagactgctggaagaaggaatccgagtgcaggaatgcttagccccagtgattaacttttacccatcaaaagttctttctaacagtgaaatagaccacaggcctagcctgacatttgtccaagcctaaattttcgcttaggctgttttgaacactgatacttatgcctgctttctaagcatgaaataatgtccttgttctcatgggagtaacacatgtttatgcttgggggcaaataagccaattgctttatgattaaccctgaagttaagcctaaaaagcaagagtcttacaataagagtgttgacaatatggttgaaaatgggcctgtttcttgttaaaaagtacatgtgtgtctacatgaacatgtgcatacatatgtgtgtgtaggagtcaagtcctgactgggttgattgcctgcaatctagggttcagtttttaagtttgggaaatgcatttaagtgtattttaacttggaaatttcacttttacttaaagcaatatttataagtaaaaattttaaacactcttcctaagataaaacacctttaattatagatcagcccattttcttaaatattttagaaaggagttggtaatcatgataaagtaaaaacattattttacctttcaaatttctcagttctcaccaaagagttaatctgataaagactgagaatgctaactagtccagcctccagcatttttgttgccctgcctcaagctggagaatgggtttaagacagaaggctagactgggccccaggggcagcagtgtgtggaatccagctggttccggctccagattcctttttctcagctgcagggatagtttaggtgaacctgtattggggtctcactcgcctgggttgcatccactttgtagtggtggagttgggctctaagcccccggcctgcttcctccagtgcatgccccattcagctgccacctctgatgctgactttactagaaacatgcagcagcaacaggtgtgacattctcactctgccatttaaagcctgtgctgctttccaggacaggtagaggcaggagggcagtctgagatcatgaagggtaacacaaaatcccacctcaaggatgctaagtttgtgccaccctctctcggacacagctgagagctcccctgggctatggctgctggtcatgttcatctgcacaccccaggtttcctacagcgggtgggtacaggcccagtcctagccattagccctggttcttatttgggacaaagcccaagctatttactcttcttcccagacacctcccggggttagttcacccctgcagaacaaacattcaaaggaggcaagtttcactaagataattaaccctggtcatcgcagggtgactccaaagagaatttgggctggtgcattccgatgcaccttgaccgtcccataccagaattgtgccaggtgcacctggaattttccaagacagatgtgaatcttaaggggagtattttgtcctcttgtgaggaaaagtactttaaaatgtgcaaaactgaggaatcagagcttaaggaagactcagaccccattctggccaaacttgaaaggctgatcttgttgctaactttgattgccacttgctatcccacatgagcatcaacccagagttctcataggtgttggtgatcttgtttgggaacttggttttcacagcaggaactgattacttagcaagtgccctaattgaagaaaacacattgctcccaatctccattggcttttgtgaaaaatctggtcctgagcagttagacatcctcctttccaagctttttatagaacacagattaatctttaagctctgcttctgatgttgcccttctttactgaaaacaattctgaatcattagtgtaattaagaaaataccgtctgaggccatttttattttgtatttgcatatgacaccaaagctgcaaaacaggaactaagcatggtaataatgctggtccaaaggtggccaggtatgaacacttccttctaggcctgctgccaggaggagagctggcttattgatgggagcattgtatgctgctgaaacctccttacttgggggttctccccagagacagagaagaaaacctaaggcaggcattagtcttggaaaccagtaccagctagtatctcatgccaatgaaaagcatccaggacaagcatgtttgcaaaaaacaagcatgtcctgtctctttcacatctctggcacatccatgatcaccctgagtcagacccaaataaggggcagcagagacagccagatgaagcagcaatttgagggtagtaactggtgatgacaaagcccttctcaattttactttattaacttagccaaggcttagttcctgttttgcagcctgatggaaatttaatagatcatttgaagtatgtaatcacctgacatgctaagtgtctgtgtgtgccggagacacagaatggcaacctgaccccaccctgtccttgtctaggaaacacgctggagaagaaaggtggcaaggagtttgtggaagctgtcctggaactccggaaaaagaacgggcccttggaagtagctggaggtgaggtgggaaagccaccgtgcttatctggttgtgacacatgcagtattaggaaagccattttgtgagagggcttagaattcagaggtgtgtggcagcacagccgcatcttcaagatggaggccaaggacagcctgtagctttacatcttagagtttcaccacatgcaggttgtctgggaaaatcacctttgcatttttttttattacttaaaatagctcctatatgtttgatgtctagatcacaaattttaagaaattataggagctgagtttggtacatctaagagctgagagtgagtgatactgagccatctgcaaaactgctggtgagagatacaaattaaaaatcttcagccatctgtgtgtgtaagaggaaacatataaatacacatttctcatttgccaattacaccttccctggtataaggggaagaaaacgacttggcatctgatgtggggagaattattgctaagacctggaggcagggtacttcttactgcttcaggcctgaatttaggtggtcatttggggtgtgcaggacagagcacctcctaaggacctgagagtccagtcagtggggaggcccagctcccccaccaactgtgtgaggacagatcacccacttcctcacttggggctctggttttctcttcttactacccgattccaatgcctattgtgtcttttaaatcctctgttttaaaaatgaatcttaagctctctcggagggtccaccaggccgtgcacctctattcccagtgacaaatgacaccccttccaggctagtctcaggatccagtaggattccctttgctgatctgtgcctttgacctctgctctgccacttctgttttacctgcaaggggcatgacatacagggtagtaattatgaagttctcccaggcagttccaccaaagtcccacattgtacaagggaaggcatacacagttttaactacctagccaggggcagctggcctttccccaggccctttaaaacacctgtttgaccagcctgtgggtcctttcccatcggggttccagcttgagtcctgctggtagcccttggcacaaggcctggtaggcagcctggtgctgccatgtaccaaactctgctggggaaacctcagccacagcagatgcaaacccattaggtatagcatggttcaagatatttttgcttgtttcaataacacttttgttcttgattttaagggctattttagaaactgctttaaaatatttttgaaagtataaagaggtgaataaaacatactcctgttccactgtgcaaagatagtcactgttaatgtttctttccagtcgttttctatgcatagtttagccatgacttctcatggggacaaacccactggtttaattcaacccccaatgtcaggtttttataggtcagcccagagttctcaagcccagtcacaaagcagagccaggactcaaattcacaccctgtgactgagctgtttccactgtaccatgagacactacccacaaatcgctccttctccagtatctatgacacgaccataacaaaccataccccttggacagatattccttaaaaaaaaaaaaagtttcagaaatagccaaccaaatacaaaaagtttggatgttttactttagcagtggtgtggagactctggtgtgctcttgtatagaagcgtagcatgcagctaaacccagtgccctggaaaccttctttgcagagcatctgtggacaggggttctggaacatgctctgggagacatggtactttgcagtttgtggcagaccccaggcctgtgtccttagatctggcaagggaaaggcaagtctttggtggagatgtatagctagaaaggggcccctcttctaggaaaagaaaaacacagttccttaaaaactaatctaattctgccacaaataaacaggatccgttattcacacagtgaggccatcctcagcagggagaagacaatggcagagtggagatgctggtcaggttgcttagcagatcatttaaagcagttgctttcctagtagctttgtcctgaattgggtttgggagatttagagaatacatcatagtagagacaaatacatcatattggtgtgcaagtcgataattagcacaccagtcgacttgaagaagaagggttggaaacccaaaacaattattttgaggctgcaaatgttctgacacgttgagtttgcgttcagttgagttttgatggataaggctctgcctctgggagaaccgtgtatgctttctgagagtggagagaggcttactacgaacttggtcaaaattcctggtggtgacacatcataatgccaactttccaagggtgtggcttggctccagctcacgttggaatcacaacgcagcagacagctgtggaactcctcggacacagggcattggagggcccaggaagatataccgtggcaggggagtgggtctgtgtttggcatcttgtgctttgcagtgaaccagagctcactgtttctgtttcatccccgcaccactagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggtaggggcacatgcttgttacgtatcggtcatgggtgtgtctctctgcgcacacatggcccataattgtggtgctctcactctgtgcaaggcccacggaggctgccttaaccaaggagaccagaagcacaacacagggaagaatgcagacattaaatgatggtgagggacaattagagagacccaaatcccaaggatgatataaaacttaagttttgatagcaaatgtcatcacagaaggggaacccagtgtgtactgggaccacagaaatggtacctcagagagtaagttttgaggggcacagtgacttgggtggagaagatctggaggcgtgaatacagggatacaaacgaacagcttggctgtctcagaataaggctatagctgtgttatggtctgtcccccaaaccacagtattctttggataaagccctctgcccctttcctttctactcacaagtatatttcacctcctgagaacctgcatctctacctgactccctgtcttactgccctagggtaaccctgctggcctgctaatgaggtaatgggacctggtggaacggaatggggaattacgtgagattgaaacagggctgggccctactccacttcctgtcccagaaaatccccaggtagactcaccaaggtcttcacgaccaacacagttgcccctaagacatacacatacccggaggaccaccacaggagaagtctagtttttcgacagctgatgatgcaggtagggctcagggcaacccccacaatacctacctggttgtacaccccacacatgtcagcaaataacctatcaggttcctgcctgttggagcagcactgcactctggcttaggggtcaggcctggagttgcatcctggcttggccactaacccggtgagtgatgacatgtaaattaacccccattctgagaagttggcataataatccccccatgcagtatctcagggttgctctagaaattaaaggagctcttagaaggcagagtgctttcagaagtgtgtcccatgatgcagacatgaggacctgtcagggcagagccacctctgagattgtgtcccactgcccattgctagggtcctccctaccaagggtctaagtccaagagtccaaggcctctggaaggctcgaggtctgcattgggcactgaagcaaagagaaactggcctttagaggctgtagctgttaacaacttgcgcccaagaggagccataacctggggttctgtattggcaggtggcttgctttggacagagtacctgccactgctcctggggcttcccatcccagcttgtgagccttctggggtctctgcccatcagcccctcccagcacccaaggaaggcagggctgtgcagcatcaactgcctatgacactgcaggctgtcccttctgggcgagcctgagcaacagtcctcagaaccatgtcctgaactgacagctgctctctgcaaagcactttccttccaaactttctagaggatagagagtagattttgccattttccgcttaggcaggcctcgtgattttgcctcctgcatgctgccatcactgaggtcccacacctcaagtactggtggcagaactagtacagagtgggcttcctgtcacttgacattctgcctagtaaaaggccttgtccacaggcagatgggcactgccaccgttccccagggctttctatggccaaggccatgtgtgactggcaggacccaccagtaccaggctctggggaaagatctctggttgcacctgaaccttctctggagcctgtatcactgcccgccacccgccgccacccccacttctcccagtcaagggcaaaacagcagaatgagcatttccccagcaacccctcaccagttgttgagctatgggcaggcttgcctcccccttccctggcctcacatctctgggctgtctggtcctggggttctgtgagtgaggcccctcagctctcctatcctgtgtgacctttggttaaatgaatcagcctctctgccctggtctgccttatcagcaagtgaggctatagggactgcccatcctcacaaatggttctgaggctcagttaattagtgctttcaatgcactttgatctgctctgatgaaaggtgcttccgcagagggaggcaataggaaactttattggaggtaataatttcacaacctttcatatgggtattgggaaatttttaattgaagcataaaagtaattctcataaaagagcatctgttattacaaacttatttacatttttcatggagtaaaaagtaggaataaaaataatcaattgaaagcttgaagagggggaaatgcctaaggcagcacatgtgtacagctacccaggccacatctgccaggcagacctcaccccatagagctgtgtaaacagctgccctctctttcatgagtaaaaaaaaatgggattacaccagagccggccagtaaatcacagtgggttttaggaggggaaataaaacagcttgtttgttgcatccagtgtctctggcacggaagtaatgttggaattaaaacagtataaaggtaagcatgttgggaaagagccattggtaaaggatcactctcttagctgaggcccagtggcacagcctacatggatggaagatgaccataaccacacctgtgtgatggctccctccagcctgtgaggccctggcatctggacatcctgtcctcagccattctggtcacgatatttatggatacccccactccctcagctctgtttcacattaggggtgacccctctccagaggggtagtacatagggaatactagtttggggctttgattaaactttccttagatttataagcttaaaaggaaaagctggtttatttttttcaagctactatttatgggtatgtgttgagccccaggcgcggtgctaaaccctttatctgcattatctcacagcaaccctacaaggtgaacagcattattcctttcaagggcaaagaaactgaagcatagaggggttaagtaaatcatctgaggtcactcaacttgtacttggtagagtgagaatttgatcagaagcccttcgcttcagagctgttaggctcatggaacccctgcctcccatctccattggtcagccagaccccaggtcccaccacctcatcccaccataggactgccccctgcctgcgtactctctgtgcataaaacactacctgggaactccctgacctgcccaagtatagccatcagcctctttcccctcctaagcattggcctcagaggtgagataaaaggacagaaactcaagagacctttgaatgggggagaatttttcatttacccaaagcccgggggcctggagtgggaggccactttggggctgccccatcccctctctagctgcagggggcacagctcaggggagtggtggccccatcaccatcgcttctgaatgttctccctcctgtataccattgctctcggctcaggatcctgatgacttggatcaaagtggcctgtggctggggcaacttcaacctggcaattactaaaaaatggtaaaggcctaagagcagcccacagcacagtgcgagggggacctaatcttagcagaagaatgtctataccctaagtgacagacaaagaataccagaatccacctctactcctccccagccgtcaattgcaagctcgcaatctgtctgctccagaaaaatctccctggactcccaggatacagcctctcctgctgtgactctctgaggtccctaatgagctcctagcctggatttgctgcatacctgcctggccccagccctggaaggtgagctcactgagagcaggggtgcttagtgaagtcccactcaaggagagggctgagaagagctgggatgtggtccttggtgcacctagagtccctgcgtgtccagacaggaccgtgggacaagcatccaatgcgtacaccccccagccattactgaggaggctgacccaagagggcatcttgcactggccctgggaaactgaggtccaggactcttgggaaaggcaaagggcattacagacacaactggagtgaatttagggaaagctcagatgtctctttagtctgcttaaggtcctagccctatggtgtaggaaactcttgactccagaggaacttaaggaacatgccataaacacaacccacaggccaggtcaggggctgaagagagagtggaaacaacaaacagtgcacgcatctcccaggtggggctgatggtggccgcagtactggcagcctcatcatcaccaccattgtcatcactgcacagacccctgaaacacctaatttctagtggaggaaattaatgcttagagaggttaacaccctggcccaaagcagctgggattcaaacccaattctgactctagagtggaagcccttagtccctcttgctctgcaacatctgatctgaaagataggcagcacagctgtaggacagagtggctggcacagaggccaggccaggcaggaatggctattcagaggggccgtggttatgcaagtagcaagtgaacccagctgagaagccaaagatgcaacaccagtgggcatgactgctcctgaaagcagtcagtactgcactggggagcctctatgtagcccctgctgctgcatgcccacggtcacggccagcagctctctggggtctgaggccaacattgttagcaccgtgtaactgcaacgacaacagcagttacccagtcacagctatcccagggacgagggtggaaggggcagttttctactgcatgagccttttaaaagacccttcaaagccacctactttatagacagctcctcttaactgaagactctctgtgccatgccccggtgctttgcattttcttgtcccagactctgattccatttcacaggatggggaaacaaggcaccgaagtgggaccacaactcaaatcctgtgtgactccgggaaatcctgagctcttaaccactctgcttctctaccctggagggagtagggctgtcaggccacccaagcctcagaggcagacctgggtctgacctgcctcagctgctgcatgtgccaccgctgcctctgtctggaggctgcagggctgtgtgtggagtgctcttgcagggcatccacctacacattccattttgctacaagcattctaactggcagcaagacattttgaggcccaccagaaaacgttaggaaagccgttacctccgccattccttcctggcagcctgcgcagtccagagcagccacagtcccatagcagggtttcttccttaggctgtagcttcctaggacagagggatggatttgtcaacaaagggttgtcctggaaacaaatccagattcatgttcacccaccaacaaccctgaaatgcttgcaaggccagggacattccggtggaaccgtctgctctctattaacgggacggtaggcaggtgtgggcactgcaagtctaaaacatttgatactgacctctctcccccacttgcagatcctcaacatctgggtccaccctgccagcttggattataaagtccatgctggctatttgtagaacagcagttctcaaaagctgctagacctgctgaatcaaactgttgtgttttgacaagctctccagaattctgatgcaggctaaagcttgagaactattgatgtagaggaatagaaaagaatatttcctcactgaaagtcacatactcttttgtaagggtccaaggcagaggcaaggaaagcctcaggaggggtctgtgtcagaaagcactggtcacaggcaggagtgactggcacacttttggtgtgttccagggagaccccttgggacctcccagtcagcatggcatggcatgggcatgggccaggctacactgtgtctgcatcataccacatctcacccagcttgtgtgggatgtagctaaccgttgttggagacagctgcctgggcatgcagcccggctgcagctacagaagccctgccccagggctagctcagctaggcagaacatcgggccacctgacaactgctgtttgcagtagctccacaggccctcagcccagcccagctccctgtgcacgtgtgaggctgagacaggcaagagggcacctcactgtagggaccttggagctggcagagcatggtcttgggattcacatgcaaaatgcaacttctcacagctcctctcagcaccctgcagcccccgttgatccaggtcacatccacagactgggctctgcctgctccagaagcccttggcccctaagtacaggctgcaacaggaccgaggatcccagcccacagttagaagcagcctgagctgctggaaagatgccccccaaaaatggaagattgagtttttatctcctcaagcaattctcaacgtggctcattccagataacctgtcctctgtgctccttgactcctgtgaatatagtcagggcagctctgcctggtgtgggccaagatttcagatctgcaaacagcactggtgccagaggaatgacctgcccactctcagcagagcccttttctttcactatacatgccgccctccatcctggcccacctgttagtctagtctagaatcaccagggtctcccgggaggaagctgcgcaggtctaacaccactctcgtggccagagcggctctggagctctgacccctctcatgggaagagttgtatgcgctggctgctctgtggctgaggagctgccgcctgtgtgtgaaggaaccctgggttgccccccactaattgcccgcaggctccttcacataggctgggggcacatctcttgtcctctaagagtgaactccactcctgaggcatccagaagctcctaagtctccaccagccgggtgaagccgtgtgtggtcaaaagcaagtcacaagagggtttcccctgtggctgtgaaatgcactgtgcactgtcaacagtggatcgctgagatgttccagggccaagccaggaggttcagagtgcacaggcatgcagtgagtgaagctagcagtactacagtagatacccaccttaccacctctggaaacccctccacctggcagcaggtgcctcatgtgagggagagctccagctgaaataggcgggttggcccagcgctttggacaccaacacgcccacaggctcaggcggatctgtgactgtagatctgccaatgaacaaagagcctacccatgagagctggccccagactcaccctcagtatccttaactgtaaaatgggaccagtaagggatgtgaatccagggccactggctctaaacccaggttttcactagaccaggcaagctgcccatctcctccggggtcccctgggctacccacatgccatgctgaccaggagcagcctcaggcacaccacagagcagtgagggccagtcttgccagtcctgatttcacatttttaagtccagagcacctacctccaaaaattgccacgacatttatttgaagtggaaatgtgtgtggattcaaacacatttggcttggaaacttggatgatagcccagagttgaagagcccacagctccctgcgttctggcctctggggtggtaccgctggtgtgtgttagagggtggattcctgggcggtggcccctggtgtgaaggggtaactcttctgtgtgggtggatagaggtcagtgccttcccagagaacctgcagccatcccctggggctgacatcaagagcctgggctatggctcaggcactgtgctagtcaaaggtatcatggaaaaagaaaatcaggagcttacactgtacttcgggggcttaatgcacaccacaaaacactattctgtttgctggctactgccttctctaaaagcacatagcacatccttctgcaggtgccagctctctgcccagttgtctgtcccccatcccatcttctgggcactgggctttcccacactggcgtacaagcagacacggggctcaacagacaccgacccaacacaaggcaagctgcagcacagagggaggtggcctgtaaggtggggcaggtcctgcagcccccgtggcatcccagttgctgagtgcttatcttctcttctccaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgtt

SEQ ID NO: 36905 - DNA, 175235 bp, Homo sapiens
agatgccgcgggggccgctcgcagccgccgctgacttgtgaatgggaccgggactggggccgggactgacaccgcagcgcttgccctgcgccagggactggcggctcggaggttgcgtccaccctcaagggccccaggtgaggtgcgccgccagtcccttcctctcgcctggttggggcttcttggaatggggggcaggattttctcaggaagagaatgtcttggcggggcggggtggtgagggggacggtggtatctgagtcgagaaggcttcactaacgcaaagcaaaagggagggagagatttgtttaaaaatcagaaagggagaagggagccagctgtgggcgcgggcaaagcaggggacggaggcttcagatgtgcgctccacgactctccctggctccggcctcctgtggggtctgcgccgaggccacagcagagggggtttgtacctggctggggcaagagactgcagagcagacctccggacacgccgactgtccccggtcatatctctggggaaagtcgcccacggcgcggtgcccgccagccctgcgccgcttccccaaagcggcgacatgaccgcgctctgcggggttcttactccatcctcccggatccctgccgaaagctccccggggcttagtccctgcagtcgagactgccgggtaagcccgggaaaacggaaagaccccagctccggaaggagattgcccgcactttaatagcgtgggtttggggccgccgactgtggttctggggcagcaggctgcggtgcgctacagccctccagcccgagtctctgcgggagctctggcgcccgtttgtaagctcccaccagcgcaggagtaggtccatgagcggcccagactcgggctcgcctctggcttgggattggcgaaagctgccagggtcaacgttaactttgagaaccacaccttcccgaaacctgcgccgcttctcggagcgcgccaagcctctctagctcccggcacgcacggcctccctccctgcgctctgccccggaacgcgagccgggaggtgggaagcactgagaagctggccagatggggaggacggcgaggagagctcccttctcccccctccccaacccagaggaactgtaggagggcccgcctcacgctgtgaagcggagtccccagagaaagtggggtcgggggaggcttgcgggtccggcttccttgtccgtttttttgccgaggccctgctttcgcccggggctcgccgcgcctgcctctcccgggtgaaaggttttctaggtgctagaagaagccctgttgcttttgctgataatgcagtaggaatttcatgggccatcacactgctattaagaaatcgcatcttttaattatttaataccatccctgcctgacgacgggttatccctaagggatgggagtggggggttgttcttgaaacccggctgtatgagggtatagatttcactaaagtcttcccccttcgtctccccctaaagaaatcgtgctacgatcgctctgaaatcttttcttattttcttcttctaatcatggctatcggtttaatatgaggcagtaagttttcgttttaatcacagggaggctaccataattaatctggctagaggacggatcaatttcctcatcacttgggcttgcagcagacgtcgatggttttgcggggtgtctggatttcctggggatggggatgcagatgtgttctcaggagcgaggatcctgtagcatcgcatgagcacatttgccaggctgggctctgagcgctagagcctaatatgttggcagagaagagaagggactgaccttcttttcgttaatcctggaattgtttttcctacaaatacgtaggtgcagacaccagaacagaaatattaactgcccaaccctagctgcagggagcctggtcttcttccaataggacaaaggaaaaaaagttacaaaacaaagggacagagttgtggccaatacgagaagcactctgaggctccagctactgaagttccttaaatgtaatctctgattccaagttttagagttggccagtgggctctggaattcgaacctctgtgaaaaactgaaatccagcctagtacaaaaggaatgtgagtgcttttcagtagagaccagggaaaggcatctgaaaggccaggaaactttgcttgagtaaggattatctttacatcttacttttgaaacattgtaaattaagacattaaaatgtcttgcaggcatgcactattattaataaaaattattactatcattttagttgttacttcagagtctgcataaactgggcattttatgacattgtttgaaagaataaaccaccctcctcacccctgggaaagggggaatgaaggcaggccttggaaggattgagactggataatctggcgagccccagacatgtagatttattcaaatggctgcttattgctgcctaggaaaataagcttttaaaatagttctaactgaagcagtggaccatcttgatagcacttcagaactttcattacgttcagcattcttatcagaacaccagacagtaaaattactagaaacctaaattctattttcaattaagatgcaatcttttgttaatttgaaaatttaaaaaaaatagttatggcgcaattttttttatgtcttagaactcatgttccctctgtagagtggtggctgtggatgtgcatgtttgattgtttatttgtgggaggagggggcaggggacagacttggagagccacgccatgatttgggggaatacggatcaatttcatgctcttttaatgcacttgtcttcataattcatggtttttcttctcctttgaatagaattacatggctgctttgtaaagattctggtttggggaccctcatatgggaaacgccatgacattgacctcgtggtctgatttacaatgccagtactgcgctcccaggagcatagcatgtcctggaaccttgcctgtgaatgcctgtgacttatgaagtggtaacttatgaagttggtaaactttgatctcttatattcaaatctgttttcagaaccatctaaacaagatcttcaaatctgattttagtcttccttcattctcaatacatgtatgtaggtagatgttggagaaacataacaatttcattggaatttactttcaatattgatgttttcactttgatgacaggcatacttactcattcaataataataaaacagtggaatatatagagtttgaaagtaggtatcaaactttttttcttgaattgtcaaatttgaagaatgactatgaactttcaagtttttttttcctagaaaatttgagcactgtataaattcactagccaatgatttaagggattgaaatgtgtttgggatgattttctcccttatggaattggctgctgtttcataaaaagttacctaatttgtcaagaatccctattctgcacttaccaagaattgtgagttttcagcctttttaatttaaagttattgcctctgaaatatataaaagtagttggtctatataaatttgtgatttaattgattagggggaaaaacatcaacaggtctgctaaagaaaaagaaaaataaagttggagaaaattggacacatcctggtgcactggtaggagttaaaaatgagctgttccatcaggattcctgtgatagccatccgcagcctcccctatgagcaggaaggactaaagaaaacactcgaggagcataattagacatctttctgctataattttaccctgacattgagagccttgtacaactctggaaatggactccttcgcggaagattgcacttctggccactagagggcaatggcacccttctccaactgtctgcatggagcccatctgcttttgagggcatcatgaaaagcggttttgttacttacaagccttgtctggccctctcaggagagaccgaattcaatctagctgtggttcaagctactgctcgagcagttggtcaggattagcatctctctagtgggtggatcctgttaccttcagcatcttcttcccaccttggagtttactagaaagttgggaaatcctgtaacttgacattgagcagcagccggggtgggggctgggctgcaggataaacaaggtcagctctcactgagacagtgatctgggaggattttctggatttttttctggcaaaaagagcatcatttctgactccaagtggaagggaatggataaagaagaaaaatatcagtgagactaccgtgacaccattgcccgttctttcatgaggttttgaagatgtctgcaagacacttctaatttgcaaaaaggaatagcagtttgatcttcggtaaacactttggggcatggaattttaatatagcagtaaatgttttactgtttcttttaaaccattcttgatattgttgtgaaaaacctaactttagcagagagtaaaatttaattcaagattgttcctcgtgcactggagtataatcatttgattttttttcttctcagcgatatggaaattatggcttatgattaaattgcatattccaggctacacaaatttatatttgctcctgtttgatagtgtcatgaaagttcaggaggagaatgcaaaaagaaactaatgctatattataattaagaggaaaactccattaaagaaataagtactgttttaagtggctacttatttgtgttttttgtcttaagtgagtacagttgcctccctggtgattcagcaatgaagttctttgcagctctgagctgtgttggaatgcgtagacagttgatgaagaaggaatcaatgcaaatggattatgggagggagtattaagtaactcagtggaaagtaagacaaagtgttttgtaaactgacgttcacttaccattggacagtttatttaactttaaaaggggcaattttaaattctaagctcttgtgaataatgcacattgtttgaactggaggcaaaatttcattgttatttggtttaattagtcatgagacggttgcagagttcagggattcttattgagacaaagcatttctctcacagtctgtatggtcgaggtttctgctcaatcagaaaatctggtacatcgggatattaagtgagaggaatgtgagagagaagagagggaaaggaggaagaaactcaaaagtatgagagagactaatgatgctatttcttatggaggccaatttctgatcttcgtacctctctctctctctctctatccttattaagccaattgaagagctgaatctaggaagttgatataaacagctttaaacagctttaaagactgcagtagacagtagccaaggtcttattctgtgttttctggcaccaagtgtccctcaaacaatatttgtgaatgagcaggggtttattctcaaaatttcctggttgctgcaggtgaaaaaaagctttcacttcctaaactccacaccccttatttgccagaaatcctcctgacatggtcctctgcactggaatgattttcacaaattaaagttagctctccacattcagctctcttgaagaaaatggcctggagcccggctttgtccttactatgatgatcacctcgcatggcaaccagtgtggtaggggaggctcctccctggtcttagtttaagacacgtagagatctcatttcagcctccattaggctccatcagtgagagcaaacagtgagaatttagggtagagtccctgctatcgatgcatctttattcttctcaataagagcaagggtggaggaagcaaggataggcatagcagctcaaattgcttcacacctaccctgcctcggattgctggcaatgttttacccataaactcattctggaaagttcagttttcatcatgctagaggcttggaccagttattcattcttggaagcaatagtgcccagcagcggggccaggatgagggtgaagagagtaagtccaaggcctgtaagtgcacggctggattctgtcttgattgaaaattttgtcttttgctcatcatagattttttccccactaatcttcattatttatttacttttttagagacagagtctcactctggagtgcagtgttgtgatcgcagctcatggctggtctcaaactcctggcctcaagcaatcttcctgccttggcctcccaaagtgctgggattacagatgtgagccactgtacctggccaactaatcttgatttttaaaataatgcattaaagtattacttattttgattactgaggttttgtttttttgttttttttttttttggtgtagccttatattttgtgagtgaggagttttgcctccattacttacaaagtatgtgaccaagaataagctatataagctccccaagactcaggtgtcttcttggtaatgatagacctaataataatatctatatcctaggattcttgtaaagataaaatgagaatttagtgcaaggcctagctcacgatgagccttcagtgtgtgctggggttgcttgccctgtctgaaatagacttgggattcagttttatggactaatgagaacaggtagcagttctttcttatccattataaggccagaaatcttgcattgaacatttgttttagattgaggcctctcccaattagcaatgaattgtttattagtgcctgccttttttgaatgatttcgtaaatttaagtgatccatccctcttccacttaaaatattcaagaggcagttgggatttgagatttgagagataattactgcttttgaacactgcctgcctccttcctacctttgcattttttccctctgttcgttctgcgtatgggttgctgtggtaagttaccctgcagtaataccttactgggaaagtttgctaagcatgccatattgagatattcatcacaggtttgctttcgtttaaaaggggctcattactattccagactagctcaaaagataattagtctcttgataaatcgtctccatttcaagactgttcctgtttgtttttcaggtaaatgtagtttgggattgtaaggggtttgagcagtgacagttttaactcataaatagactgtggctgaaaaagtcctggacctgccttgtgggtttctgtcttttgcaggcccaggcaaaagcacagtgatttggcatcatgctaaaaataacggagtcctcaccctctcttaagccctgaatggtttccaactgtttctcacccaaaatcacagccaggctgggctttccaaggctcctggaccttccaggttgtcctgcagtttcccatctgcggctcgccggtgtcatctgttcttgctccaggctggcgttccctcctgcctgcaccttgcaatgaaagggaatatctgtctgtgtttgccggggaaaaggaaggagagagagacaactttttgagatcctactgtgtgccggacgctctactcggtacctcatctagtctgtacaaccccccgagaggaaggtactttcatctctatttacaaataggaaaatgactctcagagggaatttaagacacttatctaagctcatgagtctggggagaaggaaagctggcttcccaaacctgctctgactctaaatcctcagttttccactgtttttggtgcgtgtctcaagcctgggcctccttcactctctggagaaggacacagaagagctggtgtgactgctcaatcctcagctcctacaaaatctcaaattttacttgtaatgggagcttctgagatcctctgatccaactcccttatcagtaggttttttgttttcccaataatcctacagcttcttaaatgtcctgatgacagcctgctaactacctctcaggaaacccaggaggtgaacaggtgattcattaactctagtcattaaaagcactccattttaatgaagaaggagctgaaataacctttatggtaactttctcccagtagttacgttttgaccccccttcactttttccttttcttgaaggctctgcaattgtttggaacctggtatttgataatagttaaaaccttgcatttattgaacactttgttagtttcacacactgtactaagaacattctgtataatatgagatttactcacaatgccctcatgagctacttaagattgtcgccagcatcttatggggggtgggcagaggggtgcggtggaaatcacgcattctagtgttccacagctggtaattgataaagctgggattgtaacccaagcatcagatgctgaagcttagtcaccatatcaggctgctcccaccattcacagtgtcagctaatctgatgagatacagtttccagacctctcaccatcctcatcactcccatctgcttccactccatgttgtcactgcccgctttaccacgtggcatcttaaatcatgttccctattgcagacagtctaaccacttcgaaccactactttctctaaggagggctgaggactccattttaccaagtagaattctcaggaatcagatgtatgcagtcattaactgaatcattagctattccagtcaaccttcatttagagatgagggttcaggaacccagagaggaaccaggacttgcccaagatcccacggtaatttagggtttaatggaacagaactgtgctcttgaggctcttaacccaatctcttttcactatctataaacaaaagtctttttttttttttttctgagatggaatcttgctctgttgcccaggctggagtgcaatggtaaggtcatggctcactgcaacctccatctcccgggttcaagtgattctcctgcctcagcttccagagtggctgagactataggcacgtgccaccaccccgggctaatttttgtatttttagtagagatggggtttcactatgttggtcaagcttatctcgaaattctgaccttatgatctgcccgcctcagcttcccaaagtgctgggattacaggcgtgagccagcgtgcctggccaaaagtcattttttaattgattattttaatagttgtacctgtggtctgatttctttgtaaacgtatcattagttcatttgtttatgtaaagctgcgccctctgatatccttgggcagttaagttgtgagccctaaacataaggctttaaatgaatctcttatttggaagttcgtgatcagtccagtgtcatttcatacgctgtttgataatactttgcaaaatgcaacacttggccctggccttaagctctgtcctactttatagtcacctcctattactaactccattccaaggttctgtaaagaacagagtaagaatgatgtccttaccttgccactgccaagcctatagaggacactttggcagggtttgatttgaaattcatttcaaacccatttctttgtcattaatgcaaggtcctgggttgggcaaacagaagtggtcaaatcacgagggcttcccttcagagagctgacaatattaacagcacagagaatactaggtctgttgattaaaactcaaggcttcatactgtaagggccccaaaggaagcattaaattgggccataggaaggacaagtcacatccagtttagtgatcaatggtggtttgggaaagaaataacagaattctactcctacatgatagggagagactacagaggccacctagaccaacaaactctgccatcaggtccttgaatcattgctaccatgtcctggtggtggttgtagcattgctagtgatatgtaactcattacctacttatgcaaaccattgagacattgggaaccttcactgttggaaatgcttcctttagttgagccaaactatctccccaaaggttatgttctttgatatagcctatgatgctatgcaggatagatgtaattcttcctccacattgcacttattctttttttttttttttttttgagacagagtctccctctgttgcccaggctggagtgcagtggcgcaatcttggctcattgcaacctccacttcccgggttcgagtgattatcctgcctcggcctcctgagtagctgggattacaggagtgcgccaccacacccggctaatttttgtatttttagtagagacggggtttcaccatgttggtcagactggtcttgaactcctgaccttgtgatccacccgccttggcctcccaaagtgctgagattacaggcgtgaaccaccgcgccctgttgcaattattcatttttaagttgtcttccaggatgccctctccccattcttaaaatctccagattgaactccccatttgtgtgtgtgtgtgtgtgtgtgtgtgtgtgtgtgtgtgtttctagctttcctcagaggaaaggactgaagccagaaatctaggcagctagactctagattatgaactcccttctacacacttcttttattgcagcctgaggctacattacattagcttttattgccagccacatcacccagaggacttacgctccacagtttatttgtttatttctttttccttatgtgctgccgttaagccgcatttccccacctgtccctgtgcacataagaaatgataagtcaccttcagtggtgttagcacaggctctggagtcaggcttccctgcttccaggcgtgaccatgtcactaaccagctgtgcaagtctctttatctgcttctcaatttccccatcgcactggggttaatgtcagtatctgccttctagagtagctctgatattaaatgatattaatctataaaattgtttaaaacagctcatggcatggagttgctgttattcttgttgctgttacttttcatattgctgagtttggtcaattgatccagtctactgaaatattttaaaatttaaatcttgagtctgttattcagcatatctgtcatccctcctagtctcatgctatgggttggtttcctcagttccaaccttgccttataaaaacagaacaaagcaatggcaatgaaaataccctgatgtgagcagggacagagtcttgttaaaccatatgatatatatacacacttctatttaagtgattcaaaaccatggaagacaacattccatgtgttactcattccatttagctcatgcttggcattttgtttgcttgttcaattgtttggctgcgtggcctcagaaccaccttcctatgtttaggaaataaccccaataagcacctttataggaggaagagagttccttctactccaggggcttaaagggccagagagttgattccctaactttcctggaagctagaatgccaactcagcaccaaatcccctgtgttttaaatttggattcagtatcttacacacacacacacacacacacacacacacacacacacacacacacacacatcattggccatggataactcattctggtcactgtagcagtggctgtacagcatctgatttccaggggccacagaggtggtaaaataacccatagccacccatgtccagcggggacaaccgtggtgccttcactcttctcgttgtatggcagagtctggcctgggcttctaactgcccagccttcctaggtatctggggtttttctgagcctctttctccagttttcctgcaaagactgtgctgcccagagtctatttctgttgctttcaactaagaaacccaaaagttttcatttccctacatatccttgtgggactgttatgaggaacaatatctgctgcattattgaatgagatatctggcttttgagttcttctcaaaggccatatagaatgttgagagtcagatagggtgtaaggttggagcagaaggaggttttagtaaacattgaataggctgggtgcaatgactcatgcctataatctcaacattttgggaggttgagacaggtagattgcttgagcccgggagtttgagaccagcttgggcaatacgatgaaacctcatctttacaaaaaatacaaaaattagctgagcacggtgtcacgtgcctgtagtccccagctactcgggagatattgcttgagccggagaggtcgaggctgcagtaagctgggattgcgccactgcactccagcttgggtgtcagatccagaccctgtcttaaaacaaacaaacaaacaaacaaacattgaatagtccaatttgtgttgagcaaatattgggcaggtgtcaggacctgggtagaagtccagtaatatagctcagtggatgaggtggcatttccaagggcagctatggcaggcagcataatagcttggcatgtggatggaaaatggtctcttgtaagggacacatccagttctgtgggaaagttttctatggactctagccaaggagccaatgcaaaaatctcaaaagctggaatacataggaactctcggcattgatgggtgcatgaaaggggaccaccccataaaatggacaagtggcctcaagtcgcatcttagcttctggaggggacagtctgcacaccttcttaactgtatagcctctgtgttggcccaattattgggtaaacagtggaagttgtcagtgcatacagttgggtgagtttgggcagcaaggacacacagttaaaaactttctctggagttagtctcataccatcccacaacaacttttctgatacacctttgaaaggaatttgctttactctttcagggagtgaagtctgcaggggaagcccaaggtctcagagcatctgagacatggtagcctgtctaatgggtcagagagtacaacctcataagggctttgattttgtagctgagacagctccttgcccaaatttaacccagttatcactgaactgaacagaactcttggagccattcatttcaatttctttttttttcgaaacagagtctcactctatcacccaggctggagtagagtggcgctgtctcagctcactacaacctctgcctcccacgttcaagcgattctcttgcctcaacctcccaagtagctgggtctacaggcatgcaccaccacacccagctaatttttgtatttttagtagaggcagggttttaccatgttggccaggctggtctcgaactcttgacctcaagtgctccgtctgcctcagcctcccaaagtgctgggattataggtgtgagccactgtgcccagctcatttcaatttctatgtggtaatccctgcctggtcactatgaacgcaaatccagatcactacccaaagaggactaaccaaacataggtgaggctatataggcagcttagtaaaatatcactagtaatcaactttcaattgtctactcattaaagccacatgtttaaaagtttttttttttaaatattgatttgatagcagcagcaaaactacatttaaatccaaagccaaattgaaaatcagggtgaagtgcttcatttatgcaaacaattctaaatctcaatactttgccaaaatattccagtagtaaagggagatctatcttgaacaacttcactccaccttcttcttcatagacactgctatatagtataagatacaattttcatttttgttattatttgggggagcttacaaagcactttataaatggagtgtcactatcagtattattatcttagagtaaaaattgcaatttagtagttagagctggggacgcttgccttccaactaatgcattggtgattcttgtgttttattcatcaccattcctgctgcaatcattgcagggaatcttcaacttcagcaagtctcagcagtgcatttgggagcattaatcaggagactaacgcagcctgagaagtcacatctttgaagtgaggaacggatcagatcctgaggcatcgttgtagctgccccctctctatcacccccactcctcctgtgccctgtatcgcaagccagaaaagcaacagttttcacttacagagagacgtgcctagtgtccttttcttattgggtgcctaacttctgtctcatttcttgtgattggggaaagatcacctgtcagcaagtttgtggtcaattgctgacaaattttccctaataggctgccctgtgattcccttcctctaggcagatcagcccttgcaatgctggcattgctgataaatagctgtgtggccttgagaaagccaattaacctcagtttcctcatctgtaaagtggccttttgggtcctttccagctcgaaaatggcctggccctcaaatcttcctccacaaatcacttggcatggcactttctaaccatcacttctcagcattctggagaaggaatcatggagacaagcacacctggatgtgaatgcacaggtttgctttgcccgagcagagtttataagcagagggtgatagtgagacatcattctgaaaccctttatgggatactttcaataccaaatttagagctttggactttattccctaggtcccaaggaaattttacaggatttgaagcatgctttattaaatgatttctggaccacattgaaaggaactgatagaaagagacagaaagtttaaacagggaaattcacagggagagtactcctgtgagtaccctctggcagtcacctcactggtagagaggatgaagccagcacgagggtggaagcattgttataatagctgatgtggactgagcatttactgtatgcacacactgcgttcagcatgtcccatgaattatctcagtcaatcttcaggacagtctcaatgaggtagaagctataattatccatttataaaatatgcaaatcaagacctaggataattcagcaacttttcccaatattatgcagctaataagtggatgagcagggctttgagccaagagatcccgtgttcttcattgctctgttatagggagacagacttaaggtgctttcaagggtaggtccgtgagacttaccactggtcatcgggaagtgcttactgacggcctgggactgggcctttcataggttatctcatttcatctttccagttccataaatgggagcctgagatcacatggtagacagctgcaaatgatttaaattcaggacctgaaagatccagaaaccttttcccatgacttttctcaggcatacaagattgatggattcttggcactctccccacccagaattatttaaggatgacaccaagtgttatgttttctgtgatgtgctcatgaaacttaaatatttaaaaagatgtgttaggcagaaagaagttgtgtttcccagatccatgttctctcctgagattttggctcctgtccagccctggcatacatgaagggaagatgctaccaagaatgtcatgtcagaacatttatcttgcacccaggatttacagtttgttttgaagggttgttgaaagaagatgtatacattcagtttttgtccatcaataggtactatccattctctgttatgcagcattaaggtcttgtatgttgcatgtcaaaaagggagtcccattgcagcttctctaatgcatattaataagaaacaagatttataagagataaagaataatctacaccgaatttgaggatgacattaagagatatgaaatttggcactctaaggcaggtcttcagaatagatgtgatagcaaagaccaagatggcaaagttttgttcaaagagacacagtccactaaggtttctatgttttgtattgatcaactcttatatttgtgtaacattttcatctgtagaccaccaggtcaaaccctatacccatcccactcactgttaacaagaaggaactcactcctcttgtgtggactcaagtttcctctttggtagaataagaggattagaatggaacattacctccctacaggagggattgggaaaaacagttgagctctgttaaaaaagtccaagaagaagtttcggtcacactgacttgacccagagaatatgtgtattattctcctaacacagctcctgggttcaaaattttatttgggcaatgaaaatcaagttgatagtaggctcatggaaactcagaacatagttctcagttctggcaaagaggcccccaaacctgtcctccaaggaacagttgtgaaaacaaagcatgtaagaaaagcattgtgggtaagactgaattgatgaaattcatggtaatagcatcactcttcaagaattgcctgtctttgcttaacgttgaaaaatattgatattatctatagtattgtttcccctgtttttacatttgcatgggaaacaattcgattaacatttctttctgaagatggtctgcttctaagagagtgacattgattgtgtcagcttggcccactaagcatgctttcaccttgcagggctgatttggatgcaaagcagagagatcttgaaaatatcaactctacctgcattgttgcatctcctttcaaagctcatttgggtttactataaggcaacattgaaaatgctattcatgcacatgctctcaaatgtgagaaattgtgctaatccaactttcattttcatatcaaattgaacaagaaatgagtttgtcagaaacaatcatgtctgttgcagaggtgtcaggttggatagtcagagggatgtgactgttgccctgggaggtatcttgtgttgtgggaatgtgttgatggaggttatccagtaggctagatccaagtgctccccctgggaaactcacagggattatagctagcagctggtttgtcccagctgggaatatttcccagtctccctctatattcggttcagccttttcctaattctcagtgctttctgggcccctcacaaaaacacaaacactaaaacctcttccaaaaacaaataaacaaacagcaacaacaaaaagaaaacccagccttcatatagatagttcaatctttatgaagtgtatgctttatgttaaaaaaaatattgtaacttgatgctggtgctgcaaacgtggacagagagattcaaagtcatttcgggaagaactgggaggacctcagatatttatttattttactggccatgcaggaactgattttaaagcttttaagttatctgtgaggccagaattcttttggctttatatttcgtaaattaacttttgaatgtatttcccccaaatatttaattcttatgaaattgagaatactaccaagacaacagaatttgcaaagtcagcttacgtacttccttgtcttttggggtctttcttttgaatgaacaaatggggcacagagtgatttaaatcttacatcctctccataattcgctatgccttcacaacagcaatataaatggggaccattatttgatgatcttggtatatgcttcacattcattgtctccttccattcccaggagagccataaaagactaatctgaatagagagcagtgattaaaagcgcagtgccaaaggggtttataccaaaacagattccactgccccctgtcttttgttgtgtccatgtgtatattacatgcttctgttttttgtttttttgctttaatttccttctctctaccttgggatgacagtggcacctacctacaaaaagccaagtgcataatgggacttaataaatgctagctatcaccttgtaagttagaagtatattagtatttctgctctatagagagaaagagattcaaagagtttatgcatcttactctgggttctatggctagtgagggacaatgtggaatttgtctccaagttccgtgtttccaaacccatatgtttctttccattccctttactaaaattgactaatctattgctgctcttccaaacctaactttcacctgggtataaggaagagaatctttcctctgcttatgaaggtgtcatgcttcacttttaaaggaaattggcatagataatactttccttcccagcaggaatcatatttgcatacctctgaaaataagaactcaattttctccaccaaatcctttgtttttgagcttttatatgtttataattgtaatttcatgataactctttaacccagtgcagtccaataaaaatataatacaaaccacaaacgtcattcacatatttagtttaaaatgttctagcagtcaaattaaaaaagtaaaagggaaatagggaatatttattttaataatttattttatttaagccaatatatcaaaactataacacaatacaacatattataacataatataaattattggtttataatcaatgtaacattattaatgtgacatttcatatcttttttatactgtctttaaaatgtggagtgtgttttatactaatgcatctcagttgagactaggcacattttaagtgctcagtaggtacatgcagctagtggataccttacaaatagtgcaggtctcaacttttgaagaatatatttatacacagtttttaaaaactactattggtgaggaagacactgttgggcatattgtcatgttatctaattcatcttcaaaataatcctatactaccatccctatttttcagacaaaaaagttagaatcggattacataacatgcttgccatcatataagctagtaaaatgtagagcttgaattcagatttaacatattttatttcctcatgtaggcatctttccataatactgtaacaccttaataatgatggcgattattacaacaatgatgaaaaaataataccattaatataacaattctgttaccacctggcatcagtgaatttataacattttctcttacattgtctcatgcttattctcatttcatacacaattgtttaaaacatatatttatatactaaataagcatctagcaggttgcaagatccaaagctaaccgagaatatgtgataactcaacaaaccaagctgctttcaacacccaggttatccaggaaatcagattcctgtgaagtttagagtttcaatggaacgcaaaaaatatgagcacccaggaggtgtgccatggtgcttgggccatgtggtaggcacctgcatgaatgtgcatgtgtaggcactgggtggagagtgacaagaggagggcacagagagacgggctggctccaggttgcagttgttgtgggtgaattgatagacagcagtagagaaccaaaataccttgacagataatgctcagtttcagtgtttttgctgcatctcagtccccacacttttaaaccatcttcctgcattttttgctccattgctcctgtcctgagtctccaccccaaagttgggttcaacagaaggatccatattaagaggatggccaagaatagggtatttcttatctgtacccagggataatcatgactttcagagggtgggtgagctatcattgacacaagcttcagtgtctctaacacatggccccttcatggggctacttgacttacagcatggtggttggctttggaaaggataaatctcaagagcatatgtttccaaaggacaaaaatcgcaacatgcaagggtgtttatggttctgtttgcatcatgcttgtctatatccctttggctacaggccagggtcatatgggcaagtccagagttaatgtattacagtcatgagtaaaggaagggtgatttattgggattctccaaagtaagagtttcctccacaggtttcccaagagggaggtaagtgacttttttttaggagagtgggtatatggtgatgttgcaagagacatgatcctattagaaatatttcctcatactctcttcaactgttgactcaatgagacaaattggccgtaagattttgggtctatagctacacagaaatctaaacagtgcagaaatggattttcaacatgaattttttaaaacttagactttgagtggatttaattcaaacattatctttggttcttagagtcagaagtttccttaaaagtcgtattagctgttgtctgcaggcattttttggaggtgtgaacttgcaatcattgggcaaaacaaagaatctggcacttttaattctactatgcaacctgagaataattttacttttaagaatacatgtctatattgtatgaatgcaatatgtcatcataactgtgagtaaagatgtccctgaaacaaacaacaacaaaaaacccatcagactaaggatatgtcatctgcccatccacccatttatcagaatatccatccattcattcatttagcgaaagtcattcacactgaaaatcagctaggctgtggatataagggttgacaaggtagacacagtatctattcttatggatcttatatttagtttgtgggagtggaccatagaaagcaaacaagtgaaaaaaataatttttagtagtgataaatgtgatcaatagtacacggcaatgtgatgtattgggaagtggccttgacacttgaggaagatagtcatcatcttggctgaggagcactgctcatgggaagatggtagtgatggtcttggtatttaccataataggggggcctacaaagtggtgagtagggagggaagagaagaagggaggaagaaggaaaatagaaaaaataaaaatgaggaagaaagaatgaataaatggagataggaaagtagggcaagatattagtatcacaattcatattttcccaaactgatgacctggaatccccacaattgtcctgggagtggggtcccctaatgttgaaggagagctccaaagaggaaagggagtttgactagcatcacaggtgaggtcagggctatgcccagagaagaacctgtgcctttggctgtggtgctctgcttgtgcatgcctgtctctcctcatgattggttggtgtcttcttggcaaggaaggtttgtctcagcaatgatggattaggagagtggtatgcatctcttggggttctgagaggccaacaaatgtggagaacaagtttgtgtaagtggttggaatggaaatgttattagaacatagttcctctgagtaatggataaaagctttgaggtgctatgcctggaagaatatagcctacacatatttgaggaattactttaaggaagaaagttaccagatttttcacctttgacaatattagaaaagcaattaaatgtctatcttaggatgaaaaatttaaattttaatcagaactgctcccttgataagaggtgttagctatagagggcatggaattgttttttcagatatcattacacatagtggttgtctactcattgtagatatcaccagtgaattgccattctggtgggggatgcccctggctgcccccttactccagtttcctcaaattcactatcttttggtttttctttttctttctttcttttttttttttttttgagacagagtctcgctctgtcacccgggctggagtgcagtggcgcgatctcagctcactgtaacctccacctcctgggttcacgtcattctcctgcctcagcctcccaagtagctgggatcacaggcgcccgccacgacgcccggctaattttttggatttttagtagagacggagtttcaccgtgtcaaccaggatggtctcgatttcctgacctcgtgatctgcctgcctcggccttctaaagtgctgggattacaggcgtgagccaccatgtccagccagtttttcttaagatacttttgtttttctgaaaaaggaattttttttttcaattttcttggttggtcactcatctcagcctttccagtcaaatactgctttcttccttagtattttcttccagtcttcttctcctattacatttgttgcctcagatgatccatgaaatttcatggcagtattcaacatcctgtcactaactaatcctcaagctgcatcccaaacttcacttagcaaactcttaaatatgataatttccctatattctatatttctgtgatgtcaacactatccacccacttttccaaccagcggtaaatgatcacacattaactttggaggatccatctttaagacctcacacccagtccattgccagttactactgatttcatttctgatatttctttcataatgtctatttttctaattcttttgccattgtcaaagttttctgcccttatcatttctcttctgagatgcgtccttaatctcctaactgccctctttgcctccttcctttgtgcagaacactctgaccttcagctctcacttttactctacctcttccacacaactgtgaactgcatgaagagttcattgtcatgagggcaatgaacttggcagctcatattacccctgcttggaggcaagtcattgccatgaggacaagttatgacttgccctcatggagtcgtctagcttctgtcaagactggatgaaggacttaaataatcttgtgaattttatatttctacatttccatttacatgggcacatctccatctactcttttctgggtctaatcaagtgttgaactcatattttattgatgctgagatatttttcctaggtgacagtaacaaagacacaataaccactggaagtctcagaacatagcttttgtgtcttaagatcattaaaatcaggagagaatgatctttctgccactctatcaggaaactgcaaagaactgagactaccttccttgagttacagtccatctctgaggccatttgctatgtcctgtgaatattctgaaggacacagctggggtcctgtgtttatccttgtgattgacagtgcacttgagacaaggaaaaacaacatgtaccacataggtcctcaaaattgttggatgacatgaatagatgagtggatgaatgaattaatatttggcttccctagaccttccctgtttttttaaatattccatgttttcacttgtattgtctactctccttgggagatcatggcaccctgtaatataaaatttattatcgtacagccgtctatgtgctgttcccagtaacaatggattccagaagacttagataggcattccatttcacaagtcatcatacccagttttattggattggtgaattaaagggttagtaagtgactgaaattatgaatgaatgcatgactaagaaaatagacggttacaaagcacatctgtaatttcaggttctctgctcaatatatcaaatataatagagatctgaaagtgacctcaaaggtcattttattcttaccttttttaaacagatttaggtgctgatatttagaaaaatttagaagactacacgccccacctcccccacacacaccaaatcacatggcatactagtggcagagacaagaacaggacttcagcagttttaatttctagtgaggttcacccttcattacacaatttcttatcttaagtaataggcatttgataagcacctatgatattccagacccaataggagatgctacgggtgatactaaaaatgaagacagaggcagggcatggtatctcatgcctgtaatccagccaacttgtgaggccaaggtggaaggattgcttgagcccaggagtttgagatcagcttgggcaacatagtgagaccctgtctctaaaacacacgcacacacacacacacacacacacttgaagacacagttgcaatctgcgattctccagcatctcatagacaaatgagggtaatttgataaattcccaacagcacatgtattacatacccagagaaggagggtcagtctggccagctgctcccatatttccttgctgctagagtaatatttgaatatatcatgtaactagactactaggtttatcttacagtagtatctgatgctgttaactctagcatgttgttctgtcatcccttagtatccaaggaacttaaggattaacagggagagggatgtggtagcaatatgaggttcaatagtaaatattgaacctctcattacccctgttctttccctgaagatacccattggtcagtaggttcttccagctgctgccctacccaatttcatggccttctcttccacagttgatctattttgataattgattttctccatcgtgttgagcaaggtgagtcttctggtaggaaggaagaatcagtaagggttgccatccttgtgttactccaataatctaagcaatcctaggctgagtttgagtggctcacctgctcttttttggtggtttctggttagattgtcattatagcagagcttagttattgggcgaaatcacagagaaaaccaatttacagattcaattgctgaatttcctcttatttttaaaaattttttatcttaacttttctgatcaaaagtccccagtagtggactggaagtagagaatgtgaaaggatcccatgtgttgtgggagagatgttacttttctgttctttgttataggactgattacaggggtgtgtttcctaattcatagagctgtgctcttctttgtgtatgttatacttaacatttttagaaaaataaaaagtgactactactgataataataatgattttgcccccagaggacatttggcaagatctagagacatttgttttgtcacagcttgggagagaatgctgctggcatcaagtggataggggccagggatgccgctagacgtcctgcagtgcacaggacagccctctgcaaaaaacagtcatccgacccaaagtgccaatagtgctgaggctgacaagccctaccctagagaatgagggtcaatctgaaagtttcattattgaacagtcatgacaattaccatttatagagacttatgaagtaaattggctatatcttcattttgcatttgaggaaatcgaggctaacagaagctaatttgtccagcatgacccagttgggaatccaggtccccatgcagtcccaaccttgttctttacaacacgtatattattttgcctattgtcacttctctatcaattttgaaaacttacaaatatgtttttcccaatagctgaaatgagtttgtgtgtgtttgtctctgtgtatgtaaaacaaccagtatgtaaaacaaccagataaaaggtaataacgagaagaggctttaaaagatattatccacatagtcttctgcaatgatgcctttatcaaaacataataatagactactgtgtactgcttttgccaagaacttgtcaaaaaaaaatcaaactgaaagcatagtcttctagttatttaacgaattgaaatttgacttttggatacaggtaagaatacaactgtcattcaagggagttaaaacatgtttctggctattgtcaggagactgaatagcctcttccagttccttgagtcagaaattttctgaagcttccatttgtaaatattaatatatacataaggtattagtcgaagttcaaccaggggaacagaaccaacaggatacacacacacacaccccaaatatatacatatatatttgtatatatcaaactgtatatatttggtatatatacatgtaatacatatgccaaatctatatagttggtgtatatatgtgtattatatatgttatgtatataatatgtataatatatgtgtgtatatatatttggcatgtgtttgtgtatatatacatatatgtacaaatatgcatatatacacatatataaacatatatgtacaaataggtatatatacacacatatataaacatatatatacacacacacacacacacacacacacacacacacacaccccgaaagatttatggtaagagattgacttaagcaattttagcatatagtagtctgtttggcctgttttaacaaaataccttaggctggatcatttataaagaacagaaatttattgtttacagttctggaggctggaaagtccaagatcaaggcgctagcagattctgtgtctgatgagggagagacaagaatacttgtaatacttcactggaagtattacaaagaagttgtagctacatggacgtatgcttgcgataaaatgttaagaggtacaagataggtcatcgaattatgtattcaatctgacttcaacttactacacacatacttctgcatttatgtatatatcagagcatgtagagaaattatggcaaaatgccagcagcaattgcatatggctggaatttaagtttaaaatttaaattgtattcattttcaatttgtaattactgaatattcctcatagatggcaccatctcaaggccttctcaaatagtggaagaggcagggagctcttttgattcacttttataagggcattgatcccttggcctaatcacctttaaaaagcccaaccttttagtatcatcacattacagattatgtttcaacatatgaacttgagggagatattttaagaccttagcacagaggttggctgggaaaattcaaaatccatagggcaggtaggcaggaagggcagactagacatctcagatgagagctgacattgcagtccacagatgggattgtagcttcatcagggaagtctcagttctgctcttaatgcctttcaactggttgaatcaggcccttccagataatctaggaggatttttcacacttaaagtaaactgattacagacttgaattacatccactgaataccttcacaataacacctagattgcttagattattgcttaattgtataactgcagactataacctagccaaattaagacataaaactgatcattacatgtagtaaactatatatttttcctaatttagaagttactttagatggtggagtaggtttatcaaaagccgcaagtgttaagtaacgtaaagcacattgtttctctcagcagtgcaaggatgtggttggttggccatacccacctatccagctctaatctcccagattagagatatctttgtatgccaccaatgcttgtaattctgtcttgaaactcactgtgattcattcagagacacaatgttgcagactggaaagaatgaggagtgaggcagacctggacccaaaccctgggtctgctatttaggagctatgtgaatatgcctatgacctacctacattagaggtagtaacacacaacttcacaggttctggtgagatttacctgaaacatgcttgtgcagtgtatggcaatatagatacatacctgtatagagatatgtatgtcttaatttctttgtgctgctacaataaaactccacatcctgggtaatttataaccaagagaatgtttttttttctcacagttctgcaagctggaaagtctcgggatcaaggtgccacatgtctggtgtctagcaagggcctgttcctcatagatgatgccttctgagtgtcctcagttgacagaagagatggaaggggtgaaaacaggtgtatttcctcctttaagtcccttgataagggcattaatcctattcttttatagtcctctgtttgtagtcagtatcatcgtgtctccttctgggaggagatcatgaaaccatgttaaagaagcacagagaggggtacaaaggagaggctgagactaagacaggattttataaattccatggaagagtcactggctgagattgtggttattgaactggactgctatgcttgggtccccgtttgaattaagcaaccctagagatgtgtctatatatacacctgcatatttatatataaatacatatctactgtgtgtgtgtgtgtgtatgtgtgtgtgtgtgtagttttctgtttatttttgggttattgtttaaggtattgatttctttattagactctgtgggagaaattctactgacatcaagtatcaagaaatgttttgtttcacctggacaagaatgcatttttattttgtttagttttataactattggtgtttctccagttgctttggcttgctaggaaagaacactatgtgtcataaattatggtgtgctttagaatgaagtactttgctccatcttaacaaccttacttttactttcccttcatcccactttctttaaaacttccctttgtttaaatcttagtgcattgctggtatttatgaaggccattcgacttctcttaagaagaggagaggccttaaataaatgggttagtaaatgggccttagtatttgagctcttcacaaggccaatcattgggagtccatctttctcctggaggcttgcttagagctttagttaaaccctatcaaatagtaatttcttattaaggcagagttggttctaatattcatccaaggaacatatattcaaatgatagacttctcactaattaattttgctttcatattttgacattcagtgaggcctttttagtgtttttaatgtgtgcattatagtacgtataagaacatactgaaattaccaatttaatcatatccttctccagattattagcattttgacggtagggactataatgattttatctctgtatacctagtatctaccactgtgaatatcacgtagtagattattttgttggatgaatggatgcttgctaaaataactgctgtgtacgcgtgtgtatatttgtacctgtatacacactgctatggtttgaaggatcatgtctccttcaaaattcatgtcgaaaaataatccctaattaaatagtattaagaggtgtgggttttgggaagtgtaccagagctgctgattgttctagaaccaccccactattccaagtttattaggctcagagccactgagagccttgagttctgggcacttctgtcacccatctccttttgcagcaccagacaaagaattttcctttttagcctcattgtttgcatgcctaggagtcggtcactgtgctcctcgtagtctttgggtctcagaaatagtgaacaggtacagcatccagggtggaatttttgcctttagtaccctcccttgaactcttaaaaaaaaaaaaaaaaaaaaaaggaacccaacactgggaggccaaggcaggcaggtcacttgaggccaggagttcaagaccagcctggccaacatggtgaaaccccatctctactaaaaatagataaaattagctgagtgtggtggcacatgcctgtaaaccctgctactcaggaggctgaggcaggagaattgcttgaacttgggaggcggaggttgcagtgggccaagatcacgccactgcactccagcctggacaacagagtgagagtccatcaaaaaaaaaaaaaaaaaggagacaaacttgtagttttgtaaatactgtaagctgaatgaatttgttaaaaagtacatcacatcactacataagtgacttgacttcagggttctttttatttattatttatttttcctttaaggaaaggtcaaggcactttttttttttttttggaaaatgtccctcaagatgaggaggaacctcagtgtcccaagaacagatgatggatctgttcatgggtgagacaaggaacctgtgatttgagctgagttgcaagagacacaggagacatctggggactaggtgaatggacacctgacacttggtctgggcttggccacttggctgtggccatgttcctcagctcctttgtgtctcaggcatccccaccaataagcagaagatagtaatagccaccccatctctattaagcttggtgtgcaagtggtactaaggcatgggttagatagtgcctctaacagccaagaatagaggtttctatcagtttggcccaaagcactttggtctccctgggctgaatgggattgaggtcatctttctgtcttctgctctgggctgtgaggttgccgtcactggaaagctgtggaaggaacattggcctgggagtccagaatttttaattctcatctagattctgtcatttttagttaaaacttgggtaactaatttttccacatgggacatctgtgtatatattttttaaataatggagctaagtttggtgacctctaagagacttttcagctttgaggggctgcagtgtagcaatcactgtgctgtaggatggagataagtgatgaggacagaccctgccatctatgactatggcattctatgggaagaggcacaacatctatgacaggacaatctcacattgtggtatttgtccaaaaggaaatgaacagagtcgtgtaataaaatgagaggtgaaatgagttcaggtagatccagagagacttctctggggaggtgacattatttattatccctgggaaaaggagggagcttgataaataattttaaagatacactagccaattgagtgaatgtttattgagcacctactctgtgcctgactttaaatagggaactgaggctagggtatttaagaaatctttcttaagaaaggcctaatctcgggtggatcacgaggttgggagatcgagaccatcctggttaacacggtgaaacgctgtctctactaaaaatacaaaaaattagccgggcgtggtggtgggcgcctgtagtctcagctactcgggaggctgaggcaggagaatggcgtgaacccaggaggcggagcttgcagtgagctaagattgcaccactgcactccagcccgggccacagagtgagactccgtctcaaaaaaaaaaaaaaaggaaaggcctaatctatagaggaaagacacacacagaaataaatctttcttctattgtaacaacagtaatcagaagacatatgtgggattcagggacattgatgtgctgaggtacgatcaacagcattcatagaaaatgagtgttcaaatggaaaagaaaccgccaacattatttttaagtaattatatttcttctgctgagattttacaataatcatctcacttttctggaattaatactaaataaataggtggaaatatttaaaaattagatgcacaaaaatatctatcatggcaaaaatcaaaacttaaatatctaacaaaaggagatttcttaaataaattatggtatatttttatggtggactaaattcagtcactagaagtattacaaaggagttgtagctacatggacatatgcttaggataaaatgttaagaggtacaaggtaggccattgaattatgtattcagtctgacttcaacttactacactcatacttacgcacttatgcgtatatcagagcatgtagagaaattatggcaaaatgccagcagcagttgcctagggctggaatttaagtttaaattttaaattttattcattttcaatttttaattactatatattagtactcaagtaggaaacacacttaaaatatctccaaacctggagtgtttggaaaagaatggaatagcggttccctctagtttccatctgtttctgatgaattagtcatcacacctttggaacaaaagcagaactttggatttaaaaataaactttacattttgtttttaatttggagcctttaggatattgtaattcatttctactatctacatttttcactacaaattaaatgaagtaagaatagaaagcatatgtgagttgggaaaaccttattttattgtgtgtttctgttggaccccaggaatggctggcgggagggaagaactgttgtaagtaaaaaggaccgcagtataattatttcataactgagggttctaaagcttagagatggggagttgtttgcccatggtcacatggctgatttatagggacattaggcatcatcaagatgcagatggggagaataaggcttaagaaaggattggaccaagacttgttattttcttgctgttggtggtggtgatagtggtatctgtggtaatggtgataaggggcagaatgaagtatccagcataatcaactgagagacacaatattgttagttgtaagatgacattcttctgtatacattcttttcaaagcaggaacacaatgttggaaaggaaattataaacccaatactagatcaggtgacacttaaggtctagatttcagcttttctattaagcgaaaacttagaacatgtcagttttcagaatagaaatgtttatttccgtatctgaattttaaaatgcattgtgcatatgttctgccacttaaaagtaacaatcttttccatttttctcattttattacaaattgcaatcacaccatgtcatcaaaaagttatttagtgacaacttagggggagccaaaaagtttcctgtaatttgcatatattttccacattcggaatgttagtgattaaattttttgtatgttcacttaaataatatattattattgaaaataaatacaataataaatgcaaaatgttggctctaatggcatatgctaaacattttcacagtgcaacacagcatatgcttagttcttcattaagagattttaaaataactcgtatttagcaagaatacattatcttttattcagaattaattatatgctgttttgtgtatggtaatttaaagtgctacccacttctaatatgtaacacgcaaaagaaactatggttacaattcattagaattggcttctttcctttgcaatttagtggcataattaatacatagaactggaatgctatttgttacttgaatcaaaagttatataaagtgctgataactagcagttacacatcctttatttttttttaagcactgcaagacttagaagaatgggataagtcatgagagtaagtcacacataattagttattttaccattctttcatagttttaagagcaagttttcacaagggcgatttgaattagagggtagaataatattttaaaaatcgttttctattattcaaatatagaatgttattaaattttttggtatcgctggttaagtgcctagaacttgatcatcttctatttctttttcctttttgctatgagaaaaataatgctcagagaagtttaaatccttgtctagggtaatgtagttcgtgactaggaacccagagttggaggtttcttggtttaggtgaggctgctgtttcagttgcaggaaagttactcatattgccactttctaccttggttattataacaggttcaataagggcaatatatttgaacagcatattaccccaactaaacaagaagctgacaagaagatgacctcaactaaacaagaaggaagaaaatgacaaaaacactcaaagtgcatcgaaagtgaaaaacaaaattcccaaatgcactttccatttctttgaacacatatgttgatgtcttgactttttccctaaaagtgaaagcatcttgaataataatactattcattctgacctgggtggaatgagatgagcactctaatactctgctgacgaaagtataaatcaatagtagaaggcatttggcaaagtttgtcttgaacctaaacatgtatcaggccctttgtcttacttggttaatttgtgatatctagccttaggaaacactgaaacacgcaagatagaagctcataaaaatgtgttcatccaggtgatttctacagtacgtaaattttaccttaatatagctgataaaaaatgctcaacaaatttttatttataggaggcaaaagtgaaaacgtgctaaatgattaccccttagaggaattctttgaatagtaacagttcattcatacaactgaaaagtttaagatgtttttaataatgaatatatttttaataatgtagagaattacttgtggtatagtatttatcacagatgcatgatgaaaattgtatgtaaatcacaatctatattttaaaaacaataagcatggttaaaattattagaaggtagtgagcattttagcatgacaactaaaatgagttatcactgggtgacaggattatccattcattattcagttgtcttatttcctttggactgctattaaaaaataccttagagtgggaaatttataaacaacagaaaatgtattattgacagttctggaggataggaacttcaagatcaaggtgccagctgattcggtgtctggtgagggcccgttccaaatagacggcaccttctgtgtcttcatgtggctgaaggggcaagggggctccctgaagcttcgtttgtaaggacgctgatgccattcccgagcttggagccctcatgacttaaccacttccctaaaactccatctctaataccatcatattgggtactaggtttcaacataaataaattttgaggagatatcaacattcagatcatatcaccagtcatttgtatatttattttgccaactttatttaatttattttgcacctctacatttccacgatattcttccatgatgattaattactgttaaaaagaaggaaaaagacaacaataaaggtcaaagtgaggagtcctgctatacggccatgttgtattaaatgtgcctgtgtcacaggatgcccacacatgtggcccacttttttgtagattccactacagtttgataatagcccttacctggtcaagaggacccaagttaatagcattgataaaattcattaacatttcattttctcagtcatagcaattctcgatcagccccgagaatatcattctgagcagcttgtgttgcaaacaatttacctaatgcagttgatttacataaatctccttctccacatttatccaacagtagggtttttaatttccattatttttatcaactctgataaaaatattaagagcaaggaatttgctccctgcagcagcatgtgatgtatgatttgcattagagtccacctagtacttattgcttgataccttcccatggtcagactctcagttctagtccaggaagtaaacatgtttcctacaagttaactcaattacatagtcccctgaattgcagcaaacatttcttatactgagccacttgcatattctctgtggtagctgacacttcataattcctaagggaaggcatgaagaattagactaaattccctggattcagaaagaaagggaaagggattaagatgttgaaattgctcaggctctgctgctgtcattgttggaggaagcaatacctgtgtcaggtgcaaaatgtaatagttctgattacctactacctatcatctgggacatttccaattcacacctaactccgaagtctgctctgtatcaaaagattctagggcatgctggcctagggctttctttcatctcaaatgatatcacttttcttctcatttaaaattcactctgaaggccctaaagtcgaatatttgacgtagatgtttccatgaaagcaattttaaaatacactttcttttactgtctgttctggaatatctaagagtctataatttgtataatgtccaatctctataccataccctggccttcagagtgagggctgtaggacctattgccttttgtgctctgggacttgtgtttgttttatgagagttttataaaaggtagtctgcagatcatctgcttcaacattacctgggaaactcgtttcaaaggaagtttctagagccctaaccctggccttctgtaactgggggtgaactctgagacgctgcatttgtaaccagcttccaggtgactgtgaagctacctaaagcttgagaagtgccagattaactattttctgttttcggagagctttcacccatgctatctcattctgtacatcataacagctttctttacaggaaggtgccttcataatcacaaagggtgaataaacattctaacatcacagagacaacagaggcggatctagatgtagctttcacagtgtgctttctgggccagcagtttcagtatcatctgaggatatgttaagaatgcattttcttgagctcaccctcacactttctgaatcaggaacccttgaggtggctttaaagagccgtgcaagtgactctgatgatctataaagtttgagaaccattggtatacctagtgtatggttttacagcatcctggtactagctgcatgccactatgtatttaaattatctacgttaccaatttctgtaaagggctagacagttgttagcttcagatcccaatttcttttagagaatatcaaggactgaaagctccagaagatatttttgaatcaatgccattggcaaatgatgcctttgaaacagggaatggttctaccaggaaggtaatggtctggactcttaaaagcagcatcaaaatagcaccacaagacccatcaagttttaaattagataacagacttctaagttaaagctagttgagttgaatcttggttttgacatttaccagctgtgaagctttttgaaaagctaaagaatatctgggagaattacttttcatacctgaaaaagagtataaggatagtaccttcctttcacatggcaattttgagcattgcatgaggcaatgaatgaaagtgctttgctgaggatctggtaataagaaaatgcccaaagaatgttataaggcacgtaaccacacatatgaattgcagtttcctcactcttagttccctcattttaaattttgagtaattatagtgtctaaaagtagtgagcttcagtaaaaagcagaaccgagtggatctctgtagcaatagaatctacagtctatcctatgaaagatgaaagaattcagaccaatcaatctacctacatctcctgcctctaggactaattttgacacgtgttaagtacttgaggaatagatgtgtgaataattaatcaatagctgtgttttacaaaaggggtgcttttcagagttcagttatatacattatttggctaatattcccagtgattccacgaggtaggtataattactgatgtcattttacagaggaggaacctcaagcttgtggagatgactaaggtggaatggggcagcaacccaggttatctgactcagggatcctgttcttaattacttttctatcatgctttaaccactatgcagctttggctggtaatctctagcaataagcagcaggggcaagaatggttagaaataattttttaaggccaggtgtggtggctcatgcctgtaatcccagcactttgggaggccgaggcggatggataacctgaggtcaggagttcgagaccacgctgcccaatgtggtgaaaccctgtctctactaaaattacaaaaaattagccaggcatggtggcaggtgcctgtaatcccaactactcgggaggctgagacaggagaattgcttgaacctgggaggtggaggttgctgtgagttgaggtagtgccactgaactccagcctggacaatgagagtgaagctccatctcaaaaaataaaaataatcataatttttaagcacctgtggataggacagtaaaagaaattatgcattaggttgaatcagcaatatatttttgtgaattcagtagctagaagctaattaactcctagccaaattgggaagagaaggctttttattttgtgattaatattttaaactatgttcttgtaagatattatacaaaaacacatgtaaagcacttgtgtagctgaatgcattattgcaaggtaaatacttttaaaccacctctgtgaggatcttaaacctcgtcagatactcaggatgcttccccaaagccatcactctgcacaaaaatgacgactattctcacttatatgattccctccttgttgttaatgtgtgtgtgcattctgaaacactatagcttaattttgccatttaaacatttttttttaatctttagataggcttcttcttctttttctttttctttttgacagaatcttgctctgtcacccaggcttctgaagtgcaatggttcaattttggctcactgcaacctccacctcctgggctcaagcagtcctcccacctcagcctcccaagtagctaggactacaggcatgtacccccatgtgcaactaatgtttgcccaggcaggtctccaactcctgggctcaagcaatcctcccaccgtggcctcccaaagtgcagggattagagatgtgagccatcacacgtggccttagaccttttacgtttattttcatctgtaaattatcctatcatcctatttcattgaataaatgaaataatttatttcataatacaaggtttctcaacttcagcacttattggcattttgaacaggacaattcttgactgtgggggactgtcgtgtacattgtaggatgtttaggagcatccctggtatctactcatcagatgccagtagcacctcctcttcagtcgtgacaagggaaatcctctccagaacttaccaaatgtctcctggaaaataaaattgctctgattgaagagctctgctgtgttttccctctgtcttgttaattttctgaaaattgcatcttggatgagtcttagtctgattcagattcaatttttaaatttattttatttattgctaagactacttcctaggtggcatggggacttccctctggaggcacataatgttggtaatttctcttgtgatgtcagccacccctgatgtctgatgattagatcctttataagggagttgcaaaatgctgacattccaattctctcatcccttggtcactgctttgtcagaatatttgtgtcaagatatgtcttgcctcagcaatgatttgtttgccaggatggctagaatgggaaaggccccatgtaagttggcccattgtttttccaggctgtcttttacctagtagccagtcttccccatttttgctatttggacacacccttctcagctttgaagaagcagcttatcaaatgagacaggaccagtgtggccctcctggcccatttctgcctggagtcaatcactcctatgctgtcctggctcaatgccacttaccatgtcaggcataataatgtgctctcacgtccttctttcccattagtcagtgagtaaagcaaggctgtctcactcttctttgcatccccactgcatagattggaaccaggcagcctgatacctggggaagagtgcaggctttgcagggagacaaacgtggatccaaattccaaatctgaaaaggagctggtggctaattcaagtgaggcactcaaactttctgtgtttcagtgtgttcattgtcaaaatagaaaaaaagtcatttctctcagttacttttaagggtcaagtcatttggaaacagtgttcatgggattcctactcaatatacacgtaaggtattctttcctattgtaatagtagcttctatttacccactcaccatgtgccaagccctactacataaaacccttgtgtgccttctcgtgtgatccccctgcagtgcccacagcctattacaggtaaagcatcaatgtcataggcaaatgatgcctttcaaacaggtaatggtcctaccaggaaggtaatggtttgggctgttaaaagcaacatcaaaataggtaaagaaaatgaggcttaccgaagttaaatatcttttcctaaatttccaagctgatgtgagttgactctgcacttaaactcagaccttactgatggcaaaattcactatatatcctgcctttaattgggtattacaccttgaataaatgaatgaatgactaaattaatagaagaagatgatactaggagtttattagcaaataattatttcctcccagacagttctttttttctgggaagtcagttgaatctggagcttacattttacacgtgggttgaggctacaatgaccagtcagagagagccctgacttcagtgtggacttctgagggaagaggaataccaggtgcccagtctgacttctgctactggttggcggtgtggtttgtataagcctcacatatgctcagacactacctggcacttgtttctaaccagctgttcaccttcctatggtgaggggctcactgggccacccagtccaatggtgagcacagtttcctggatcccagccttttcatctgtcctctgctattacctgttaaagtgtgagctttctatttgacacctgggcagaccaagctcagctgagccctgacctggctagatgtcagggtgctactggcaggaatttaaactgcctcaacccagggagccagacttttctggaaaagaatgtaggtgggcaagcagttttgtggtttactccagggtttgggaatctcctgtccatggcctctgggaaggaattcattcagatgggaagatgagagcctgttaggcagctcctggaaagggaagccatagcactggggaagcagtggccctgtgcagggtctggaggactcagtcctcagcaccttttctccccctgcttcccttcccccaaggacatgtgatgtgacttcacataacattttcttgaattcattctgtgttcacactacaaatcacatctatgtttccaacaaaaattaattcaggacagttataggtacaatatagctgtttgaaattaatacattttattttagaatgtattcagaatgaaagtttttgagtaatgtgatcactttatggtttggaagataaaacaaaacaaaaacaaaactcaggttctcttgggggtgttcaagccattgatcctgacagataacattatactttgatagacaaccaaagtagacccccattttgatagggctgtattacatggtagatgctttttttttttttttttgagacagagtctcgttcagtcacccaggctggagtgcagtggcccgatctcggctcactgcaagctccgcctcccgggttcacgccattctcctgcctcagcctcccgcgtagctgggactacaggcgcccgccaccatgcccggctaatttttttgtatttttggtagagagggagtttcaccatgttagccaggatggtctcgatctcctgacctcgtgatctgcccgccttggccttccaaattgctgggattacaggcgtgagccccagcgcccagccctgtagatgctccttaccttccctgtgcaggtcattgtttgatggccattgcactgaatggcttatctgtggaatatgtttatctatttcatactgatattcagaacatgtaatttgatagatcaatttaggtatttaagagaaatattgaggtatagaatttagacagacatatgcatatagtattaacgattattgtatattcaacatatataaattattaaaatgtgaattttgatatatgaaagcaaatgatttgagagatagcttttactggtatgatacaataaaatacaatacaatttggcaaggatttattgaatgatgatgatatttcgggcactaccattgcatcaatatgctagagatacaaagatgaataaagaaagaaacctttcttaatgaagatcttgatgcatcaataatctaagcatgtgaagaaacaaccataaggggaaataacagcagggaaaagaatggacaaattaccaactcaaaaatatcatgagcaaaatgatgactaaagaacaaatctgtgaaaactcaaaacaaatgaagaggtattttaatattttaatacagagctcttgcaaatgaattagaaataccattgctcccatagaaaagaggggaagcagctaacaatacaattaaccaaaattgtatgcatgactatacccacatacacatacatgtacacgtgctcacatgaagaattcaacttgttactaatcaaagaaagatattcaagcaatgcatttatccctttacaaattttgttattgttattgtgatgggatgggggattataatgagcatttaaaaaatcatactggtgtgtttgttaattaaaacatctcttctggaaaataatctgaaatatgtacatagatgtttaaaagtcttacctcttttgacccagtgatttcacttctaagcacccattctaaaggaataagcaagaatgaagacagacattaatgcacaggttttttttttttttgcatttgtacttataataggaaaatgttaaaataccgagtagcccagtagtaggggttgaatggttgtatagtttactgtacatcggacaagcaattatgcagctgttagaggcagagctcccagagacttctcagtagaaatgcatgaaaatattcagggtttatattaagtcaggtacgacagaagaagaaaaatctcaattgcatttaaaaatagaaaaaaaatagtgtaagccaatgtttattttctcatttatacattttattttctaaaattttgacactaagtctgcattatctgataattagaaaaatatcaagaagtaaaacttaaaaattatatggataattataatgcaatttgagctgagagctgtgcaaagaaaagagatgtttccaggagatggatcagttgatttcacttgatgaaacagtcagagaaagctagagaaaagagatgaatttttaaggatgaaggcataatttgcccggttagacaagaaagcaaggtggtttcaagagcataggttatgcgaatgacagaagcataaacatacctggcatgttcaaggagtgaaattgatctggtgtgactggggcacacactctgcaggcagtccagaggggtcaactgaatcaagaaaggtagagaggaacaaggctatgagaagcttttcattctcaggccatgctgaagagtttaagcattaaaacctaatcctagagaattggagacacagcagaatgctgattggaacacgcacacacacaaacacacacacacacatacacacgcacatgcatacacaatagtgtaaggtaaattttgtcacaagaatcaaagtaaaagcatacatttaaatgtgtgtacaaatactttttagaaaacatcttgagaaaaaacattaatttttttcataataaaatgcaaagcaaaccatgatagaaaaaaatgcatttaaaaataatatttcccctcaactcctttttgtgcttcaaggctttctgcccttaaatagatctgtcatagaggttttcttggtcagccgccctgtagcaagtgttccgtcccatctgtctactagtagtcactacttagattgcaaactttgtgcagagaggagctctgttgtatatgccattgtgtccctcacacctggttcataggacatgctcatcaatagtttcttcctgaatgggtttgcaatgccttgcatatgaaaggctttgtcaaaattcatgaagtggaccttgctaatgactcaggccacttttagcttcggaatcaacacaggcatattaggccggggtaatttcacttttcacatccaaattggtgtttatttttaaattatttttaaacttggagacaaaaacagctggattatacattgcttacagccaggcagtcagcagccccaggttctggttgacattctgccaaataccccaaatggcattagttgcacatggttccctcagttttctcccctgtgaaatgaggatctggagtctgtctaggttcccgattccaggagcctcccacaggaatctctattgcttacctgccttgtgatttctagtgcctcattcagcagaaaacagcacctgataaatgcttgatgacttattgatcaaaaaaatgtctattagactagaattctttatattttgagatgggttacactgtcctatgaagtttctggaaagttctggcaaatatcagcttcttgcagtgtgatggggattgtattcaatgatgtatttaatgggggaaacaatggttttctttgggggctctctatactgctattgggggaatgatataatacgaagtagtgtcttcgctgatgctaattctaaagctttcctgtcactacggggatatcacatatgcctgatgccaccagaagcacgaatgtatcacatgtctcaagcaaaaggcagaacgtttgagctcggtaaacacactcacattcattcactagcagggatttgtaaactgtttttctacacatggaaatagcagcgtgagggcaaaatactgtaaagtcttatagccagacaccatcacagattgagctcttgaaatttcactttcagtgtcagggaggtttctttgacttttccatattgtcaaaatatatgaaagaaatatcctgcaaaattaacagaggatgcgattatttgctttcagtggcaatgtaccttggcatagtaggggagggtaaggattgctagagcaagtgatcatagttcacaaatcagaggatcaacctaattgctaccctctacttcagaaaacttacccgtctctgtatttccacttctgtgaatgaagtcaattctggtgttaagacacagagagcctacaaatgcatttctggctaacattaattgaagggaaaatatttgagaagagtcttctttatctttgatgtgaaaaagtaagctgcagcaaagtcttagagatgaacagaatagcaaaatataggatgtttaatttgttttatatgttccaccaaatatttgtgaaacttgatacttctgagtcctatagctgcgtaatgacgtaatatttaatttaaaaggatttcccttgtgaagcatattgtgttgattgtaaaacctgtatgtttccttataaggtacctatagttcatcttttcactgtcttgactacagggtacatggtaagatattgtgcaggtgagatgtgatgcagcacttgttaacttctttctcttttctcagtttccattgcatttttgcatttgagttcacatttatagttagactaggcaatacactcatctccatggttattagttattctctttacatcacaatttcactcttctgcacatgtgtctcacaataagatttgtttttacgcagctgtgaaaagaagctacacacaattgaggagcttctacctcatgccaggctcagagcactattatctcattttatccacatgtaatcatcagtaaagatgcttatactcacttttttttcctccaataaggaaactgacatctagagagatcaagtgattttctggtgttcatatgttagcatggcagagccagaagttagacatgcaggtatctttactattttgtgacctttgcaaaagcactgaaagctaataggatttttctttttctctcttggaaataacaagatgcagtggaaagtgtatgggatgcccagtcaggccattctgggtgtcttttatactcctgatatgccctcaatgggttttaggaagttacctaagtctcttgggcctcagttgcccctgagaaaaatggggttgatcaaagctccctgcttcggtgtctcggattagaaataccatgtgctaagaaaatgtggcacatatacaccatggaatactaggcagccataaaaaaggatgagttcttgtctcttgcagggacatggtttaagctggaaaccatcattctcagcaaattaacacaggaacagaaaaccaagcaccgtatgttctcactcataagtgggagtttaacaatgagaacatatggacacagggaggggaacatcacacactggggcttgtcggggggtggggggctaggggagggataggattaggcgaaatacctagtgtagatgacaggttgatgggtgcagcaaaccaccatggcacgtgtatacctatgtaagaaacctgcatgttctgcacgtgtatcccaggacttaaagtattgaaaaaaataccatgtgctgccaggatgggctggatcaaagggagcccacacttgtttccacctttttctccacccagtctccttttcttcaggccatgagacatctatgaggttattgatggatgctgctggtggaggagcagctcagtgagcctgagggagggaggttttttgtttttgtttttgtttttgtttttttggtttgtcggcatcaccctgtaaaagaaaagaacaaccaaagaagcaaaggcagttatgcctttcaagcttagatgcaggaattggaagaggagtttgtgggagataaatcaaagaaaattgactagaatagatacaaatgaaatttgagtttaacaagtgccggagtggtgaggcaggatttgggatcctcttgctgaaacacaattactgcacctcaagggagctggcttgttggcaaactctcaaggcacaggtgcactcatctcattctacggggactgcagctcacagcccctcccacaggcagagctctaggtagtcagtgagtgctgccttcttcttcctacacatgctcacatcctttttcaaaaagaataggtactgtgtattagactctgcccataaatcaggtgtaagataaatcaggcatttgattccattcaacatcttaatcttgatgacagccctaagaagaaaacacaatcatttatatgttatggatgagataacttggtaagagaggtttaactacttccctgaggtcacacagctatttgggagagagttggtgtatccaataccacattgtctacgctggctgtgcaatagcacattgtctagggatggcatcctgggagcattaggatttgcctgcttcatcagaggagataaatcttcagggctgtattgcttgttagcaatagagtctcctgaaatatgctttggctgtcctgtgaatgccagtgattcaaagatccttgccaaaggatcatcataaatcctgcttagacagagaaatccctaatggaagaagggttctttgcagtgtcccacagccttgagcattagtgtggagaagaggacaatttgcaacaatgcttgagtgagagtcaagaggcctatttacatggtcagggacacagatggtcccgtaagtaggatttgatgaagagagccccctcatcccacttggagacagggaaacgggctttaggacagtgttgtctgaaaggccactgccacatgcagagtcctctaatcctctgcctgagtggctctgtttctttcagagacaagaagcttgtctgacattctgtcccccagcatggtgacaattaaaggcatgactgagagccattcctttcaggcctactttccccccatttttccctatccaagtctagctgacagaccaggctggcagtgcacacccacaaatggtggactgatgagcagacgaccagccatgcaagcctttccttccatgaattcagcctgcttatgtttgccagggtgtactatgtgtaggacacagtgccatgttctagagagtgtaagatttgagacagcaggaggaactagtgtgtgtgtgtatgtgcgcatgtgtgtgcctgtgtgtttggtaatttccaagtatatacactttaatagagaatattaaccatttcttccacctaaggatgtaagatgatttaatatttcttttacaatgtttgcattgttctgtataataattaggaacaagttaaagaggaaaatactattttgaatgtgggtctttatcactactcaaactctttctttttctttcagttaagttgtttttatttattattcttctctctcccctcctcttctctatctctgtctgtctgtttgtctctctctgtgcacacacacatattctgggggaagatatgggcttggaaatagggaaaattacacacaagggtacatccataggaacttgtcataaatgttccaattcttgggtgctttcttgggactttggaaaaagtcatgccattgttcacatattgtgtgtgtgtatatatatatgaattatcttatagcaacaatcctataaggcaggcactactaggatcacattctatgtagagaaactgaggttcagagaagttaagccggggggttgcacagctaccaaatgatggaggctgggtgtgaaccctgagttttttaaatccaaaactctgaactcttgctatttcctgcagttttactgaagggcagtgacagacagttaatttgggtatatcgagctggcactgttttattacttttagcagcaatgtgtcccctttggagtctgggtgttttgcacagctctgttctctgtggcattcctatccctgcttctgtagccattcaaaagaataagggaatgaaagttaaatgaactccccaaagggcagtcaccaggagtcaataggtatttgctttattctatttgtttgatttagaacaaaacaaaacaacaaatgttccccgcctctgggtccaaggacttagccacagctttagcaacagccatgaataatgaaagagtttccaagttatctgaaaacaaccatgacatcaaaaagacaaccaaatgaaactcaggtgtttgcttcccctctccattctccaagcatctactttctgcaaggccttgcttctcctgatgctgtctgtggaccagtggtggcctcaccatcacctgggcacttgttaggcaggacctggacctcatcccttttcccagacctgctggagcagagtctgcattttaataaggtccccaagtgacttgtacattacagtgacagaagcacactctgaagaaagaggaggacttacctcccacccagagctaggtctagtttgggatgagtgagtcactggcccagggtccaaaatttaagagggtacccaaaaaagcagtaatcaacaaaagcaatatattaaaaaggaaggccaagtgtggtggctcacgcctataacatcccagcacttcgagaggccaaggcaggtggatcacttgaggccaggagtttgaaaccagcctggccaacatggtgaaaccccatctctactaaaattataaaaagttagctggatgtgttggctcatacctgtaatcccagctactcgggaggctgaggcatgagaatcacatgcagaggcaaaggttgtagtgaaccaagatcatgccattttactccagcctgggtgaaagagggagactctgtctcaagtaaaaaaataaactaattaattaattaaataaaaatggaactggacaattgcagtcttctcccttctggatttttgggggagagggcaggggaagcttatggggtctaggtttcttgttttctctaaatattctgaattttcagcaagtgaaattacattgagttgtttccattttggtccacatacttatatattattggattttcaataactgtggttagacacaaaaaaatgtagcattgtaacctaagcatttattctgcaaggtcagttcaaatggccaacatagatcacactaatgatgatgataatgatcaaggtaggtagcctttattaagagcttgctctgtgctgagtgcattgcatgaattaacttatttaatttttataggaaaccccacatgggaggcacaccctaatctccattttagcagtgaggtgatggaggtatgcagaggttgagtagctggtttaaggctatccagctagtgactagaacaagttggatcaggcaacttgcccagagcccactctttactactttacaatatacaatacaatagtgtaaaataaatttaaattgtttttaaagttctaaagcaatttcatgcatccttttcttcaatatacaagtatttcactgccaagtgtgtttccattctgaaaaatctacccctttaggtttttaagttaaaaatgctccctaaaacaataagagtaatagatagatgatgtcatttactttttaaaaatatccataaaattttggctgccaatttaaaaaaaaaattggacaagaagatgctgttagttcaagggaagacaaatagttcgaggtcctcccttttggattgggaccctgccgtgggctgggggtaccatgagcctggtgggcacaatgtgatcctgcctctgccggacttggcttcttctctgcctgttttgtagcaaccactgcacttgtctttcttgcttgtgtctgtgtgggtctcattagcagtgggtgtgtgtcttaccacagtggctcattcacagggctgctggcagtgccagggatcaggagccgcctctccgtctgtccagaacaaagctgggctgagccctctcacggtcctgtggcccttggtctccccacatgaggtgtcccgagattgaagagagaaggtgcctcctggcattgccaaggctggaatctgcctgtcaaggaagtccctcggcggctagctgctgcaccatgaccttcgtgatggtggagtgagtaggcactggaatcaataagcctggcctctccatctgccagcctgaatgcaggtgccagttactactacccagcagggacgagggacgggaacggtggcgcatagatcccagcaaaggggattggcttttgtggacacaagcttgaggctggcagtgccgttttatttatgtcttgtccctgctgtaacagctgccgcctctgtatgcctttgctctttctgtactttcggctcgggtcacgatcttcctttgattcagagtttgtttttattccagcctggttgctgctgccagagccatggctcaacggcttggcctggactgttgatccgcatgtcaggagtttccaaaagtttgttccggtctatctttgagagaaatagcatggactggatcccatcgccagattgtggtgtctggggacacgcgcttggggcactatttccatcttctgtctttgtctggtcccctcctcattaaatcttcctgggtctgtggagctgactaccaattggtgcctgacctagttacagagagccactacgtaaccccttactcatcaccataaatggatcataaccgtttgttcactgtgattcaaagtggactctgctattttagagtcgtttctccctttttggagtttgcgcatgggggtgtatgtgcatatatttatacatgcatgtgtgtatgcacgcgtttgtgtgtgtgcgtgtgtgttgtgcagctgcctaaattaagctggcattttccgttgctatgtggggactctgcttttggaaaacacttctgtggcattgtatggaatcgttaacgggcttgctggtttccctgccttgacctcctttcattttccactgggaccactttctcttgagcataggttctcacattttctgctcgaggtgtcagctctgtggccactcttctgccaaagggcaccagggagttcctcaaaggaccttttgaactgtttgttcaatgaatgaagagttcagtcggacagtgacgaggacagcacatacctctgattggtccctgcctcagaattgctgggcatgactcatgcatttggctcttgcctctgctgatctcacaagccatgtgggaggttggtttttttcagcgtctcccagagtctgtgaccttgtcatcaccattttgccttgcattttgaaaaatactctccctgaacaaattgtgtttataaagtaacaagcaattccttttcctatttttagttattcatttgtacctattttccaatcagagtttctaatcagtatgagttaatcagagttaacatttatttatttactgagcaccttctgtgtgactgacctataccaggtgctggcactaggaaagtgaacaagattcagtcttagcaggggtttccaatgcataataatatttctgttaattcacattaatttgggtaaaatttattgctcacccatggcatgtgtggggtggtgccaagtgccttatgtataccccttctttaatcttcagggcaatgctgtgagtttgtcattagagataccactttgcagatgtggagactgaaacttgtacagttgagtcgagccattcactcaaagtcacacgttcaattacagggtagaggcaggatttgaaccctggattgtcagactccaaaacttgccccatggagattatagtcaccagctccctgcattccttccttcactctcctactggataggtgtttgcttttgtggacatgaggagtgtcctatgttctctccatgttccgtggcttttggtttagtgtgaggtgtctgaatatcctggggacaaatgaatttgttgccccataaaataacggagcttctagctttctaagatattaaacttacttacctcttgattgttcagatggggaaagtgaggctctgagtgcaaagggatttgccacaatcgtacagtggcagggtctggacttatactcagcagctctgatctacaggctgatggggttattggctaatttattctgagtcagatggcaaatctcaagagttctcctgggaaattctatccaggtttgaggtcagagcagccaaaattagatacaatgcaagctcatgaggggcaaggttctaatcttgttcatcaccgtgtccctggtccccagcacagtcctatggtgcaattggtggtcaactgatgtgtgttggaggaataaactgggtgaaatgaaaggggcttccagggagaaccttctaaggtttgtgctatgggattggtagttgcttacctttcttcctgggttctgttaacccaagaaagtattttagactcaaattgatggtatcaatatttaatttgacacttcgatgattcagtcatttggtattgtaaaactatttttccgtttctattttggaataaattggcttgttctttgggcatctctgggcagagtagtttttcctggctgtacaaaaaagaggatgctcaggtatcggtatttgtacccaagctcactttagatgtggccagctcaggtgtctatgttgcaaaagaggtactccatgtgtcatgaagtgactacaagattaaaaagtgtttccagaacagacaataccttaaccatcatatcagaaataaagaagagaggaaagaattcacccagaattcattcactctgactcacgaattgtccttattttcttcctcctactattcaaattagtcagaaatatttttacattattgtaattggagtcgagatttgacgtcataatgaaccatgtggaaatagtcccaagtattttcccatgtttctttataagtcacagcattgtgactttggggaaagcctgctattccatgcacagcatgtattctgttttacttaaacgttctcctattacaacaaggcaattgtaactttatgggaatgtaaaagagtgtttcttgttggcaatatgggtgaaacttaatgagattacgcaaagaattgcaataccgacaaggtcctttacttcaagtgagtttttctgtttggagtcagcctaatgctctattttcctaatgaaatgagaatacttaaaacatgcatagggaaacatcaaattagtcaatattagaattatttttgttctttttctattttttataatttaaataattaagatgacattgaaagcaagcatctttcttaattgctcagagcatttttcttatttctgaaaatgggtggcatttaactgagagacaaaacaagaacatcaataagaaattaaagcgaatggcttagaagtgctaacctggtctttaatgtttcttcgggaaaaaccactagaaaagcagaaaactgttcaagtaaatccatctgctaactttcaggtcaaacctgttaggattagttctttaatgaggttacagggttttgggcgatgagtgtgcagaaatgatctggtaatgagctgacttcgaagagaagcttgagagagctttcattaactgtgtttgcatcataatttggcaaggtcacgggagagagtcttctttaggccactaaaaatagacagtctcatagatccaatcatgtcatcatctctctccctcttttttttttttttttttttttttttctgtagtcatatcttatttcgggagctcccttcattcttctcacccacctgcctcctctggaaccctgtgattactttgtttaagacactgcctccttgtgtgctgaagaagagaggaaagacagggcatttcaggcccctcactcacctgattactttatcttgcagtttcccttcctccctccttccctctttcccttcctctttcccttcttctctcatttccttcctttcttcctttccttttttctctcttcctttgtctctccctctctccctgccccctccctccctcctttcatccctccttcccgcctttctttcttctctctctccttctctccctgccccctccctcccttcctcccttcttccctccctccctgctttccctcttctctctctccctcccttcttccctccctcccttccttggttccttcctccctcccttccttcctccctccctccgttcatttctccctccctccctccttcccttcctttcttccttccttcctctctccctcccttcctcccttcctttctccctccctttctccaattcatcctccctctgttcctttctctctcccttcatccttccttctttccttcctctctctctccctcccttccctcccttcctttcttcctccctcccttcctccctttcttcccttcttcttctcttctcccttcttccctccctccttctctttctctgtctcacctttacataggtcccaattctatgtgtcagtgtgcatagaaatacttgatatacaattatttaaaaagtaaaaacaatgaatgagctccatttcaaagtaaaaagaatgaatgaatgagcaataaagaagacaaaacaataaatcaatgagcacaatttcaaaggaaaaacaatgaatgaatgaatgagcaacaaagaagagaaaattcttgagagaatggtggggctagaaagacttctgcttccctcgaaagcatacttcgctactattttaatacctctttctttcacactcttgtacccccactgccaaatgtgtgctctacttacattgtgtatgtgttctatctatgccttgtcatctgtctgtggttgtatgcatctgcccatatctaaacatatacatctgttcagaatgaggttctgtaaaaattcaaaggattcatttaactcctggattcgtcgtttctctttttttttttttcctgttgactctttgtatttcatgcaggttttggtaaggaaaattcttaccctaacctctaaaacatatagaatggataaagtagagcttctgtggattaaatagaagaaaggagaaagttgtaggaatctgcagaagcctccctccagctctccccaccacaccacagcccctgcaacagcctttgggataccccaggaataccactgtttgccaagaacagttagtaaaatcactagattagatcactgctgacttttcatttggctcttacatcctgtgatttgtgatgtctctgatgtcaaactttaagtccaggtctctgtgtttatggtttgcagcaaatgcagatgattctgaagtaggtactgtaggagctataaacacgatgcagatgacagagtttctgcttttcataacctcacagggactggaggagcaggcagacagttgggaaaatggtttcttaaaacaacaaaatgttcaaacacataagaacagaatgactgataaaggtggttgtaagtcatagttgttgcctctcatttcatcaaatagttactgagcatcagctatgtgctggccacatgtgtattgctttaaagaggtcctaagaagatatgatcccctctctgttttattaacgttttaaaattttctttgtgtaagttatccctgtctaattctttgctgctaatttttctgtttactttttaactctaccagaggctgaacactctgtaaaaagagcaatcttacctgtttggtatccagggatttgactgatgcctggcacataatagatgctcaagaaacatctgctcacagaattacactgtgtcattatctccaccaatcacagtggttggcggagatgatgccacagtgtaagctttgtgcgtgtgtgtagttgggaaggtggactgtcaggaggtgatatttggccaagaccttaaaagacaaggataagtttgtgaaaaaggaagaggaagagatattcagttcagaggcaaaagtaggaatgaaggaggcagagtgaaacaatatggtaagttgaggcaaagcaatgggttcctagaaggagcttccccaggtgaagctgaagaccagtgaggctcactaatgaagggctttccctgagggcagaatggagtggtgcttaagagaggacgctctggcgtcagactgcatggatgtgaatccctacaagcaaggcaggtggcatcagtaactcaccctctccatcttagatttctccactttcaaataggggttatctatgcaacaatccactttagcacagtatctggaacatagcaggcttggctattgttaaaagtagaggagaccaatccaaggagaccttgagggctttgcaactgagagtggcatgagcaggcccctggtttagggtgtgcctgtagcagctgtgtgaaagaggggcttgctctcaggtccttctggcagaaagatgctgttgagtatcttcctctatctccttccttcacctctgtgggccagtgatgctgttctaagcagcccaataattatctttccactatgtttaagattgttgctttgtgtcttgcacagggttgtctctgtgggaaccaatgggataaatagtatgctggcatcagtacccagaatggctgcaatacagctcagcagcagttttatcttcatgggtcctgcggtcctgtgccaggtcgtgtgtccccgtccctttcgtgaagcagcccttgcaactaatatgactttagcccaagctttgcatatgaccttcattcaaattatttcatgctgttctttctccttttcacatatttagtattcaaaatagtcttatatgtgtttgtactgtatgcacctttgtaggcggcctgaaattccctttggaataaaacaggatattggtaaaatgcacggcatgcgtcacagggaggggcatgaggtggagagtgggccgggtgagtcttcaacctagtttctttgtgaagacctactttcctgtagggctttagactctgctccctcctccaccaccatgtcggaactggcatttgtctctccctgtaattccttctctgtccttggaagagaactgtgatcatttcttgcagtcccctcgcatagctgacctgacccgtgatattaatgaaaatgcggtgcagagaccctgggatgctggaggcagggtctggggcggtttagatgctgtaggcaccgctcctcacccatgtccccgttgggcctccgtctccctgtccataaaataattgtggtgccatggatccgtgttcctcacctctcagtcattcaggttttgtcttccctaatatctggatacaatcacattgttatttacttaatattttcttttgactccttctactttctgctatttaaaaaaatatttttgaagaaaattatattgctctaatttctggaaagccagtatctcttgtcataaatatgaggcagtcaaaaaacagatacaattaaaaggaaacaacataattgaatcctctctgagcctgagactgccttgtctttgttaaaaaaaggtttgtttaggaatcactgcaaacagagactttctctttgctgacatcaggactgagaaagaattgaaaaggtatgtctccatttcccccatttattgtctctgaaggccagtaatctggcaattggtggggcccctgttgtgtcaggtattgcattaatttctttatgttgagtctttgtaacagaaccctgatggtattgacttatatttactgaacagtaaatttgtgtcagaaacaatagcgtgatgtgcacatattatcacctctgtgctcgccacaggaatgtgaggtgttatgttgctcattttacaggtaaggaaacagagtcctaagccacagaactgaagagtcatggaggcccaaacaggaatcagcttgcagctgcatcttatgccaaagtctttctaattccacaaattggccccttggcttgctgggggacatgcccctttggtttggctcctagataaggtcctctgggccttctctgaggaccatcttgactctgaaacctggctgtgcctacacatcaccctgagagccaaaggtgacccctccctggccgccaaggtcttctgcacatgcagtgtcctcttgaagatggccacatcatggtattgggtttggcccatgaaatccccaacacatgttgaatactagagaagtatcagctcttagctctgtgtttcctgaagtgtggttggaacactcataaagggaggtgggatgcttttagccaggggaactgattattccaattacaaagttctgtcatttcaaagtaggaaacaatcttactgcccatcaaatccaccctggtacccaatgccaaaattcatttacttactggataaggaatgtgactgaaatgtttacaaatataaatgatcaagttatgaataacatacacatgcatgtgtgtgtgtgtactgacacacatatagatactattatatatctttatatctctgtatgtagaacatttgcagatatcaaagccaaggagtcattttaaaagcctgtttagaaagacaacctccttgcttcttggccttttggctaagatcaagtgtaggtatccagcctcattttcttgatggaagccatatgatagagaatatgaatattgtagaagaagtcctcctgaaacctctgatccactgatttgcagacaaacagggccatttttctgtcatttccacactcatgatccaagcacagtctggtaagatgacccagctccacatagctgttgacagtgctttttttgttcgtttgtttgttttttctctttattttcagttcttaacaatggagttagtaaaagtaaccatccaaagagtatttaaaaaatgaaaagaaaaaaacatccttgagaatatgtgttttgtgtttgtgtgtgtgtgtgcagtcacatttacatctaaagcacacacacatgtgactcacaaatcgaggtagaatagcctacataaagcttcctatgaaaatattagattctcaatattgacaaatgatttttcgcattcttcaagaatgtcacaatttgtgcatagcagtgaagaatgttcttccaccaataaagtccagcaaacgcgaaactgaaacattttaatggcctgattcccctgccgaccctgggtgaatccagtgtatttaatgaggtgtgatgaggatgtagagcacccgctagactctctccctggctcacgtcagcccctctgtggccaaattcaaatttgtgcctgaagaaaatcagtctccacttactgcagcccttcagaagcacttgtaaataggtgagaccactatgtccagggctcagatttttatttactaagtcattggtttgaaagctcttttgaagcatttagtttgtgcctttgtctacctgattataaagtggacaaggaaacatatatgcttcttatccctgtggagtttatagacaagcagagtttgtacagcttgtgtcttcagagtaagtgcctaggaaaaggcaaataacaaaatggcatttttttcttaacctaattttatattgcaaaaggatagtcccacttaattttgagaaacctgattttgtttctttctgagtataatggccccagagggaactctctcctattatatcataaatcagttgtattgctatggactatgcagtttacttttcttactatggaaagatagcgggaggctgtgactattttggcatacaacaaacactgcagtgtgtgtgtctctgtgtgtgtgtgtgtttgcagtacttctctgactttgtgaatatggagatttgcatactccagaaacttgcaaataagcggatttcttggttgtctggaagttgcccagatttggtaaaatgtaagagactgtctcaggccttgtgtctggttaaaggtctttgtttttctttattacatgcatgggttctccttcgtagttggtttctgcttttcctggatagttaggtagcctggtaaagtgatgcagtccttagtcatgtttcttttaaatcattggactactttcctaatttagtgccctattttatagccaaagaatggagtagagtacagctgttgggtgaattgctatagatgcaaactgcctgtgtccgagtcttggcttcactggtgagtggctttgtgattgagggcaactttactccgtctttttgtgctccaatttcctagttgtgaaatgaagaaaaaccacagaacctgacttataagattgtcataagatgaaattgtgtgttgtagaaaggtacttagcccaggacctggtccattggaaattctcaataaattttagccatcataattgcctgtttggattaagttgtgtctgcggaacattcagctcctgggggatagagaaatgctgagagttagcatcatatgtacatgatggcattcatgccttaaatccccaaagatgattaaatgcttcatttggcatgtgaagtatttagaaaatattgaccacactttttcaaacttaatacttgcacaaacacaggcatttaatgccagtcagaaaatacctgttggtattttattgttaatagccgattatttgcaaaatgataacctactttactgattttaaatatttaaatattatagaaaacaaaccaaataatgccacgttgcatttatcaaagctgaataatttgtgccaaatgagtacattattacagtccttgaaaacaaattacaaattatacctgtcatttgacatcaagtagataaaagtcaataggtattttcaatcttttaaattaaaaaattatataattttgtggccattctttgtctaattactaccgttcatttatttctccaatagtctagctctgtggagtgttagcagtgtactgacctgggacaaacaaaaatgagaataatatgtgatttctgtcctcaaatagctcacagcttccttgatggaaagttgggaggaccaaatagccacaaataacaaagatctctaattgtgggagaaataaaaaagcactatgttacactaagggaatcctgaggccctctgagtttatgctaggtactgaggagaatttccatcaaagtcacactaacagtaaatggaagaagaggtcagatgcagagaagcacagaggtgcacagcctgccaggctcaggaacagcagtacttactgaagcaggaggtaaggtgggcaggtgaggctggggacagacaggagtcagatgcataagctgtgttaataaatgtggaatgtgggcatctcctgacctgacgggaaaccatttagaattttaatattgtcaagttttttttttaatgtaaaaatcaccattcttctagttgatggcttctgttgaaaaggggatttctgtttgatcatgtgcattatattcaaatgtttagatatttatacatgacaaggagacaaataagtaaaataaaatcagctacagaagaagaggttaaagttattctggagcatatgtgattgtgtgcatgctggttgctttgttcaccctagtagttctttagaaaactttacatactgaccatatgggcatccttaaaactttcctgcagcatgcttgtacttatttttgtctgcttctcacctccaccctaaaaaaaagtttaaaaagtaaaattgctagcattttaggcaaaaataaaatatactctcctggagaaagtcttttcattttccttctattctagctgttctcaagttgttaataatatagtctctctctctctctctctatatatatatatatatgcaaattttatagtgggtgtgcttagatatttccccttattctaacttttattcttctttatttggtagcaaaatcatcattgctgagtgggaggggaagagtctttggagcaagggaaatctagattggaattcccactctgccactaattagcttggttatcttgggcaagttgtttaacttctctaggttctaatttcttcctctttcatgaggcagaaataaaatttctagtgttgtggggaagagtaatttttacaaaacacatgtagaagcaccaacgcaataataccgatggcgtgtagtagatggcacgtaaaactggagcttctagtacctcagttgttaatatgttgaaaggagaaagtgaagctacataatttgggcaagaaatacagataaaatgtagtgagtagtaggaggtttgctcatatgctagatgactgtttgtttattcatttcccaaagatatgacaaaggccgtgaatatttatttagttctgctcccaatagcccttctaatagggaattatttgggtacaacgaaagacatttgtaaatgcggctgataagaccggcattggacaaggcgtgttttgttggacacaagaattctattgtccctggcttcagttgtcaagtgcccggggaacccagaatttatggtggcagcacaatgggcctttcagggctcagggaaagagctgtgagatcctgctccccggcttttcaaggcctctagtctttttatcaggcctggacaatgccggattcagcggctgcctgagcctcctgaccgtccattggccgtcaggtattgtgcagtaattaccatggtgacaatggactctctctacgcccgtccatcggcgctttggaaaatggtgaaggttgtcactttgcattaggtgcctctaaaagcatggcttacttagaaaaactactaaatagaaatgaagataatcgtagtaagagtttgatttaaaaggccactgtgtcaaatccatttggggctcagaaactctttatggatgtcttcttctaattacagatagacgttgggcatcatcctctgtacaggcagtaaggagccagccttgaagattttgcaggaagggatgagcagaggacagctggtgtcccctaaccacgcagtgggagtagaggtctaatctgggtccaggaactttgaaggatctctaaatttctttgagactcagattcctcatctgaaaaaaaaattttgcaaaatgcttatagattattattaattacatgtgataaaattgtatgttaatatttatgcacatatcaatattggttctgtataaatacacatctattaaagggtttttgaatagcaaatatacaataaaaggtaaaatgtttaatcatgcacaatcatagaagcacaatatatcttttcataatcacaactattgatttttgagtgtataagtgaagtgttccatgtattgtgattatcctccacaatcattcttcaaaataattgttattatccccattttatagtgaggaaactgaggctcagaaagttcttgcttgccccaactcaaactagcttggaggaggaaaaacttgattttaagtcttgttctctcacatgcaacagcttcctgtttctcccaattttttacaaaaaaaatcatgatctacaatcctagcttacgaaatatgctttaccatatgggtttggaactttgcaataacaggaaagaaaaacacccaatggagattattaactgagtttaatcatccgttcaacaatgtcagaaacatgtgatgctcaaaaaaggaagaagcccccatctgcagacccccagggatgactgtgtatgtgtgaccccttctcctgcctgcacagagcaacatcaacaaagcaaattggtatttctagaccaccagaaaagtggatggccgttgttcaacttcttcaccaaagaaaagttttaaaaacctgatatttcacttgtttatacaacagtaacatgtaaacatttaattatagtttgctttaactaactatgttccaaaatatccaaaatatcccattgtggtggctttttgtttgtttgttttgtgttgttttgtttttgagacagggtctcactttgtcacccaggctggagtaccgtggcgctattttggctcactgcagcctcgatcccccaggctcaaacgatcctcaagtctcagcttctcagtagctgggactacaggcacctgccaccacacccagctaatttttttttacacgtttcgccatattgcccaggctggtcttgaactcctgagctcatgtgatcctcctgcctcagcctcccaaactgctgggattacaggcatgagccactgcagctggccttcccagtgtgtttttaccaaaaagtagaaattatctgtagtcacacaccatgggaataggcatgatttgcctggggagtgggcctcctggtgggttcttaaacctagggaaaaaggagtgggtttattgatccagcccagttatgctacttccttgctctatgcacttgggcatatgccattcagcctcagtttctcaatctgtaaaacggagtaactccatctcctcgggctatgctgctcccttcattgacaactctttccattttaatggagagcctaagagagggaaagtggaaaaaggaaggatatggctctgcacgtactgagccttccacacaatcagagcttagcaaaagggagctgccacagtcacagctgcatcctccactgactgtcttccttgattttggtatgcttactgagtatgtccttcattccactttatacactctggcttcacggtgttccttttcctgatttctagtctctctgaaatagtatatagcatgtactgtctgagcccctaagaggcttagtgctgtgggcagccaagcacaatgatggaagggctgatagatgacaatggcgctgtacttgaagacagcccatgatggtgtgcagagctgggaagatggcagagagaagtcccgagagtaggtaggaagtgggtgcagcaaggctggagtgtggtttcctggctgagaggggaacacatgattccaagtcttgggggagtcatgagctgtggggaagatgaaggaaaatgaacattccagccatgaaggccggtgcagagaatgcagaaacagatgacccactatagcccgcacagccatcttagctccatcaactatgctaaaagcataaagaacaacttggattttgtatgttcatttttttttgtaagaaacatgatataattgtataccagtttttttcacagaatccacagtccctctttctcaaatgtttgcagtgattagaattcatagacaattcaccatctatttttgcttttcttccaaagcttttttgattgactgcctaggcttttggtgaaaggatttctataggaaacattttgcagggaggtaaagaatgcaagacaaagtggggagttcgatcggtcttttacagatttgagaagtcaaccctttttaaacacgctggccccagtcacagcttcattattaacagaagactagagaaggaaaacagaaggtacttgggctatgaggtcagcactgctggattccaaccataccctgggcattattggctgtacactttcagcaagagtcttacctttttgtgttgtagggtgagatggcgttcataatacccaggatggttatatgtgcttaaggataattcactggtgagatacatggcaaatatcttttccacccctgtttataacattccagttatctattgctgagttacatgacatcctaacatttagtggcatataacaacaacgtattactatctcttacagttttgtggattgattgaattcatttaggtatttttacttgttctttcctgccatgtagtcagatggctggagttacatgaatatttttatgtattaggtgtccaagatggcatctttagtcacctgtctggcacctcagcttggaaggctgaaagagctggaaatggattggcacctctctctccagccatacagcttctcctcctggctgtctggagctttctcacagcacagtaatatcgagtatttgaacttttgacatggcagccaacttctcctagagcaagcgttcaaaaagcacaagataagctacagggtttctgtattagtctgcttatactgctataacaaaatatcacagattgggtggtttaaaccacagatcttaatttctcaaagtcctggagaccagtaggttctgttctgggtgaggatcttcttcatggcttgcagacaacagtcctctcactgtgtcttcacatggcagaaacaaagagagagctctgctttcttttccttttcttagaagaacaatccttcatgacatcatctaaacctaattacctcccataggccccacctctgaatactatcacattatgggttagtgctttaacatgtgaattttggggaacaaaaccattcagcccataacattctactgctgatcctgcaaaattcttgtccttcttgcatgcaaaatacattcattctataccagcagcctccaaaatcttaacttgtttcagcataaattctgaggtctaaagtccaaattctcatctaaataagtatgggtgaaacgcaggatactattcattctgagacacaatcagtatggatgagatttaaagtactgttcatcctggggcaacatttgtctgcagctgtgaacctatgaaataagataaattatgtgcttccaaaatacagtggtgggacaggtgtaggataggcattccctttctgaaagggagaaattggaaaaaagaaagtagtgatgtgttccaagcaagtttacataaaaaggcaaataccgctgaatcttaaggctcaagagtaattttctttggttcaatgctttgccttttggaccgaccagggtggaggtccctctcccatggttctcagagtgtcacttctgctgtttcattgttatgcagagccagctcatagtcccatagaaggagactgcacaagggcatgcctatcagagtgtctgggttattgtggggtaattttagagactggccacagcatgtaacatggttgacaagcagggtccttcctcattcgttatgcattgtgtgaactgctgcatgtagcatttcctccatgactccctgtatctccaggaataactccagtgttactctgtcctgacatttggataaatagcacacaagaggacagctttattgttcatcttgctacagtcaccaaaaccaggctctatgaacaaattttagtagatctaaggtccatccacatcccttcactaaaaagggcttttgtttgcttgtttgttgttttggagaaggctttgtgtatggtgttcgatggaagcaatatcaaacaaggaaagagatttggaaagaaatgaagtcaagtcaaagaaataagctgtttaagcccctaatgcaggctgagttgatcctagaaggtagaagcctagagatgaaggacattcaagaactcctttatgctgttgtgttatggaagctatgccagctggcacctttcttggttcagtgcctcagtttttaaagatgacagctgtttagacactccatattcctttctttattcactcaacaaatatgcattgaacagatgctctgggctaggaaatgtgttagacattttgggagatatgaagatgaatcagaccagaatccaagcagaacacagcccccattttagacacagaaagtctaaaacgtggtgttgtgggtaggggaaatgcaatcttgaagagctgcaacactgtcagcccaatgctctggtctgctggagtggggatagtatctcctattaccaccactgctattgctactcttcatccttgagcctgttgttcaagaggatctgtcaacaccagaacggtgcttctcactttaggaaggaagacattgctttggctttggaacataggttctatcagaaatgggctctaagttttcataccttcccccaatagcttgttcttcatgcaagagcaaatgtatgtgaatgacacagcatgttataagaagttgtgtgtaggattgcttttatcattgtcatcaaagtacgaaacgcatgtatggttaatcacactatccggtggtacttataaatccatgacaagtttttcccacttttcacgtaattttagtaatttgtttctctctctctttgcacacctggattgtcatcttctaagagaaaagtctgtcatatgcaactgtgtttaatactgtatcacttggtcaattcatggcaccactaggttactaatgatcctttcactttttgcagaaatcactgtgttttcagctcagcggccctgtgacattccttcgtgttgtcatttgttgagtgaccaatcagatgggtggagtgtgttacagaaattggcagcaagtatccaatgggtgaagaaggtaagttggactaatattactgaacaattcacatattactatgtatgtcaagatggaaagtatgccactgggtctgtgtctcaaatgtggcttgatttggaccttcactaaagccaaaagtagaatctgagagggagagaaaggcctacgtttttcggtagtgaggaatgtgattattcagtgttgatgttattggattctctttattgaacacctattatgtgctagtaatagtaagatctggaggagaaagaaggaactaaagggattataattgtttagcaaggacccggctgaacaggccaactgagatgattgccatgttgcttttttccccttttcttttgaaataagtcttaaaatgggaacaaggtagcttatgtcccacaaggaaatgagattgctaggaggctgaaccttttagacttcaaatgacatggccctcgatcacgagccaggaggcctgatttctacacccagacctagctctgccattcactgtctgtgctatgggattaataagccatttactggactgccagggtggctggacctaggatttctaacagttcttacattttaggattctacgaatccatttaccttctccatctgctcggtggtaactggagcaatattcacaggagacaactaaatatccagatagaaatttaagaattaattctaccagtgtgactttccactcttggggaatctagaccttcttatccaagtgcctacggctcgtctccatgtagatgtccagtggtgacttaaatatgtacgtcaaatccaggtttttcctgggtcccacattcctgtaatagtatcaaaattcacccagaatagaaacatggacggaatactttaagcctctcaacccctcacctccaatagcagttaattcctcttgattcctattcattctatcatttggctatctctgaaatagttttgtttctctctatccctattgccaccgttcaaatgcaagtcaaatgttttttctctaatattactgaaattgtcacctattacgtatttttgcttccagggttatttctcccttatcagctccaacgtgatccattatctatgtatatcctgaacaatgttcttaaatccgtacatattgtactttcccacttatttcctttcaatgatagagataagcttttcttaacaagcttctaggatcctttaatgggaagggccactgttttgctgtccagattcatctctcagctggtattccctctccaccctgcctgtattatatacatccactctaggacctcctcataaggcacagccattatttcccccaaagcctcataatctctctcacctcataagcactcttaaggcattttatatcttagcttggacttcactatctctaaggagctatttctaatagcctaagattacctagacaatgctttagcagccagggattacaccatttactgtgatttctacattggactgtaattgcctttttagttgtctgtcttcccagctagacctagagatttttgaggacaggacttatttgggaccactgtgctcccagttgcaagtactgtatctgggccaaagtatgcacttagtaagtacttactaagcaaatgaatagggaccctcagtatatttttaattaaatgtgaggaaggtggactaaggtgactaacagagaaaagtcataataacagcagctaacaggttttgcatgcttactatatgtcaggttcctaaggatgttaagtgtatcactccccttactccttccaaaagccttatgtggtaggtattattaatatccaacattttataaatgagaaaactcaatcttggagaatgtattagtctgttttcacactgccataaagaacttcctgagactggtagtttataaatgaaagtggtttaattgactcacagttctgcatggctggggaagcctcaggaaacttagaatcatggtggaaggagaggtaagcatcttcttcacaaggtggcagaagagagaagagaagcatatgttaagggaggagagccccttataaaactatcagatcttgtgagaactcactcagtatcacaagaacagcatggaggaaactgccctcgtgatccaatcacctccctcccttcacacttggggattacaggttcctccttccacacatggaaattacaaattgagatgagatttgggtggacgcacagatccaaagcatatcagggaagataagtaacttgtctatggccatagtgctataacttttatccttggaatttgtatttatgggaagtctaactttagctagagtttgtgtcttaccactgtccttgtctgcctttctcctgaatgaatctcccatattatgggcaaaaaacattacctccacataaggccaggggcttttcctgcagcccacacaagctattgttaaatagatggtagtcccctgtgactgggaactatacatttctgataatttctcaggtgttttacactcttgtgttaatgtgggtctgttttgggaggacatttcaacgtgaggagtccccacctctttctctcattgtctggtcaatgtttgttaagggaataaaccaatgattgaaaacgcttatcctagaagcaaaatcgcactcccctacaaacgcaccagaatgatttggaaattgtaggactgactcctcttgcatttgcttattttgcactcatttgctccgaagcctggctcagcagaggaagtgcatccctcctgtggatatgtctgtgaatgatgatcatctcatttctgctgagccaaatggggctcttcatttcatcggccctttgaattcctcaataagatgtgcgagtgacatttcctatttttctagataataggggcaattagaatgaggtgtcaatgaatcagagtcaaaagttaaatagaaagtacttgaatttaatttcatgtctaggaaatctggtagtttttttttttttaacctggaaattaagaacagtctattttgaagagttctgcaaagcttttattccaaggagaggaaggtaaattactccaaggctggtggcatgaaacctttaaaaaacaaaacaaaacataaaacagcaggaatgcagatggaacaatcctttgatttttcaggttaagcttcttcttgatggaaaagaattctgtgcctggtggaggaaaggacttgttcttgatcgcactgtaaggattttgaagaacaaaactaaccaatgactttagctgagactcagattcttgattcccaaacaggtcaagatgccagactttcttgaacaggcacctatgacatgccacaaaggcaggcagagatgaaagggcacttcctctttcctcaaggagtttatggtcaggtaactgcatatagcagtcaaaatccaagtgggaaggaaagacggagagaggctttaaacaaatgtggcatgggctcacaggatcggcactctagttaacttacagtgaaatccactggagcttgagcttccgtttctagcacacatgtcttacttaggaacagaggaggaattttctgggcagctacaggataaggcttctaagccctgtgaccttgctgggttttcagtagagcacaggggcctagaaatgaacatcttggagaagtggaagagatttgccctttgctcaagagaagtgtacacacattggcatcctgctgagtaataaccagcaggaattgctggtcgcaggtcacccagttatctttcatttgcataggagtgaatcccagaaagctgcttctggggcagctcacctgtgctgcagaacccaccgggctctgcattgtccctgacagcttgaagtgttagcaacctgcttcctaactctctgtgctgctgggtctgtctgtgaatgtgtatttcctattttgggatgtaggccactgtggagaaggaggccaagtgtctgtctgtatctggtgtcatcagaatcataaacagacactcggttcacttgttgcctacacattgtagctcttcaatgtgtacaatgtgactgtcatcaccacaatcaactaatgattacatgaagcccttatgtggtaggtcacctgaacatccagtccctgtgcaaaatcataactaaaggaaaaacctgaaccaaagttgtgttctttgatcttgctttatttagctagtgatgggcaaagaggtcaatgacattgatattttctgagcatgcccttgtaccaggtactgtgatatgtgctttacatttattatcttgtttgacgtcaccaagactttggctgctatgcgcaggggtcatgattctttcatagatgaggatactgaggtttagagaagttaaagaacttgctgaggaccaccgatgagcgatgggtagagacagggtctccattcctaagcacagcactgtagtgcttcctattgataatgtctcttccaattcttttgtaccttgacttccagtcttaaccaagctgggatgggagggagttggagggcaattattattacagttattttggtatggcaatgtcctaaatctctacttgagtttttttattttttaataatagattcagggggtacatgtacatgcttattgtatgtgtattttgcataatggtgaggtttgggcttctagtacacccatcaccaaaataatgaacattatacccaataagtagtttttcaaccctcctcctccctttttggagtccccagtgtctattattgccatctttatatctatgtgtacccattgtttagttcccactcataactgaggatatgcagtatttgattttgtgtttgtgagttttttcacttaggataatagcctccagcttcatctatgttgttgcaaaagatatgatttcattctttttttatgactgtgtaatattctctgtggctgtgtagtatttcgtgatataccatacagccataaaaaagaacgttgtgtgtgtgtatatatatattctacatacatatgtgtgtatagagataatgtatgtgtgtatagatacacatatatacacacataaatatatatgtctatatctacatatacacacacatatatacatatgtatatatatgtagatatagacacgtatatatacacacactacattcttttttatgtgtatatatgtatatgtgcacatatatacacatatataccacattttacacacacatatatatgtatatacacacacacacacgccacattttctttatcctgtcattttttgatgggcactgaggttgattccatgactttgctattgtgaatagtgttgtaatagacacatgggtgcaggttccgttttgatataatgatttcttttcccttagataggtacccagtagtgggattgctgggctgaaaggtagccctattttcagttctttgagaaatctccacactgttttcacgaaggttgtgttaatttgaattcatactaacagtgtatacacattcctctttcttcacattctgctctccacttgagttttaaaggagacatagtgggttctggctaatgcagcgaggtgactgaatgtatccagtgagtgaggggcaaaaatggcaagaggagaaaagactctggatgtgtttactcatcagtcatcttgagaaccatccctatgttaggctttggactaggtgctggggatacaataataaatcatgtgtatcaatacaacaatggaaccgtactgttgcttccaaagaacccctcttcttgtgatggagccaggctggcaaacaaataaccatggtacagagttccttttagacagctccatggatctgtgagaacatagaggggctgacttctgctggaggaaatcaggcggagcttcagtgaggaggtgacctctgggtttagacttgatcatgagtagggatttatcaggagaaaccgggaaggattttccaggcaaagggaacagtacagaagttgttaagtcagtatttgtcattactaggtgggatgtcccatgaaatatttgtttttatttttatgtatccttagatagatacatttaaacagttaagatggttaaaatagataaagacggttaaaatttaaaaggtgagacctggcatggtggctcatgcctgtaatcccagcccttagggaggccaaggtgggcagatcacaaggtcaagagatcgagaccatcctggccaacatggtgaaatcccgtctctactaaaaatacaaaaatcagctgagcatggtggtgcgtgcctgtagtcccagctgctcgggaggctgaggcaggagaatcacttgaacccagcaggcggaggttgcagtgagctgagactgcaccaactgcactccaacctggtgacagagcaagactccatctaaaaaaaaaaaccaaaaacaaacaaaaaaaattaaaaggtgaaaaagagtctacagagaattaagtcttcttcaattcctatactctaggcgttcaatctcattccctggaagccactattgtcagttttctgtgtgacttccagacagtttctgggcagttgcaaacacacacatccatatagctacttcctccacatttgtatacatagatcacatccagctgtaaaccctgttttacaccttgatttattttttgaggcagagtctcactttgtcacccaggttggagggcagtggtgcagtcttggctcactgcaacttctgtctccgaggttcaagcgattttcatgcctcagcctcagtcccagagtaactgggactacaggcatatgccaccacggctggctaattttctgtatttttagtaaagatggggttttgctacatcggccaggctggtctcgagctcctggcctcaagtgatctgcccgcctcggcctcccaaagtgctggaattacaagcctgagtcaccgcgcccagccaccttaattttaaaaggaaaaatgtattaagtttttccctttgttttgcttgtattcatttgatttaaaacttttttaagttttaaaactatccaaacctacagaaaagttgcccaaataacacaataaattcttatgaacacttcatcaggagacactgaattttaaaaaatcattttgccatgttctatgcaacaattttatgaatttaatccctaatcaaggtacagcttggatgtcagttacctggagaccagagtgcagttcctctccccagcattgatttactgagataacataagatgttctcgaaatcaataatgtgttcctctcattgtcagtttccctgagatgcccataagcagcaaatccacccccaggatggggatccatccctaggatggagatggctggaggtgcccctctttgggccacttgatctttgggaaaggattttctctgcctcctcaagtgctcagcaagcgcttcttgggcaggtgagcatgctctccacacttgccttccgggccctgtggtccagggtggtaacaggcaatccaactgaaatctaatcacttcatttccgacaaccagccatatagacagcattatctcttctgttcagcttgtcagagtcaacacggcatctcaaaggctggtataggattctctcctttgaaagatcaaagcgcctgagcattgctcaggttacctgtgcatttcctccctgcgttacatggaaagggatagtttgtactcaaagtgagagggacttcgaacagcatgacaagcaggaagtaacttagtaaggcagtgtcttatgattttgtagtcatgtgctctgggcctaagaggattgttttctggtattcattcattcactaactcatcaaataattcctgaaagcctccttggtactattttatgctctgggccaagacatgtgcatgctccttgcagactgggtccctaggatctactgggtgacagacaaataagacagtctcagccaaagaaagtagctgaacctgagaggggtggagtggaatctccaaggaattacttcttggccattcattaattcattcatgcattaaacacgtatttactgactccgcctgtactctctgtccctacgtgattcttgagccacagaattaacatttcctttcctggctactaacccaaattatcctttgtgcagtgggggactcagagctcaaggcaattagataaatcagggaagtaaagggaacgagctatactaaaatctgccaccaattaattgtgtctgctgaggatctagaagactgtagccagacacctgacagatgccaccatttggaagctttagaaaatttgtggcagggctagtgagtttatcttttctaggggctcttttacagtttaagcaccattccaaaagctgttaggctgccatagcaacagttcatatatatatatatatatatatatatatatatatatatatatacttttgagggaaacaaatttttaaaaacttggtcacattcttgcaagggcttgtgagaagatacctctttaaatgaatgtctagcaagtttcctgaagtatcatatttctgtctataacatactattttggacctcttaacactcccaaacacttttcagaatttctgcttgaaagatggacctagggggatggtgattcattgccccaaaccatttacatcattctttgggaaaggaaagcaaaagcctttgtgtggttttatcttgctagtggtttcagccggagcacacgtccctgccgtgccagcccccacacagtgtgggatggaaccggtgcccacacaagcccccaccagggaggctggagctcaggctcatgaaagcatgtccagctctattctctcttccccagtccttctccactgagccgcagcattatttctctaaatccaaattgtatcaagttgcttcagtataaaacccaagcttcagaagcttgcagtccctctcaggataaattgctaagtcctttgcctggattctaagactgatttgatccaggcccaactcccagaagcctcccttcccctccctcccatttaactctgtccatattgtgctgctggtagcccctgaatgcattgtgatgcttgacacctcaattcccttgcacacatttttcttctcttcccccatttgtccgagtgagcagagaagcatcttctcctccagcaggggctcctagaccctgtgagatagtttgtccctttttccttctgtatagagagtgccttgattcctcagtgtctatcacttccacgggtcctgggtacatgtatcttcatgagcccccttttccattaaaaaaaaattacagtttatgaccattttggtttaaagaggaatatagtgttctaccctaaaaggtcatttttttcttctgattttaaaagaaaataaaacatttctgtgcatcctctaaatgtgttgtgggcactgtgcctactgttcctaatggagaagtcacactgatgttgctgggttaccacatcgccaattagttgtcttcaagtttgttaaatccttgagaatagagtttggctgtgtaataccatgccatctattggagtgtgtggaatgcatactcatgtgtggtgaacaggctttcgcaggaataagagcatggtctccattcacctgccttctgctgctgagagctttggcaggcactccctcttaggctaatgctgctcatccattttcaaaagggacaagatcctctcctccctttttctgcacagcactttaaactgcagagaccttccttgtgcattatccactttgatctcttgagatcaacattagctgccccattccatagaagaataaaacgaggcccaaagaggtgaagcagagcctagaaaacagagttgtcccctgcccagagtcacacgtaatatgtggcagagccaggattctactcctcccctccccccaagaccaatgccaatgttctatcaaaccacaggacaagaaacctaaattaaggcagagatcgcttcattccttttaacttttttggaagcatcaagaacagtaagaaacaggaaatcccaacatgggtagaattgcttctgcactgaacactgcaatgcaccacccagttccccagttcactgaagatctggtggtctcagctactgggaatgctcttggcaggtgacttcacttgcagctttcacctcagccaaagtcatgctcttttccagggcagctcacattggagggctgatcagtaaaagtctggccatctcagctttcttgggattattttgaaggatgatctttagcccagatgaccatgcagggtggtctgaggctgttgctgggctgcatcacacatcttctctttatgtttgtttctgattccccttccttttcttctccaggtgttattccaaagggtaccccctagtaaacatccccatgctaaactccatctcagagtcagcgtcccagataatccaacctgtgacaaactctattaaatattttgcaacaagccttcctatgtctgtgcatgaatacacaagattcatttgttcctccattgttttcactgaatgcttattcatgggatgctaaacactgtactaggtaccaagatactgtggtgaacaagacagaaaaggacctctggttacaaggaacttaaattacttctactctgaaggcagatattaatcctgtttctgcactaaaattatgcaactttcagagcattctggtcacctcagcatttacatggagtagcaagagaagcctcccatcaccagagccctgctgattgctttgcagagtaaacactgcttccaggaaatcagtagcagtgtctgaaaggttttcccaccctgttagagaaggacccagagtgaagttggggctacaaggaacttaggataggcaggagaacaggggctggaatgtctgtccacaatagatttggagagggaggattcaggtgcagatgaaaaagccagtggaaatcactgtcaggatcagaagttgaatgaaaaataccagatggagggaagacaggtcaagatttaatttgtagcaggatggaataaggtccaagggaggagtgaagtgggggttttcttgcaattctctacggtccttattttaaactatttattgacgtcctgttttaactggaataaaatccagatgcaaattttgctgccaatgctctccttgagacagtcattccctacctctctctttgcgcatctgctcagctgcatttgacaattgctgccccttgagcagacccagccctttctaaccccagggactttgcattttctattctctcagtcttggaagtctcctcacacacctttcaggattcagctgaaatgctcccttttgagaggcctttcctgacttcacaacctctgaagccatatcctccacccaccctgtagtcattggacacttcctcattgtgtctaattcttcacagcagcaatcacaattagcaaataccatgtctatttcatttcatggctgatttttatattgtctgttttccccatgggattctaagccctgtgaagtttagagacttgttcagccatgcccacccctacgtcctggatgtcaagggcagcgccatccatactagtagcactctaaatatttcttgaattaatgactaaaccaatgtgactacaccaatagccaattattaagcatttgcctaatgagttgacaggaatatgatggttggtatgtttggggcagaagcctggagcctgggctcctccacactgctgggatgagcagaatcttcagacatctctctctctctctctgagttcctcctggaccattactcagatttgaggggcatcattgcctggagcactccactctggggaagccaacagctgcataatggtttccctgcccgtgcattagcatgggccttttgggcctgctccggcttgcctgacccatctcccagcaggaaagtctgtgcatctgtaatactctggaaaattggggctgacatgtagttcagtacccaaagtggtttcactcaagcaaacgcggagaataaaagccatgcgcttaaaatgcttgagtaggtatcaatcagaagaacattccaataatccatgtttatgaagcctgttagtatgaatttttgaaatagcacttaatccactttattcttgacaaatggtgtttgtagccattgagatattttatttcaattatgtgcggatgttgtagggaaaaggtttctgacagtatcaaggcataagacattttttattgtgcttttatcactattcccattgctacactcgactggacagttcattaagatgaaaaattaacagcacatactatggagagaataatcatggaacatgattattcttcacagcttgtggaagcaccagaattcagagtagcagacagatgacaaatgtgctggtctttggaagaggtggcgattggtcaatcagttggtacccatgtgtgcacctacttgtgtgttcagctctgagctgaggtgctggaggagaaagaaaatacggaaaacatggttgttgctttccaagaacatactgtctatttgggaaggccaggaagatgtcaggtgtcaatccaggaactccaaagtgttacacaattgcccagcactttggcgctggctgtaagttcaggagaaagttcactgtggactttagagaagagttcttagaccttgaagaataccaggatgttggttagtaaaatatgttctaaaaatagtagctactgatggctatgaggttgcttctggggagtaatgaaagtgttctgaaattagatattggtgatatgtgcacaactttacaacataccagcaaacactgtaccctttaaaaggcttattacattttctatgcatgcaacaaaacatcatatgtggccaataaatatataacatattacatgtcaataaaaagcatggtctttatgatacatgaattatatattagtaagccattattttcaagcactctacaaactcaatgctgctaaattacagtaatttttttattatactttacgttttagggtacatgtgcacaacgtgcaggtttgttacatatgtatacatgtgccatgttggtgtgctgcacccattaactcatcatttaacattaggtatatctcctaatgccatccctccctcctccccccaccccacaacatgccccagggtgtgatgttccccttcctgtgtccatgtgttctcattgttcaattcccacctatgactgagaacacgcggtgtttggtttttttgtccttgcgatagtttgctgagaatgatggtttccagtttcatccacgtcgctacaaaggaaatgaactcatcattttttatggctgcatagtattccatggtgtatatgtgtcacattttcttaatcccgtctatcattgttggacatttgggttggttccaagtctttgctattgtgaatagtgccacaataaacatacatgtgcatgtgtctttatagaagcatgttttataatcctttgggtatatacccagtaatgggatggctgggttaaatggtatttctagttctagatccctgagaaattgccccactgacttcaacaatggttgaactagtttacagtcccaccaacagtgtaaaagtgttcctatttctccacatcctctccagcacctgtttcctgactttttaatgatcgccattctaactggtatgagatggtatctcattgtggttttgatttgcatttctctgatggccagtgatgatgagaactttttcacgtcttttggctgcataaatgtcttcttttgagaagtgtctgttcatatccttcgcccactttttgatggggttgtttgttttttcttgtaaatctgtctgagttcattgtagattctggatattagccctttgtcagatgagtagactgcaaaaattttcgcccattctgtaggttgcctgttcactctgatggtagtttcttttgctgtgcagaagctctttagtttaattagatcccatttgtcaattttggcttttgttgccattgcttttggtgttttagacatgaagtctttacccatgcctatgtcctgaatggtattgcctaggttttcttctagggtttttatggttttaggtctaatatttaagtctttaattcatttgaattaatttctgtagaaggtgtaaggaagggatccactttcagctttctacatatggctagccagttttcccagcaccatttattaaatagggaatccttcccccatttcttgtttttgtcaggtttgtcaaagatcagatagttgtagatatgcagcattatttctgagggctctgttctgttccattggtctatatctctgttttgataccagtaccatgctgttttggttactgtagccttgtagtatagtttgaagtcaggtagcgtgatacctcaagctttgttcttttggcttaggattgaagtaattttattacaggtgagaaaattaattcattagaatagacacatcgatgaggcagactaacattaattgaggacttgcttcatatggcaaggaaggaggcaagtgcgcattctacagaggcgaaaaccaagagttaaatcagttcatgctttgcctaagaagccacagaggtgggaaataatggggctggacttcatctctttcacatccagatgcttcccaccccattcttctggtgcccaaaaaagacagatcctaagatgttgtaagaatatgagtggcaacaatgataaagtgatgtgtctctgcagagagttttaaagttaaatgtcctcacttcttttctctcacctgttcttagagcatccctgtgaaataggatcagaggcaggtgtgcggtaggaaacaagggaatggagcgaaaggagaccaagtctgcttttacagactgcataaagaatgctgtatttgtttcccaagtgtccaaggtgttttgtttcccaagtgtccaaggtgttttctctgtgccttcatctctattttgggctccttctctacctagactttgatatgcatcctatttccccaaggcaagaggaatttccgagtgaaacgatagagatgtgggatccacggatatttagaagcaaggcttagaattagatgtcctgtctgttaaatatagaagtaagtgctgtttcttttctcctttgtggaaggagtagatacacatttctattgtaagttgcatgtttagattaaagacacttaaatcattatctcccctgcggagataatgagagagcttttgatgtcattctcagcttactggtgtaaataatgggtcaaattctcatcctgttgtacaggatggaaatccgactcaggatttgtaaatactgctgcatttgatttattttcacgagacattttcttccctagcagacagtgggatagcagcgtcccgcgaaacagcccgtggaggagtcatgatgcattaacctaagcagtgagatcaaaacaaaagctctgcttgtaatccccctgccagagccccaatctcagcagtccccactgtgtgactgcattcgggaagcctagataaaattagatcttcccggagtaaaaaggaactgggacttaggaaatggaagtctttctcaagcagcagatgtcttctttcctcatttctttggagttttgttagcgttaaagaaattaaaagaacaattctttttttattaaaaaagaaaaaaaaagaatgaacacttcttgaaatacatccctgccagttttggagtgcatttgctttctcccctcatcagaggggttggattcagcctgactcaggagtggggatgcctggcttctcatcttttatctacctcctactgggcaagtgactgctctgtgtttctctttgcttctttgtcacaagtggttggtgacttccagatccctccctagccccaggctcctcttgggtttcttctctcaggtcttggcactctcgtcttctcggggaagtggaacagcctgagtccctgttgctgggatgcggacggtcccaagggccaagtaaacagttcagaagcaggtgtctttgatgggggttactctagcagggttgttaggggagagaggagggtggttattacaatcatccaataatcagtgtctacaccagaaggatttttgtgttgatagaggaatgttttaattctaatgcacttaaaccaatgactgtcacaaaggaaggctccctaaacaggagtcggggtgatggggatggcaaggtgcaagtctacacagttccaaatatccaggtgtttccaaacttggggctgtgtagacagaggttcacagtgactgatggagtccaggtcacagctagaattttacaacatgtgctggagtgccatcttcctaacactctgtcctctgcaatgaggaaatcggggtggtggggaattttgtctccagttctcagtgcaaaaacagaggctgaaagtctgaatgattttcttgatgccacacagctggtaagtggcatcagaagatggaaattgaactgaaacttcaaatccaaggttagcttcttagatctctcagggagctcttcctctgcctgagctatcgggttttcccttcatgtgatgttgcccagagcaggctgcagtgatgtggtgtggtctgcccccttgaatgtctcctctctctcactgaatgacagaaaccttaggctagagtatatgtttagtttcagtgttccctttctcatcgaaagttcttgcatgaaacatctccatctgccctgccatcttctttctgccttttgtcttctcatctcaaaatttcttattttctgagttatttcaggcagagagtcaagtggcagatgtttgcaaacagtatgggacccaagtatccaaatgatttcttgccttcaaagtgtatcttccattgggagctggactctaattacctatgataccaccttggctaataatatctctggaactcttttgaggggggtctgcattttggatcattttagaaatggcaataggtctgtcttagtagaacatatgacgtttccaaaacgacatcctgcaggcaggatggctgcagaatggaagaagaacaggcccctttacatgggttgtggtaagcagtgatttatgaccctaatagggtagttgggtctgcatttcttttgtgacttcaaagctgtctccatcaggacattttaatgcctgagttctggcattttcacaaagtcaatctctttatttgcaaactacagtctctgtggaagaggaacatggcaggcaccttcctattaatataagcaggtagagtaccagatccattgcctctagagtcccaagcagaataaagccaagcctttgaataaagccatagggagagtcaagaggctctggggtaaagcaggaaataaaaatgaagatagttgaagaggctacactaatcatgcagtccaccttaaagtcaaattgttaaaatgaaacctctaagatcatcacagtagtcatatgaccttgagtgagctatttagcctcttagagcttcaatttcttcacctataagatggcaataacataattaaaaacacacagggctgtgtgcaaattaataaaagaaagtatgtagagtgcttagcatagtgttcagcatgaaataagcccctgctaattataagccactatcctcatcagctgctgttagtgagctgtgaccacctggacaagaagccctgagcagacagaaagccaaattggggctgactttggacctgtccactctcacgtggaaactatatttttcctgagggaacagattttctttcttgaggcagggttttccagcctcagtccaactctcagatagcagccttcatcttcactcggatctctgaatactaaagactaggtatgacttaatgctttcattcttcatcaataaaacaaggataataataacccttacctttgttggctgatgtgtaaaatgagctaatgttcatgaaagccctttgtaaattataaagtgctataaagtatgaattattattgtgattgctctactccaggtattccataaacattgtgggaaattaagaacgcacactcctggcattcaaaaagcatttatgcctttttaagtatatagctataaactatcagcagatgggtttgataatgcagtcttcaatcagatttaaatgttagcaagcgcccattaagagtgactttctagcaggggcactgctgtgggtgccagcaggcagccagtcacaatggttggctgtgacaggctatacttccactgcgcttgaataccagctgctcatgtgctttgcaacttactttgagctgaattaccaaaggtcttctgaacctcacttcgctcatttgtaagataaaggtaataatacctacctgactgagttgctgtgaagagtagataagataatgatcaccaagccctgggcacactccctgatgcaagggattaggaagccacctcagtgtggcaccctggatgctccgattgacaggtgttccttcttttgccttgagcctctcactgaaacaagtcagggttcctcctctcgctgggttcccagcagccttgcaacgtcactgcccgtgcagctccccagccccgcctcccagcacctcatgagccctgctgaccttcaggcctctcgggtcagttccaacataactaggtctttgcagatttcaaagcctcctcttgataactcgagggtcgagggggacttgaggaaatgaggagatgggatggagcagaaggctatttgtgaaagccagtgtgaacagcctgaattcctggccatgtccctcagaggctgaggggcctatctggaccccaaggaccctatattaccagccaattccacgtaggcagtccagatacagccacgtgcaccctgttatggtgactaaccagaggaatgtaaaagtgtttccaatgccattaagctttagggtgcggggctctaattctgggactctaatgctaatagtattttttgagcatttactacatgctatacatagtgttcggcacttcaacaagaattatctgatttaatccttccaacaacctaaggagaagtgtactctactattacccacagttttgaaatgagaccacaagattaggaagggcagaggtcggctttgaacctagtactcatggctgcagcattacttctcagggtacatgtggcctgtggccaggataacaggggtggctggcatcctggcagtgggttgttcttccatctatcttagtccactctatccgtattagttttcaggggtttccattgaaacaaagttccacaaattgatggcttaagcagcaggcatttattgtcttacaattctggaggctacaatttcaaaatcaaggtgttggcagagttggttctttttgagtgttctgagggacaatctgtttcatgccttcctcctagcttctggtaactcaggcattccttggcctcctccttttgtctacatttcctctttttgtagatatcagccacgtagaattagggcccattcaaatgactgcatcttaacttggccatctgcacagaccctaattccaaataatgtcagatttactgaaactagcggttagggcttcaacatctttttgggagacacaatttaacccgtaatactgttccataatactgcccataaacacatttctaggatttacccatttccttgaaggcatccaagtgtaagtgtctttctcacacaagtattctttgaatactgcttaagtgcttcataccatgccgccacctggagataagaaaatgagcaaaacacctatgatccccatcttcatgcattaatgacatactcttggaggatttcaagtccatagaccctcacagtactggtgctaaactattttattttattttattttattttattttagagatggagtctcactctgttgcccaggctggagtgctgtggcatgatctgggctcactgcaacctccacctcccggtttcaagcggttctcctgcctcagcctcccgagtagctgggactacaggcacacaacaccatgcctggctaattcttgtatttttagtagagatggggtttttccatattggccaggatggcctgtctcctgacctcgtgatccacccgtctcagcctcccaaagtgctgggattacaggcttgagccaccgcacccgaccactggtgctaaatttttatcattaattttaaatggctcatctaagggggaaaatgaatgtagcttcatcattctgaataaatctaaagagagaataaccaggagatgagtattaatatttgattaactttatttgcatatgcacaactccatttgcaaactggcttgtgatttctcaaaatctgtatgtgtgtgtgtgtgtgtgtgtgtgtgtgtgtgtgttttcctagtttacttgtggggtgtcatcgcaggccttctagaccaagccctgcaagcaggatgatgttaaccagggtgtatcacttattagatggaagaacgattaccctgtgctctgtttaattaagcttcacgtaatgggcagacgtttcctttaacaggcttgctgtcacctcatcagttatttaaggtagttcatttcacagcagggggcaaaaagagagaaaggaaaaatttatcatttgctcaaacttgattggtctgaggaaaagcgtggctgtctagaagatgcctaattgctgctgtgatcctgtactgattctctattttgtcccaggcttcttattgaaacgttaatcaggattaggtctcacctcttgatgaatgattttgtaaaaacttgatatttctcatctcagttaggaatgtctgtatgcaagtataacgccactgcaactgaatgggaagataactaatgcccttaatttcacagagggctgtgatttggtacatacagtacaaatcaggggaaatcagaatgaaattaattttctttttttgcaaaggcactacctctgttatataatgagtcacttttctttgactgtttttgctgcagacttagagaacgcttggcacatgtgtttgggtttatttcttatagctggggtcaaatttaggttacatcattttgtttgatgccagaacttgggcttaagttctctgattctctctctctctctctctgtctctttttcctcatcctgtcacctaggctggagtgtagtggcgcaatgttggctcactgcaacctttgcctcctgggctcaagtgatcctctcacctcagtctcctgagtagctgaactacaggcatgccacccccatgcctggatttttttttttttttttttgggagagacagagtttctccatgttgcccaggctggtctcgaactcctgagttcaagcaatctgcctgtcttggcctcccaaagtgctgagattacaggcatgaaccacggtgccactctgattcttttgtttgccagtttaggaattatccctgcctcacaagactgtaaagattcagtatcattcctgtttctaactcaaggtctagcattacaggtttgcaatatgatattttcctttgcctttattccatcacctcccccattgattcactctcgatgatgggacagaattatttttccttctcccacaacaatcgcacatccttgtaaatctgagtcttagacactctgcttcttccatgtcctaagggcttgacatatccagatggaaactgaataattaaagtagacattcatttattttgaccaagggacagacaccaaaattatggacttttggctattttttcatggttaattgactcccagctgattttccatctttgtatgcttcagcacaggcatgaatctcagcattttcttcatttgcagtggccaaagaataaaacttattataattatggttatcatttctttattattcatgtgtgtatgtgatccacctcctgcctgtattttctgcatcacccctttcctctttcttgagcaagccctgtgttttcacagttccaaaatcctgtggttacctgaacataggatcttatttcatgtcttaaatatttgctcctgctgttccctctgcctggattgctgttcctcaccttgagcatttgacttatgtatatactacaagactaaactcatacctactggcttatccactaagtctttcttgaccaactgcctcataccttggtttatgtgactctgctgaattatctcagccccctaagtcccccatcaaagaacttttcacattttctttacgttcatctattttctgtgctacctcccaccaagccaacaccaccattagcctatcagtgacctgaggaccataacaacatttgtttgctattgcctctgcttaatacaccaccgggcttctgcccatgttctaggtatgtttggtgaatgcatttctattattttttggtacatgtgaacaattatctgtgagtgctgcattctgaaaagagcttgaaagttacccactaatccagcgtggtacatgctcctaatataaattattctgactccaggccttgggtattagttgttttctgagaactgtatcaactcagaggatgaaagagaacattattcctaattcctcaatcaattagcaccatagttaatcctttcatccttaggccttttacattgtaggtcacctgtcaatactgaagggcctattctaccttctcctgggggaatgaaagatccttccttgagttttactgatctcagttacattgatgttaaaaattctcaaactagccaggcatagtggctcacacctctaattccagcattttgggaggctgaagcaggcagatcatctgagctcaggagtttgagacaagcctgtgcaacatggtgaaactactaaaaatacaaaaattagccaggctcagtggcatgctcctgtagccccagctactcaggaggctgagccaggagaatcacttgagccttggaggcagaggttgcagtgagccgaaacggccccactccactccagccttgaagacagaaggagaccctgtctaaaataaataaataaattctcaaactgtccacagttccccaagtgtgatctcttctgcccaacaacgttgcttttgtgaggactacgcatgggcactctgagttcataggaagatagttaaaaagaaaatgagtataggatttgaactaaaaataacatggtacttgaagattgacttgcaaagtccagttcattattttgacagatgcatttcaagtagagttgccagacaaaatataggattttgagttagattagaatttcagataaacagcaaataattgttttaatataagtatgtccgccaaactgtagatatactgaaagctattgctgtttatttgaatctaaatttaattgggggtcctgtaattcagtttgccaaatctggctcccctagttcccacacaagttaatttcttgcacattgtgatataggatgcttgataccatagatacggtagagtttgtaacattatccaggctgcctgagtcccaaaccagtatccattcctaaggtcttatgattaggataaaagattttctacttcagcacaaagtgccttttgaaaatttgtgatgattatttctggaaatctgtcccatcttagcattgctagagttggtttatcatgagacataactcaagagaaattagctatactgagatcattttatcaaaggtactcgtgacataggcaatttgatatgtcccaagtctgcctccaatgtcaggtgagttcccattgaggccaggttctctctaaaaaatgctgtaggtttgtgttgtgtaggacattggaaaggtaataaaagaaaatctacttcaaataaccaaagccgcccaatagaataaggacaagcgatttactctaacgctattcattcatccagtataaacaacgttcaatgttctcccataaaaactttcagttctgcatgctcattaaggaactgattcaacattctttagcaagttataaatgaaagaattgccaccattcttctgtaatctgaatttctcctcctcatcatgcttttcttgttccagagttgcttcactggggggaaaacatcacatctttgtatcaagacctttattattcttggcagaaaaaaatttcattttatctctctcatctgtctgctcaaagttcagtctcagagccaagtttttaatttgtaattatttgaaagagacttttcttcttaaaatatgttcgacaaaacgactatgtagtagtttctttttttaatggccctgcgaacatttcttctggcttttggtttggatactgctggtgtttcactttgagttttctctaagtgacatctccatcctctcctcatgtcaaaaagccaatattctgcttactttatggtaatagtactttttaattaggatcctgtgtaatgcttaaatcttttcttctcagaaggaagattttttaaaaagtgtttttcttcttaaaaaaaagtttattttattgtggttagaatatttaacatgagatcaaattcttgatatagtttaagtgtacagtgcagtattgtttactataggtacaacgttgtacagcagatctctagaacatatccatcttgtttaactgaaagtatgcctgctggttcataaataaagaactccctattttcccctgcccctaggtcctggcaaccacccttctacccttttgcttttatgaatttgactactttagatacctcatgtaaagggaatcatgcagtacttgtctgtctgtgactggttcatttcactcagcataatgtcctccaggttcatccatgtagtgggatattctgtaggaagatgttaatggctacccaagcatggagggttgggcatctgtggaagggggttgtgcaagctcatgaaatattgaaaagaaaggaattatgtatcagtagcaggttcagtttattctgtgtagtgtaaagtaggatttagctgcgtcttgtaagcactcagccgtaggacaggctgggatatctcagctgcagagtaagggaagagagggaagatgaggcatagacgtgtgtgtgtgtatctcttatgtgtgggtgttggaggggagagggcaagtatagatagaacaactctaagggtgtagatctgttaatgtcccaaggtccttgatctgtgtcagtccaaaaaatatccatctggggatgatgcagaggtgccaccagggatacatagagacaggcagtaggcagcaacatttactctctcctctgccccgacaggacccaagcaggaggtaaaaatgccagaggcaggggcagacaccaggaagaaaaacctgctgtgccttaggtggaacttcaaagccccgagcaatcaaactgggcatctcagcagagcagcggtcagtcatggtgaggcccagacagtgggtttcccaggaaacaaggcataaacgtgtgatatggaaagcatcgccacagaagagggatgaggctcttctttccgtttcttcctttcaaaaatcttcacatattcttcatgatgtaggtcttttcttccttcttagtgaagtgcccttgcaatcctgaatatatcctgacctcttttaatttttaattatgttattcattttagtgagctgacttgctgtggagctgttattttctctatgtgtatatttgttaaaacaactatccttcaaatgcaagtcccttccctgtgggtgctgtgtgagctagattagattgctgaggtttaaaacctaaaggcatacaaaaatctctaggcatggaagagatggaggatgaaaacttagaccttggggttgctgagagtccaagccaatgtcatggttgtattcagaagcaggagcagcctctgaaccagatcaaactatatttctgtggtttcatgggcagccatcctggagatacaagggcaagcctttctgtcgtggacatcttatcaggaaggcactaagtccttgttgcccaagttcatggtttacagtaactctgctgtattgttacgtcttcatctgctccttagttcatcagggcagctgtggttcaaagggactttcctttacaaagtaatgctggaaagcacttactttctgcccaaccaatggtgtatgagttgtacatttagcctgctggtaaatctctttggaacaagatgcaactggtcaatggtatgtaagatccctgagcgcaaaggccaatcccatctccagctgcataggcttctcctacggagatgttatttgggcctggggagacatccagctgggctttgttacaatggtgctctaaaaatggagcaaagttttgtatcatttggtttgtttatgtgctttcataaaaaacaaggttagtgtcacttttttaacatttgctgtccagaacagaattgtccctcctttatggtgtgagtactaaagtggctggtgttgtgagcggtagccaagtaatggctgctctttctatcagggaatgactctgggcctggacttaattgtcttgggtgaaatactgatagaaacatggcacttgcctctacaaccacgtaactccttttccatgggcaccaaagcaatccctttgacaatgattagcttataagatcttacagagctatctcctgttgagctgggtccatttattagaagatatttatcgtctggctgccttcctacagttccctgcagggcttgcattttattattcattagcaccttctttggagacttaggcaaggaaggatgtagaacaaaattttgttctaatgtggaaaatgttatgggagagaggtttgaaaatcatgattcattcattcagggactatttggcagaggtgggcagactggagaacatctggggaaaaatgggagatgttcccctaaggaagtatgaaaggaacccctggtgtttgaggtggaaattggaagacccttagggagatgcctactctaaaaattccaggaaccttggaattccttgagggcaaaaaacatgttttactaaattcttatcacttaactattgaagaaatccttgtctccaaaaatatttcttgagtggtggctatgtggaagaagagctagctgaattctgagcatctccagaaagcaaaatttgaaagaattatagtaaagtagatcttggttcaatgtcaaatggtagaagggcaatagcttccaaatgggtcatatatagcttcaaattccattttgggcattagctaggcatatgaactaaatacagaccaaagggctccaaacccttattttcttatctgggcagtggaggcaatacccacctcatcaagatgctgcagaaaatttttttctgaaaatgtatgcaaagcatgtagcacagtgtctgtcagatagtagacactcaattaaaaaagctaattagtagatggtaactcagtaaaaggcatgcccacccatgtgctgggctgttgcaagcaggggtttaatggaacaaatgatttgacatgctgaactcctgggactcatctgaccagaagaacccatgccatccaccctggagctttgttcaccccatgattgctccattttcaccccatatcatggataattgagaggcccaggagtttctgtggacagacttctggcctgtatccccattcatttcctttcagggatcagctatccctcctctccccactacctgcaccatcccctagccaaggagctacagctgaggtcagcatactcacaggtcaacactacagaatcccatttgggttctgggataaacaaggatgcctatgtacctgaaatgaacctgctgcaggatctggcagattttatatccatattagagaaaaggagtgaaatcacatctcctttctgtaataataatgtaatttaaatttatctgcaacccacacttctaaaggttaaaagccagaactttaaaaatcacccagccaggtgtggtagctcatgcctatcatcccagcactttgggaggccaaggtgggtagatcacaagatcaggagttcaagaccagtctggccaatatggtgaaacatcgtctctattaaaaatacaaaaattagctgggtgtggtgatgggtgcctttagtcccagctactcaggaggctgaggcaggagaatcgtttgaacccgggaggcggagcagaggttgcagtgaagccaagatcgcgccactgcactccagcctgggcagcagagcgagactctgtctcataaagagggggaaaaaaacctacccaaataaatgtaagttgccactgctgttagcatttgatcatccttctgcccacctgtgtaacccaaattatgcttttacaaagggtttccccatttgttatctcattcgaccttcaaattaacttaggaatgagggaggtcaggcatcatttgttgtttttttcataaaaggaaacagagactcagagaggggaagtgagttgttagttgtcagtgacctcacagcctcctgagcagggccctcctccctgtaccatgagattatgagcactgaagcaggaattcactaacctgctgctggactgagacagggagtctgttggttatcaagatatcagacatggtttcattttttctttttttgtaatgcagcagagctgcttttcaaagaaaaattgtgtggaattcagctatctgttctatttactatggagtgtggagccagttggttcagctcttcctggcattgtgttccctgatcccttggttttctagtatattccaaagatcttgtctggagagccactcatgttacccagcttttcatttcacagacaggaaaactagattactggacattacacaatgagttagtggcaggtctttgaatgcccagcgctatattctttgcacaccgtcattcattgaacagatgttttatgcttcagatgagggtttttagtacctgagaccaacattgactaatagaactttttgtaatgattgaaatggccctggagaatttgaaatgggattagtactttgaagaactgctttttaaatttaatttaaattttaaaagccacatgtgcctagttgctaccctattggatagtgtagctctaaaccagtggttatttactttggatgtacaatggaatcacacagagaacttcaaaaatactgattcctgggtttaaattggtttagagtaaggcctgggtaatggaatttttaaggtttcccggttaattctaatgtgcagctgagtttgagagaaaattaatctaaatcttgagactccctgagggcagaaaccatgtcaactttatattctattgactcctgtgacaaggaattcagtgaggagttagctgttgtccagaatctcagggaacttaatatatcctgaggaagcagaagacataaccaggggtaaagtactgagaaagtgcccttatcaaatttcacaaaagtacagtgtcatccaaaggaaaggcaatattcacttctacctgagagaggaaagagcagcgtggtcttcttgctgtaatgattctgtcagaggcattccaaccagagtgactccaccttgaatgggattgggtaacctgagtctgaaacctgctgggctgcatccccaggagttcaggcatccttagtcccaggatgaaacaggagattgggtaggactcgtttcacaagatacagttcacaaagaccctgctgatgaagggatatggaataaagaagctggccaaaacccatcaaaaccaagacggcaatgaaagcgaactctggtcatcctcactgctcattatttgctaattgtaatgcattccaatgctaaaagacattcccaccagtgccatgacagtttacaaatggcatagcaatgtcccaaagctaccatatatggtctaaaaaggggtggaaccctcagttttaggaactccccacccctttcctagaaaacctttgtctagcataaaatgaagaaataacatacacatactcagtcaagtagcccatgccactgctctgcctatggagtagccactcttttatttctttactttcttaataaacttgctttcactttactctgtggacttgctcttaaacttcttcctacaagaagccaagaacccaggtggcttcccgggctgaacctcaattttgggattcaccctgtgacatcttttctggccaccaatgaagaggcaatgtagactcccatcgggacaccaaatcaagactcatgggcaccatttagacctgaatggtgggtgggtgagtctccctttgtccagattcaactcgctacttttatttccctttgatttgggcacatctgtcctttcctatgttctttattttggacagatgggtaagtggctttgaggcctttggcttggtagcctgatgcagtctcccattttctgggagtcctggacaggcagaagcacacctggctggccaagtcctttataacccctgttgttgccccttctctcaggccttttttgctttagtttccaatgactgaccattttacttttttctctcaatgcccaaatgcatgcttatccttatttctttgtcacatttgtagtctttgctttggctctttgggccattgtttaaggaaggtcatttggctgtatgaggtcctctgttgtgttgaccctgggacaccagagtcatgttgttctgtggccccaattgcgttaggtcttgtgcctttggggttcactgttggctgccccccgatgctctgggattttcagcgtttgctgtggggaccctcactggccagtacttgggtactctgtttttttcagcatttgatattgttggctgattcctagcaccacctgggatactcagaggagtttggaattggcattccctctaggattatgggttagaggtccacccaaggtgaaacttggccttaccttttcttgttatgtcctaaagttatcattttctgtaacaccattttctttacttattgtaactttaacactttgctacagaaggtgggaattttcaggggaagaaaactgggctttcgctagactcagaaaaacttctatttagtggagatccttgttaaacgtgaggacaatggtgaatactgaaggactcactgctatggtgtattttaagcaattggagcaaattcagattagcaaagtttagccacatggacaagtcccagttttgtcagagagataatttggatccacctatcttttataaaatagtgaattgtgttactatttcatggttagagttccaagtaaaagctattggactaagttttggttccctatcttaaaacaagttttttttttttaaattggttttctttcagtaagattgcaagaaatattggctatcaattctaaaatatgtttccttttaaggtttctcagatttatatctgtcccttttccttggaaaagatatatcctttgcaagctcaaaaatgtctgctctatactccttctgggaaaagcattatggtgcttgcctcatactgtagcttagtgagtaaaagtttgctcttacttgatggaggcctgcattcaatttttgtcttagagaatgagttttttcctgtttgactcttatgggacttttgccatttacttaaactttacccctccatggacagcttttgatttcctgccttgaattttctttctttttttttttttttttctgagttactttaggggtgattctagatcttgtaaaaactgcttgccatctatttggagacatctcatgggtccatggttaagccataaccttagttaaggcttattggttttacttgggaaaatacttttgcagaaaaacaaactaacaaaaaaaagtagcttaaaagccagaggtgttggctatttgtcctgcctagagtctggtattaagagatctaaaaggattttttttttttttaaagagctctattgttgagagttagcttaattaaacatggataactaatatatatatatatatatatgtgtgtgtgtgtgtatttaaatggcttttatgtttgtttttctcttcttgaatcttgtttctctgaaataagaaaagcttttttcttctcagatgactgaattgtttttctcccttttgtcttcttaacactcttgagactcatatgagaggatgtaaggtaatttctaacattctagaagtccttgggaaaaacagaggaagtgccagagaccccattctgggaaaaacctctattttccttatggaatcccaggaattgaaaacggatagatcctcccaaaatctaagcctctgttctgttttgcattcagttacctggtgttttttacttttgcaggtatcagaaattactttggattatgagagagctttggtgtgtaataactatgtagggaatatactttcagtgatggctaatggcagttatggggaagcactctgctctttgcacttttggatcagagaagcatgctcttggtcatctagaaggtataaaaatgtccccacctcccaatgaggggtaagacttcaatgggggatgggctgattccctttttggggatccaggatttggtaaaaaaaaaaaatggaattcttgattttttggtgttttgccttccaactgtgcctgcttattaagccctagaaattgcatgctttcctgtccatgttcctgaaagggttccatcttgaagccagtagtccaagtaagaaaaacctaaaaactgacaaatgaaaaattttacagctactagatcttcttctgtctatttgtatttgttgtgtgtgttatttatagaaaagagatctaactgacttaaagaaaaataagcagttaaatcaaatactttattggaaaaaatggaaattataatacctttcagttcatatgactttagtaattttgaggaaataaagacagttttaaagattattggggctcggcatcatggctcacacctgtaatcccaacactttgagagccaaggcaggtggatcacttgaggtcgggagttcaagaccagcctggccaacatggtgaaaccccatatctattaaaaatacaaaaaattagctgggtgtggttgtgtgctcttgtaattccagctacttgggaggctgaggcaggacaattgcttgagcccagaaggcggaggttgcagtgagctgagatcatgccactgcacttcagcctgggcaacagagtgagactatgtttaataaaaaaagtttctggtaaaataaaaatgtcttcaaaatttatacatttatacatttggtctaaattaggcaagtcagatactatgtttactaaactacattaactgcttcattgtcttttgataatttctcaacttacctgctttggagcaattagattctatgtaaggcctactgatggacataggttgttagccatgtccccggctttgctggaaagagtcataccttatttgtacttctatctgatgttctaggctctgcacctggtacataattaacataacttaccaggttttttaccaaaaataaaagttgctaatagttaacattgtaacatatataattgaaactactgaaggaagagttttacatgcaaggtgtgtaaagaaagtagaatgtgtttttggtaaaagattataataaggcatgggaaacttttttttttttggcctagtttagagggttaaagaattgttttaagtgagataggctaaagctgaaggcttgagcaagttgtggaaggttcataaaaaattaaccttgtaaataattctgtgtgtgagcaaattgactaaaattaaaaggatattattcaatatttctataaattaaatattgaaataaaagcacactgatacaaaatctgggcccatatgtcagaataatgaggctttttggaacactaatatgctccttaatagaaattaataagtgttataaaaggtttgtggaaatcttacctatggtcaaacgaattaaacttgaataaatgtgtttataatattatatttaaaattagctttagtgttaacgatgcactaatgcaaaagtgaaatttggctttctgtcttgaacaagattttcatgtaatattaaaagataataagagacttatgtttgtcttttgaataaacaatgggaaaagaaaggagagaaaggagacagattgtttggaaaattaagtctccactttatcaatgaataagttattgcatttttgaaattttgagttattgttttagataaataaatgatttatggcaacctggagttctgtcttaaattctcaaatgtttcacacctttgatatttgacaaacttgccaaaatcaaattgtaaattgttttcttatcctattaatctttttaaatactaagtctcctaaagtccaaaaatgacatatttgggttcttggtatattaaaatcatagaggaaacattgtcaaatataaaatggtgtttggctttctttgggttttatttgtataaatgtgttatctgtatgtgtttccaaattatgtgaaactcctataattttgacatgaattagtgaatgtgaacaataatacccataactgttatgttaaattgctgtgtaccacagaggtaactggatttccttgtcaattgcatctttgactgcggctgctgtaagactttttgtcctccacagacaatggtgtgttgctttcatcctcttcaaaagatggtttatagtcagatacaggattttgatgagtagttttaaatgcacgtctctgataatttgggaaagtgtaccattaaaatagagaggaaacatactgccaaagcactcttggaaaactgtgttcataaatattgagcaaaacaggaattaattgcatagactgaactaataaaaggctgaagtaatctctttatgactttttgcttaaaacattgctgatcctttctgttttttatttcagagtcaataaaatgtttttcttttgagttatttacagcttctagcaattgagaaaagtatactactgtgagcaaaatttggagcacgtttctttctctctcccctatttcttcagaatttggaaactatgtgagtattcttaccttatggcaatatagttatttccataagtgcagtgagagtctgttttttttaaaatttttttgtaaccagacaaaattgaagaaactctttatttttccaaggctttgactaaaatgatgtgctttcagattcaaacagactgctttaaggaatcaaagttgacttatagagccaataaaagccacttgggaaaattggcctcataccttctctatggagtccctgcacagggttcctaacctgtggaaagtaaagattgtcactttctgacaggaccagaagccccaagttatcttgggttcttgagtggagaaggagtcaccaaactcattcaagtacttgcaggcacagataaattcatgactgagcttaaggctttaaaaagtctaatctaagattccttactgaacaaagttccatcaaagccaattttaaaaatgggcctatatggcaaataattattctttctgcactttatatagaaaatcaggccaagtatagtaaggctaaaacttattttgcaagcaaatcagttctaccatgatttgtttttaataaaaatggggaccagagagaaaaattgtttcaaaaactatagtacatctgtaattagcttctggtctggtctattgttttggagattttttctgcaatttagattgactgcttatttttgtgaaccaactagtgatctctggctgctgatcagaagaaacaagaagaataggtaacatacagatctagttgagtattctaattctgggcacatattggaatcaactgactactccatattaacttagttctaacaagtgtccagttcatggaaagccttcttatttagtttacttgggataattttattttgctttactgttgtggaaaatactgctgtcgtcctcattgtgtaggaatacagggtacacttactcaacattttcttatattgagcacttgttaatctttcagatttccattttttacaagattcagttatgagtggccctcaccatactgacactgactgagctactctctactctgaataaaagagaccctaatagttaggcaggaatatcattgcttctattcagcctgaagaagttatgaaagatggatcttcatccctctacaaaccctaggttgcaagcgttcccttgcaaaaaggatggaggaaatatgtcagaggcattcaaaccagagtgactccatcttgagtaggggctaggtaaaatgagaatgagatatggtaggctgcattgccaggaggttaggcattcttcactacaggatgagataggaggttagcaggactgatttcacaagatacagatcacaaagaccctactgataaagggagaggcagtaaagaagctggccaaagtccaccaaaaccaagatggcaatgaaagagacctctgatcatcctcattgctcattatttgctaattataatgcattcctctgcttaaagacactcccagcagtgccacaacagtttacaaatgccatgggaacatctggaagctaccctatatggtctataaaggggaataaccctcagttctgggaactccttagccctttcctggaaaacttatgaatgataccccctttgtttagcatataatcaagaaataaccatttgtgtacttagtcaagcagcccatgctgctactctgtctatggagtagccactgtttgattcatttacttcttaataagcttactttcactttactgtctgggattgctcttgaattccttcctgtgtgaagccaagaacccatgtggcctcccaggctgaaccccatttttgggttttgccctgtgaaaattctggtaatgatttaaaaataaagaattctttttccagaaatgcatttggagcaatagatatttctgtcaggcaagtcaaaattcacatctgtaatttcacaataggattacctggaattatggaaaatctaattaagtgagctatattatctgagacccacaaaagacacttaatattgcctttgaaagtcctgcctgtctaagaagtgttccacatatgcttcagaaaatgctctgcgtttgtactaagcacttgactagtttgctgtatcccattacttttcttttacccttaacttaaaaaaaaatcccattacttttgataaacgacactaatacatctgaaaagaaagaaataggtttcaaagattggattatttgaaacaacaatgagatcattatgaggctattgttgatgtctgctttcttaaaatgaagaggggtgggaacactctgtggtatatatagatatacgaaaaagccatttaaaaatgtggcagagtttagtctaatcttagtgtgatggagtggtttggtgaggtacattagaaagaagtccttcagaacagcccacccacatgctggtgaaagtcaagtttctgatcattggaagcagcttgactttctgcatgttcagtggcttccatccacatactctgattaagctggatggatacatggggaccctggtggattatgggcacaggatggatttctcagaattctaaaggctcttggcagtggtgatttaaggcactcttccctggctttagcaattatttcaaaagaccacatcaagcccttgtctgttattaaggccacctagggacaattcctcctctcattgtttataccttacaaaacagactatggggagtggttctctgcaggacattagattccagggagaatatgcagattgttattcttagttcagttctccactgcaaatctttaaagagctctctcaggtcattacttatgagtgctttatttttcccccttatagaacctggactggttgtttccatagaaatagtttaaaggggggactgtttttaaatcagggaagagagggcaaggtagatgctacaaaaattatctttttcctcttgatgcttcccctgccctctctgctttttctctataaaatgaagagtttaggttctgggttttgttttttttttcactctttattttattttgaataagttagttatcatctctgtatctcagttttcccattggtctattgaattaaaggactaatagctcaatgtctctagagtgtcattcaactctgagattctagaatttaataatacagcaaaatctccaaacttgaaaagaaatggtagaattgatattacttactcttgcaagaacattggtagctaattctactctgaacttttcccctgtacatctttccactgtttctgaaagcttaaaatgttttaggccaggcgcagtggctcacagttgtaatccaagcactctgggaggccgaggcgggtggatgacctgaggctaagagttcgagagcagcctgaccaacatggagaaacccagtctctcaataataataataataataataataataataataataaattagccaggcatggtggcctatgcctgtaatctcaggaggctgaggcaggagaatcacttgaacccaggaggtggaggttgctgtgagctgagatcgtgccattgcactccagcctggccaaaaagagcgaaactccatctcaaaaaaaaaaattgttttaaaccaaatgctctttattcctcaaacagcctcttctcctgttaaggccaggaatagcaccactgtcttcaaactctcccctcactgctgcttcattctctaacctaatcttttcagttcctaaaaccgtctacatctgcgtcgtttcaagaatggcccctttttctcaactcaagccttattttttctggtttggaaccatattacctctcacctgaactattgcaatgcctccagaaagtcttccttgactacacaccctcctctctcaagaaactttaagaatcccctatgcctgtgctgcctagatggtggccactagccccacgtggccagtaagctcttgcaatgtggctagtcccaacagagaggtcctttaaatataaaatgtacattcggttttgaaggcttaggacaaaaaaatataaaatatcttgagaatgtatatattgattccatgttaaaatgatacgattttggggcatgctgggttaaataaaatacattgtaaaaattaagttcactgattttttgaacttttaaatatatggcttctagaaaatttaaaattacacgtgactgacattatgtttctattgaacgaccctggtctactttatctcatctcctcacatatacctattattgcatttagcaatctctattgtattattggtttcttgtttctccttaatagacagtggactcctagagccccttcgtgaggcttattctttattggattagagcatggtatccaggggttaaaatatgtatttacgcattcttgttgaataaacaaaactcttaactcatcttcttaattacctgctgtggaccaggccatgttctgtgttacagcagtgagcagcaaagaaaaggtccccgccttcatagactttatattttgtgaatgattaccatatgacaggtactgtacaaagtacacacattgtctctttttctcttggcactctccctttgagactggtcctagggtttttccctttttctttctttttttttttgagatggagtcttgctctgttgcccaggctgaagtgcagtggtgcgatcttagctcactgcaacctccacctcctgggttcaagcaattcttctgcctcagcctcccgagtagctgggattacaggcacacgccaccatgccaggctaatttttgtatatttttttagtagaaactgggtttcaccatgttggccagtctggtctcaaactcctgaccctgtgatcttcccacctcagccttccaaagtgctggattacaggtgtgagccactgcgcccggctgggtttttcccatttttaacagggcagtgtggagacttgcagaggctgatttccacctctagtgtagtgagttgtaactcttgagctctaaccttccaactccttctgattcctgagcccatcctcttaactgttttgtaagagctgacactccttacctccatttctcctgcacacctctgacagctcggctcctgtcaaccccgactagaaattccgagtggattcccattgtccatccagtaaagtcctgattcctaatactggaatctaaagacctgtcacagtagcagggcctctgcattgtctagccccagaaggcacgattcccatgatgctgtaggtcactggggcctcaagttgtatacagagcatccctgccagctaggacctagaccttcaaaatgagatgaaaacatccgtctaggcaaagtcacttattctcagcacagactcacaagcccctgcagatatgcatgggagaccatttataggctatttccaacctcctattttatagaaggagatacttagtcaacacacagggaaaagtattttttctaagtttgcactatggttcaatagcagaacctaagctagatcactagaatcttgacttttggtctagagttatttttcttgtctcagtcttcttagaaattcagagaagaaggcattgtctatatctgaacaagtgattcatacagctacattattttagctttgactagaagaatcaccaaacttttttcctcttgatactaggtttgctgttttgataacaaaagaaatcactcaagtgagtttacatacaggaagcttgctgtcattcaagagcattgcaagtgatctcacagaaattcaggaacagatcagtagggtgggctccatgaagacagctgctgagagagtccttaattgccaagatcttcagatgccttgtgttctgctatttaaatgactcagagacagaggtcacatttgtttctctttaatttgtgactggtttgctctaagccttgatttcattgaaacattagtcatgagatgtcacttggtagctactccatttctcaagtgccttgtaaccttcctattttagttccctcactcactgcagaaggttcttgttttctttcattgaagttcccaaagaaatctgattcacccacctcctcgttttgaactaggctgaaacaatcaatggttggtttatgatttagttgtcactgaactgggtgttgtttaatgagccatggcccaaagtgggaatggaagctccaggcattggaagttgtggatatggaagtttatttacaagaggtttgactaggcaagtattgaaatacaggaccgatactttacaaatttgtctgtagaagtgtagtcattgattcctttgtgctcttgtacatagtcctatctgtactgaacacatcataccatcactcatctgcttagacaacagtctcagtattgtttgagaacagtctacatattggaggtatattgatgcctgtgtatcctcagagttcaacctaggcctagagccattgaaaagttattaccaagtgaaggaacagacaaataaaaaaagcttgatgcatatttactgcttggagacaaagggaggtttacatacaggcctttgataccacaaatgacattacattatgttaagcatcagtttatcatcaccactttgctctaatcttccctcaggtatcttagctcatacaaaagaacaaatgaaaataaaatctatttctctttccacacattcatatagagtatttattcatagtcagagatgacactgcagatagcgttatttcctttatgtgttgatatatgttattcatcttaatgatcaacatttaaaaatattacaccaataaaaaggctgtcttaaggacagaatagagtacaaataataagttcttcattgcacacattgtacttaatcatgttatcatttgaagatgatttagttacttaaagagataaataatcactgaatgactatacaagttttaggtctggggccttacattggattcctgtaatattttgtggccatgagaccctaagaatgtaaagtctgattgtatttacttaaaaaataagtggaagtcacatctaacaaagattattttgtataacaaatacaatttttgaagctgagatgatccttggagttggtcatgcaatcttcttgtattcaagattggggacctggactttcagacattgatagccagttaaaatagtccaaagtcaagcctggcttctgcagtcctgtaaacttgcattagaattacaacattgtcaatgattcagggtgtacttgggtgggttacataaggacactaagcctcactttcctcctagataaagtctgagtgatatatgtgtgtgtgtgtgtgtatgtatatatatatatataaaaaatatgtgtgtgtatatatacatatatacacatgatatatatacatatatacatatacatatgtgtgtatatatatacacatatatatacatatacatatgtgtgtgtatatatatatatataaacacatatatatatatatgtcacacatatatatgcagttgtggtgaaaatgcaataaaataatatgtaccaagccctgagcatactgtccagcactagaaaaatcaagcacctgaccaaggatagtatctacttttatgacaatttaatgtaaatcatgagtgatggaaccaggatttgaacctgacacataggtagtgaatgatctttccactttcaaagcagaacttctgtcattctctatttctccagaagcagagactcagatctccactgaagcagttttaaaatttccactcacctttgcagagcgctggggtctttgataaggggccttatttgctgcctactttaacatttgaatttggtattagaaattggagcagcatataccataacctttttgcagtctctgctgtgtactttgcacctgagaagaagtgattaccccaagcttatgccttgctccaagtctagaaatcaggggagaagaattattgagaagtgtgactcaataattcttgtaatacttcttctcccctattctctgtgatttccacagacatggcataattcctgtgatttgatgtgaaatgagagaccagctcagtgctgagtgatgagatctgaacggggaataaaatatgcttgaattaatttgcataatagaattggattggttacaaagctgtgtttgttgaaagggataccagagccccttagctcaccaacaaggggactttgcagatacagaatggggttttgagctctggtgtgggccgtggtaatattcttaatgtaataataacctgtctctaactataaattagctacctggaaatgaaaaaacaggtcagcctgtctgatccttccagctctgtggggaggggacagctgaaaaaccaaatctgcttgctttctgctaagcgctttcgtctttcattctccacccaataacaatttccagcaggagtccaaatatacttaaacacccgtatatgtcattttctttaacggagacaaaagcaggcacagcaagagagttttatgctcaaggcacggtggcttctgacgggctatctgctctcaagatagaggggtgatccttccctttcgagctggtggctttgcacatctattttcctgtcatgttattactgctgtgactttcaacaacatttatttttccctccaagcaatatgctcccatcataaaataaagtcctcctatatgttttagtagaatcccaatgcttaggcatcctggcatactgctaaaaagtgttttaatggattgttcaagaactaccttgggggtctttattaaaaccaattagaacattgatatatttccctaattattaccaacatcaaggtctccttaggagggcagcctcctattaattttcatgggagattcctactaagtccctaccactgaatacatcaatcagttctctcaattctagaaatatttcataaaacaaaacaaaacaaaacaaaaaactgaaacaactctgaatacacttttgtaacctacacatttagaaattctgaaacaggtatttaaaataaaaaccaaagatcaaattttgtgtcatatgttgtttaaagacctggttatactatgttattgatggttattgatggactgatgtaattacctcttgttcatcttcactttggtcattgatataaaatgctttttctttctttttggtttggataatttttttttattatagtctacttctccatgctaccaaaatttaaattatcatcatgttaaggctattgtgtgtatttgtattagtgtgcctaaatttgacctgcagccttctcttaggtaaaattgtagagggtaggaatacaagtcctcaaaccaaacattcagagttcaatcccaggtcctttacttgctggctctgtaaccttggacaaattacttaattttgatgtgcctcagactacttgcctgtaaaatgggaatagcaataatgctacgttttagggtttttgtgaagatttgatgactcaactcatggaaaacatgtccaagaatgttaggcggataacacccggtaaattttaactatattagtattttcattctagtcctgttattagtatacactgagttccaatagtaatttacttcccacatttagctggcttctaggtaactgctttttatcacaacgtccgtataatttccttatgaacttcaaactcaaacaaatggcaagagttgtgattgtttactggttaagaacatggattctagggcctgaagccatgggttcaaatctcaggtctggtatttactagaagcgtaagtctgcataagttgtttaatgtgtctggaactcagtttcctcatcctttaagagaagaatattcatggctcctattcataaggttgttatagaaattaatagatgagttactatttgtaaagcttttagaacagtagctaaggaaaagaacttgctacataaattttcattctgaaagtgaatcttttttttaaattatgtcttaaaatcagtcttatacatacctaagattaaccattaaaataactttctgtatcacatatagtcatataagcatttaaaatggtggaccattgctcttaaaagcaaattgattcagtattctttccaaaagaagaaaagagataatttcacctttttaacagattgaatgttattgtttattgatcatgtggaaactcttaaattcattagtattaagctagacattttttataaaagaaaaaagttgtcatcttgtttcaacacttctagtgttagaaataattgtgctttgcagcaaaatggcagccagaagaaaaaggtgaagaaatatcaactttaattaaaccctttctttctaatacacttcatggcttatatgcaagaataatttatcactctgtgaatgagcatttaatacttggcatggtgcaagatgggcaaggatcttgcctcaccatatgctgttttctttttctttctttcttcttcttgagtttccacagagacaatgtcaagtttagagttgaaatgtgagattcaaatcatatattaaaattgtattgacggcctgctttgtgttcaggtgtcagacatataaatgtgaataagatataatcccatccattcagaagtttccagtctagtaaggagacaaggtatgaatcagaagaaatgcccctcactagctcactgaaactctaatcatgaatatgaagccacttgaagaaaattttacacaggcttcagtttacagagtgagacagaacctctgcgagtagaatcaatgaagttccatggcaaattagtgccagattctccaccaaatcttgagtttcatgacttctgctcagaaatctttctgttgtttcatacagcctcattttagcatctaacccgtcctctggggccttctttgtgctctttccaaacagtcggtttggctttctagaaacagcatctgatgtattattaaagtgcctgaatgtaaggatgaagttgttaaatgatgacgctgccttttccatctttctctctctcccacgtagccttttacatatcccaaagtgtctgtttacaaccaatattaagagtttcaagtcccctattccttgaataaagactaacataataccatcccaaagtgttattgagaaaagtgacagtcaccaggctttaactgcacatctgtggcctcccagataccactttgccagattacaaaggaaacagaaagacttgggatggcaaagtcaaagttcatcaaaatggaatggatctgtatctacaaattataatttcaccaattcttttattttctaggttgctgaggtcagatggctatggtatcccaagtaacttatttgttctcaattcgcatcttggagaaagcacctcatcaccctcttgggggcatctccatgttcaaggcatgggtacccttagagttccacatggctggggaagcctcacaattatagttgaaggcgaggaggagcaagtcatatcttacgtggatggcagcaggaaaagagagagagcttgtgcagggaaactcccctttataaacctgtcagatctcctgagacttatttactatcatgagaacagcatggcaaagacctgcaaccatgattcaattgcctcccgctgggtccctcccacaacacatgttgaattcaagatgagatttgggtggggacacagctaaaccatatcagaccttgacccattatttttcctgtaaatatttcagtaaccatcagtggtttcttgagatcttcccctatgttgtgacactctgggaaaagaagaaggaacctattgcatgtccagttcccaactctgtgttcaggcctgtatgggtgcaacaattcttgtcatcctcattattcacatgaaaacatggaggttcagagtgattgattggcatgcccagagtaacccagattgtaaaatatggaagtggtattctgatccagatgcatctgatctccaagtctatgtaccttccactatgccaagattcatgctgtttccttcttgctcccttcttccctgaaccatttcacccaaagaagacaacaaaaaattaggtgatgacagtgattcctacaatgctcagtaagttttccagtttcatttagacccaggtgctgaaacagaatgttatcctcaatatcaatgtatcatcctcctgcacaagaactttctcagattccctcacattggtggtgaactcatctgattctctctctggagtctgggtggcactccagagagagaaggtgattctccagaaaacaaatgtatggttctaagagaggagaacaagcaaggggaattccttagagaagaataagttttcagcatgagaaagtccaatgaagaagtccagaacccaaggcagaagttaaggactggcaataagaaccagagtgctggagagaggacaagagtgactgtggctcagaaacctgtgaggagtgtagaaaggtgaaaggcattactggcttatcctcactggtgttgagtagctgagtcatggctgggtgctgggaacatgaccttgggctggttggttggatatactgttttgttttattttccttctcctagttagtgaaagcttgtaaaatatcctttctgagacttccaggctaagcaaggtaggatctttggcttcgtggatggatctttgccagacaaaagcaaatcttcctccttgaattgacactatacccttaactgatttaccaaagagaccttaatccattatttctcctgtaaatatttcagtaaccatcaatggtttcttgggatcttcccctacatcccttccctaacaggatccattgcctgcccgccttcttcgttactacctccaggcatgctgaacatcttggagcacactgtgcttttggatgtgatgttccttctgcatggaatcccacactctcctttcttattacagcaacctcactaaaggattgagtccagccatctgtcctctccctaaactgaaccccagtgtggattatatgttcctcatctggactcctttaattccccgttttcttattacaaaatcatatctaagcacaattttgatcaattataacagataaatatggagtgcttactatgtaccaggcattgtgctaagagacttatatgcattactcagtgaatcccagtgacagctttgtactgggtacactcttatccccacttcataaatgagcaagctgagctcaaagcagtcagtgagcttccccaaagcccgtagctcccacgtgataaactcatgcccagtcctgaaggcttactgaaaggaatggaaatgaagtggggatttggcctgcagttaatccaacctctctctgcttgcagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcagggtaaggctgccttccctcaatcctgagctttccaacccaccattggaatagtcgtctgtggccagaaagaagcaaaaggcccacaggcatctaagagagaaaacaccaatggcttgaagagccagtaaaaccacccaaatattgtacataatatgttattccagacttttaaaaaaaataatagacttatccatgttgagaatacttcttaggtttttccatttagttttagggagttatatcataaaactcatttaccatattatttagatatggggtctctctctgttgcccagactggcatgcagtagtgtgatcatagctcactgtaatctcaaactcctgggctcaagggatcctcctgctttagcctcctgagtagctgggactacaggttcatgccaccatgcctggctaatctgtattttatttcatttttttagagaaaaggtcttgctgtgttgcccaggttggcttcaaacctctgacctaagtgatcctccctcatcagcctcccaaagtgctgggactgcaggcctgagccactacgccaggctcaaactccattttgaatggctgcataatagcccattaaatgcacatagccataatttatttaaccattttccagctggaggcatttccctgaccacaccctaatcccaacttgaatgctcctcctttggaccctttatcatagctttgctttttgtattcagtgtatctacttattaatctgtctacttcactagacttcaagctactttgtgtcaagggcagtgtcatccttgtgtacttatgtcctgatgctagacccagctttgaagagctgaatgaatatgtaccagaagcttgggtgtggttttatccctgtttccacaggcatggtaaaacccagtgagatgacttcccattccaggctctgtggtctctgtgtatcccttccagaaaagtgcaagtgtagaaagagggtccaaaatacaaattcaagagagtttggaaaattacctacccactagcatttgagtaaaatgtacagttatctttcagatgatagtgacattaaaactgcaaaaagatatgtgcggccagcacagtggctcacacctgtaatcctagttctctgggaggctgaggcaggtgaatcacgggatgtcaggagttcaagaccagcctgcccagtatggtgaaaccccgtctctactaacaacacaaatattagccaggcgtggtggtgagtgcctgtaatcccaactactccagaggctgaggcaggggaatcgcttgaacatgggaaggagttgttgcagtaagccaagatgtgccactgtactccagcctgggagacagagtgagactctgtctcaaaaaatgaatgaataaataaataaataaataataaaaaagatgattattaacaatgccagttaatattaacaatattaatagtattatttattactaatgccattttctcatttttgttaaagtatttttattatttaagtttaaattattattatgagacaaaggcctccatctcaaaaaaaaaaaaaacaaagatagatccttagatacataagaactgaaatcctatcatgtggagcagctgccgtgctaggcaaaatgtaaactagattaagatagctcctaacctcaaagaggtctagtggaaaagagacagttacctaagcaattaaaaaaaaaaaaagaaaaaaagaaaatgaataatagaataatgaggacattcaatgtaaatgattatgaatttacatggtaatatttgggagggatgtcaaaggaaggtttcaaggacaacatgggaataacctgtaacctaaaagatgaacaggaattatccagtggaaggtaaaggggaaagagaataggtttgaggggtttctgaaccctactgatttctacgaagttatcttaattgttcttttacatgagaacagcacttcatgttcacataattgacatacttgaaggagattaatgttagaatctcaatgacattgtgtaagtttggaaaaatttcttcttgaagagatgtaccaaaggaatttcattcatttatatcccaaatggaaatatgtggaagttgacgtgagaaatggaaatggaaataattggcatatggaattccctaagtagaggagatgggctgtgtgccagagaggaaaaagagatttcagccatgacaagggatgtggagcttaaatgttgtgaagggctgtgcatgaatcattctgagatatgaatagaaccttctgctttggggactttctcaatgggaagcagtgtgtgtgttcagattgggggttgcagaagaaacaggatctggagagtcatttcagcatctctggagtaagcaattgtcatgcctactagaagaaaatatagaaaaaaaagaggggaaaggaaaactagtattattcatggtgtgtgaccttcaaaagctaggtacatgagaatgaatctgatgtccggttggataggggaaaaataaataaagtggttggtcctgtgaatctttcttttgaaatgtgctgagacagttccctggaaataggagggatggaatagatggtttatttcctaacaacctttgatttgatgacattcaaggttgagtgcttaagatgccctgaaaaagtgaaatttggtaaaccatggactttcagatttcttgtggaaatacagcctgtgtcatgctgtgctatgcagagagggaagccattcatctttggagttaggaattggctgcgtatgcctcagcaactggatcccttgatagcactgaatggtttctgaaactgggtttttgtttttttttttaatgtgtgtgtgtgtctgtgtgtgtgtggagcctagtaagtatccatgtcagttgtataaatcatctttgttagacacaaaaaagggaagttatgtcctactttccaacctgaaaacaaagtagaaaaataataggaaatgttttgttaaatttttagttatttggctgatcatgaaatagatccatttaattttcaagaaacttgccaaattcacatgtaatatatgaaggcctctagaaagattcaatgtctgggcattcccattaaagtcagcattttatttatactttcttgttcctcattcgtatgtccttgcccttaacttctgccaggtgtgcagcagggtaaatagaagaacaaaggtaagcctcccctaagatggcggtgtggggcagaaattttgccttcattaaggaaacttggctgaatgaagattggggcaattctgttcatccgtcataggccatcaaacagctttgtattttactgtcaaatggacttattcatcagaaatgtgttagccataatttcacgacaacacattgttatgaataacaaatgctgaagaaaagtctgtttattttttccccctagaaacaaagaggactgaaaacaaaatggtctttgtaattcatacctacaggtaacccccgagctgaaataattggggtttcactgaagcgctgcaaatcaattagatatctttggggatattgaaacaatacaaaattttttaaaatctatgtattcaaccttgctttataagcaaggtctctaggccttagtctcataataataatcatgagttaaggtctctaggccttagtctcataataataatttaaatcaaaataataaataccaattttaacaaaaatatgaaaatggcattagtaataaataatactattaatattgttaatattaaatggcattgataataatcatagtttttattattttatttaattaattaatttatttatttttgagacaaagtctcactctgtctgccaggctggagtacagtggtaagatctcagctcgctgcaacctccacctcctggtttcaagcgattctcctgcctcggcctcccaagtagctgggattacaggtgcaagctatcatgcctggttaatttttgtatttcttctagagatgaggtttcagcatcttggccagcatgttggccaggctggtctcgaacccccgacctcaagtgatctgcctgcctcagcgtcccaaagtgctgagattacaggcatgagccaatgtgcctggcctctttttattattttaaatgtcatttgaataaagctctctagtttacaaagggttttcttatttagtaggtagaaccaaggtctttttctctacttgactgctcttgaagcccactagaacagtaaaaataatgcttactttttcccacaaagggcagaatgaggaccaaggaactcggattaaaagacagctgcagaaattgagattgaacaacaaggcggggtgaggagttttttgctacaggaaaaccagatgtgatttttgggagactttcatgtttgaaaacacagagcagagtgagggcagaacagaagatgattggtagttaagagacctagttgatttcttggacctgacaagtgtgaatttaggcaaatatcatcttatctctaagctctgtcaaagaagaaaaacttggggatgtttaagattctttctgacacctaagaaattgtatacatatcaacccatgccactagtcctacctacctttagcattagaatggacacttcttccaggcaggccacatccccagatcctcataccctgtgtaccgcaaagcaggtcttctggaaaggtctgataagttgaattgtttgtagtaacaaaagccaggaaacaagctaagtgttctttagaaaggactgctaaaacgaacaacaaacaaacaaaaacattggccaggcatggtggctcatgtgtgtaatcccagcactttgggaggccaaggcaggcagatcacttgaggtcaggggttcgagaccagcctgggaaacatggtaaaaccctgtctctactaaaaatacaaaaatgagctgggtatggtagcatgtgcctgtaatcccagctacttgggaggctgatttaggagaaatcgcttgaacatgggaggcagaggctgcagtgagccgagatcatgccattgcgctccagcctgggcaacagagtgagactccacctcaaaaaaaaagaaaaacccaaaacaaaaaattttttaaaaaataataacctccatacagtagatgaggaagatctatagttataaatgtggaatagtcacctgaatttattgttagaggaaaaggatgaagtgaagaatgatgtgtgtactctggaactttattgtataacaataaactagggtacatatgtatctgtgtagatttccttgcatatgcatagaatagaatatctcttataggattcacaagaaactggttacagtgattgtctctgaacagaggagaaaatgaaggaatgggagtcagagctgagaggaagacttacttattgcatgaatgtttgcttatatatttttaaaaataaacatacatttatttcaaactattgacagatacgtttaggtttttatattttgcatatgcgcatatatatggagagaggtgaaaggagagcatgaatcttagaattaaaaatatatatatttgaactctggcttcactgttctgcagtgtgaccttggccaaggctatgatattctctaagattgcctttctcctgttgtaaaatggagatgagaacatctccctttcatgacgtgtgtgtgtgcgcagcagattgttgcaatcacttgtaagtgagtttccccactgctttcctcatggaattaaaaatctcaatttctctttcttccagcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggtgcgtacggtgtgggaggcctgctctgcttccaggcctggtgtctctgtggtgggtgggctgaagcccgttctcccaaatcaggaagtagagcttcttctttatcttttatggcaaaataacaaaaggaacaaaaattcttttgttcctctgtaaaatgggaataacaatttctagtcttgtaggaatagagataatatacatccagtcgctagtgcgtattgatgtctaataggtaatgacactggtaatatctgttgcctgtagacattgtgctaattaatgacttacatgcactattttatttagcttttgcaatgattaatctttacaatgaggtaattccaactcaccgtatttcacagataggaaacccatgccagaaacaagctaactaatttctgtagggacatttgagctattaaatggatctaaaatgcacatttaaccacagcactatgtcactatgttcagaagtacgtatatcttttcaacatgcttgaagacacattaagttgctaaaggataattttttaaaggatttattcaaagaattagccaccttctggcaatagccttctttataacatgcacataatgaaacatttgcataatgtttcttttgagaaacattcctcatattaagaaaggtttgtctttcaaacagtgagtagaactgttctaatcagggagtgagtctgcttaaaagagttttagagctcaaatgaattcaggaacattttacagatgagaaaatccagcaagtataggaatcaacctacttaagaaagataggtttgactctagaacgctaagatccttccactgtgcatacagagctttttatgccagaaaatggtatattccttctccaccaggaaaagtcaagtacttatcaaaagccagcctgaaccatttcccacctttgtctcttccattttccctgcccagtccttcagcctcttggtgtttagcctgtgtattataatgagaaacaacaaatatcaaataaatccatacagaggaaacagcagtgtcagcaactgagtgtcaagggtggggatggggtggaaaggcaaatcatcaaaatatataatccaggaaaattttcattattctcacctttgcgggctcattgatgtttagggataaaattcaggctttttttttttttttagtttcaacttttattttagattcagggggtacatgtgcaggtttgtttatttatttatttatttatttatttatttatttattttgagacagagtctccctctgttactcaggctggagtgccgtaatgccatcttggctcactacaacctctgtctcccggcttcaagcaattctcctgcctcagccttctgagtaactgggattacaggagcgcgccaccacgcccggctaatttctttgtatttttattacggacggggtttcacatgttgttcaggctggtcttgaactcctgacctcaagtgatccacccacctcagcctcccaaagtgctgagattacagacgtgagccaccgtgcccggcccatgtgcaggtttattgagtgaatatacatgaatatactgtgtaacactgaggtttgtggtatgaatgaccccatcactcaggtagtgaacagagtaaccaacagatttcggcacttgtcctctggctccactctagtaatcctgtgtttattattcccactgggtaaacattgggttcatttatacctccagttataaatgaaagcatgtggtatttggttttctgttcctgtgtcaatttgctcaggataatggcctccagctgcatccgtgttgatgcaaaggcatgatattattcatgccaccatgcatagtattccatggtacatatacaccacatattctttatccaatccactgttgatgggcaccttggttgactccatgtcttcgctattgtgaatagtgctgcaataaatatacaagtgcaggcgtttttcttgtagaacgatttattttcctttgggtctataaagagtaatgggattgctgggttgaattgtaatacttttttttttttttttctgagacagagtctcgctctgttgcccaggctgcagtgcagtggcacgatctcggctcactgcaatctctgcctcctgggttcaaacgattctcctgcctcagcctcctgagtagctgggattacaggcgcctgccaccacactggctaatttttttgtatttttagtacacaggggttttgccatgttggccaggctgatctggaactccagacctcaggtgatctgctcacctcgtcctcccaaagtgctaggattacaggcataagccaccgtgcccagccttgaattgtaattctgttttttttgagacttctccaaattgcttttcagagtgacctaatgtacattccaaccagcagtgtatatgtgttcccttttctccacatcctcaccagcatgttattttttgactttttaatcatagctattctaactagtgggagatggtttctcattatgggtttcatttacatttctctgatgtttaatgacgaccaatttttttatatttgtaagccatttgcatatcttcttttgctaagtgtccatccatgtcttttgcccacttttgcccacattgtttttttacttgttgaattgtttaaattccttatagattctggatactagacctttgttgggtgtgtagtttgtgaatattttctcccattctgtaggttgtctctttactctgtttatagtttccctttgttgtgcagaagctctttagtgtaattaggtcctgcttgtcaatttttatttttgttgcaatttcttttgaggacctagtcataaattctctcccaaggccaatgtccagaatggtgtttcctgggtttttttctctagggcatttatagtttgaggtcttacatttaaatctttaattcatcctgagttaatttttgtatatggggaaaggtaggggtccagtttcactcttctgcatgaggctagccagctatcccagcattatttattgattaaggagtactttcctcattgcttaattttgtcaactttgttgatgatcagatggctgtaggtgtgtggctttatttctgggttctctattctgttccactggtctatgtgtctgtttttgcaccagcaacatgctattttggttactgtagccttgtagtatagcttgaagttgggtaaggtgactcctccaacttttttctttttgcttaggattgctttgactattcgggctcttttttggttccatatgagtcttagaacagtttttttttctaattctgtgaaaaaatgatgttgctagtttgatagaaatagcattgaatcagtagattgctttgggcagtgtagccattttaatgatatcaaatgggaaaacattctatgctcatgggttgaaagaatcaatatcattgaaaggatcaatattccatttgtttgtgtcatctatgatttctttcagcagtgtttcgaaattctccttgtacagatcatttacctccttggttagatgtattcctaggattttattgttttgtggcccttgtgaatcgcactgtattcttgatttggtcctcagcttgagtgttattgatgtatagaaatgccgttgacttttgtaccttgattttgtattctgaagcttcactgaagttgttgatcagttctaagagccttttggcagagtctttagagttttctaggtatagaatcatatcattagtgaagagaaataatttgacttcttcttttcctatttcgatgtcttttatttcttgctcttgcctcattgctctgattaggacttccagtactatgttgaataggactggtgagagtgggcatccttgtcttattcctgctctgaaggagaatgcttccagcttttgctcattcagtgtgatgctggatgtggctttgtcatggattgctcttattattttgagaactcagacattgtattatggcatatgacagtacagtcgttgttgtcagacagtactatgaatcatggctgtactcctaatcagccttacgaacccaggcaacctattatacctttctaagtttttattttgccatctataaaatgaggataatataaactatgttgaaggttaaatgaaatagatgtgaaatacaaaaccattgtaaaggatgtagcagagttctagaaggaaattaagcatttaaaattaataatttccctagccacaccatgatggtattttcctttataaatctatcctgcctagaatagtgactgacaaatgggaagagctccaaagagattgtttctatgaaataatgaattatagaagagtaactagaaaaaagtgagatgtacaccacacaaaaatcactgacaatcctataaattaaaggtagtgataggctgtgtaaactggctcccttgcctcccacatagaaccttgcccctctgctgaaaatgttacagaaataacttgagttttgttgtgtgctggattggggttagactttggcaattaccaactttgtgaaatagattacaaagcttcatatatctcaagttcaatttctcactaatacagtagatgtaaaaaatgcccagcagaggaatgctggcaaaatacatggaatgtgcccccagatcatgctggcacagagaaattcgataattactggttttcttcttccagctcctctctccccactctgaagcccaacatgccatgccccagatacttgctatttgtgaccagccaggaacaaaggttgtttttaggaaaagcagaaccccatctttcttcaatttcctggtttcccttcgttctgacccatgaatgcttcccttacctctcaccagatgtttactggtgatttctgttatatggctaccagaccagctacaggtgggaagatgcaattttcatgccagtagggaacagcattctgctcagtatttatggccataaattaattaaattgtagaattagcagcaattttattacatgcaaagcaacaataaaatgatgtatttattgttctgctacagatggaagattgcactctgtcctttcctgaaagcaatttatcgttaattatcatttattatactctgggaagattttaatgtaattatttgatatactgaacatttcaagtgcatgagttgtaagatatttttgcaataatatttataatattattttaatcaccaaccaatgtaggatgtactataaatacagaaagttcatttttaaactgtggccatttttatagagcaggaaggaaggaaggaaggaaggaaggaaggaaggaaggttggttggctggttattttgcatctcaactccaggaaaatgagagaatgttgaataattgtggtgccttcttcagggttaattttagaataaaactttgtaaacaagaacataatttgaaaatctgaggagatgttgctaattaatttatttcacttttaaggaacgtcagtaatccaggtgacagcttcagatgcagatgaccccacttatggaaatagcgccaagttagtgtacagtatcctcgaaggacaaccctatttttcggtggaagcacagacaggtactgtggaatgtcactgtgatttgtgacacatggtgaataagaagtcccaggcctgaccagaacttatttaatactctgttttctcaaatatgaaaaaggaatacagagggctaccctatagggttagtgtgaggattagatacttggcctgtgcctatcacacagttagtacaccatgaaacatttattgttggttttcccatatttcacgatgacccaataacaactataatctaaaaactcaactttaatatcagaagtaagagagcaataaggactaagtcttccacagtgctctctatattcctcacataactgttgccatatctacagagagaaaaagcttccaaaggtctcctaaagatttaagtgagcatggcactcatgtgccaatatccagcaatcatgcagaattcagttattaatttatcattgttttccgtgacaggtgataatagacagtatgtgcttatatgagcattgtatatattttaaccgatttggttcactcttttaaaaattaatatttacactttaatgtattgcatgaaatatgcacctcctgctttaaacttaatatgcaccatcaaaacatttccatgaattgtatgtagcaatagacttacagaagattgtgctggaagtcaaaaagtatgagtttagtcatggatattcatgcaatgaccactcaagtatttcagtctttagggtgtttatatctgagaagaatagggttattacttgaatgtacaacaaaacataaatacaaatgctgtatagtaatttttatgatttgcttgaaaagacataatgatgcttcagtatggctgcctttggttgtaattaccatgttgaaatgattcttgctgagggcatgggatattttattcagcattgcttcctcagtgctcagaactttcttgttgtcataatgttataaacgaatatctgtgatgttgcctgcttacctgtccaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagtaagtaggtggacttggctttcacttttccatggtgacacagccagctctctccctcctctaacctattcctgctttactgaggtatcaaaaagaaaatctagaaaactaagggcaattcatatcattcttacaaaaacaaaacacaaaaacaagacaacaacaacaacaacaatgtcggggagtagaggtagtaggagaatgaaaagatgtaaaaagttctacaaccctggaaacaaaatatcgtttttgctaagtattttgcttggtagtagtgatgcaatctagtaattaattaacccttttctgcctcagtgtcctcatttctaacctggatataacagtccctgaatcagttatcaattactgtgtaacaaattgctggaaaacttagtggtttaaaacaataaaaataataacaataatttgtttttatcatgtgtctggaatttgggcaaggcttggaggagacagcatgcctctgttctccatagcaacaactggggatagctccactggggttggaggatccacttccaaaccagcttacttgcatggctggcaagtttgtgttgattgctgcttcctttctgcgtgggctggttttggaaagtgtgatccccaagggcaccaggcagaaattgtcttgccttttgttaactagcttcagaagtttccactggaaactggagtcataagccaccaaatgtttccactggagtcataaggctcacaaatctaaggggagttcatgtagaccccacctttcaatggaagacctgtcaaagtcatgttgaaggaaaagcatgtgggatgggagatattgttttggccatgttttggaaaatacagtcttccacagtacctaattaataggattactgtttgaactaaaggagctagtgtaaaatcttataatgacaactgtctataagtcgtcaacaaattctagccattgttatctgggggattatggctgttctacaaaatttataaaattgcagagggaattaaatgaaaaacaatgattttgaaaggttattattaataattgtaattatagcaactaccatcatttaatgaatagtcactactattgtaaatctctgcaggagcctacattttacagataaaactggtttccgtaaaaagtgcataagttgccctagaaatgtggcaaagtcagagtttgaacacaagtctgtctatgtatgtacagatgtgtatgaatggacagtatgactgtggtgctgctggtgctgctaatgcatgggggggttcatcatgaaagtgtctttttcagttagagcctgtgagcttactatcagagaaatggaacattttgcaaatgagataacaaggaaggctactaaatgtggccccaggaaggcactgtggttactcaaaggaattcaaaagcaagaatctacacaagactcttttgcctggccgggcacaagttcagcatcctcaataagcctgaggctcatataacattcaaagagctgcatgctccattatccacactgtacgattgtctggtgagctggaaaagaaaggtcaagcagaattattagcaggcagcctttactgcccttggtcatagacaatcatatagtaaagttacattgctactgtactggttttactggtttcactgccgtgaacttgaatgagatttggacaaaatccacataggacatttttttttaaaccttcacattaattggtaattatctacaagggactcccacttcccactcatcctttaatatagagggcatggtgagattaaatagattatgaatccaaaagaaagttgcaaagcaaaatactattgataaatatagacaaagtattagaactgatgaaatctctgtaaggggaaattaaaacataatgagctgaagtaacttgcccaagaccactttgcttggaaatgatagaggaaagattttcaaccctggcttccctatattgtgtgttgcacagagtattaaatgtgaaaagcaaataagataatgttgaatcttagctacttagtgcaaaccttccagtgatttccccaagtttaaacaaaacctgaagtcttttccattccccacaatggtctattttacgcaatttggcctccacttccttacagcccttctctctcaccagaaggctgtagtcactctcctcctcttgctcctctgcaagtattcaggatcttctcaccttagggtttttgccatttgctaatcacctggctggtagtttttatcctgcagatatgcacgtcattgtcttcctcagtcattttagattcctttttctaaagaatgtcttctcctaccacactacgcaaaaccaatctctccctctttctgcttatcacccacacattattaacacaagcatgcgtgttcaatcacactcatacacatacacaaactcactcacaaatagctcacattcatacacacactcacactcttacacaacagattcatgcccacacaatcactcatggccactcacacatttaccccctcaccctcacacacaatcatgcacttacacacccacaaccacacacccactctcagaaccctcacccttttaccctactttattttcctttttcattgcagtgacatcagagtgtgtttacatttgtttttattttttctctttagtcggcctcattaagagaggaatcttgactgttttgtttagtagtaaacaaaacaagcaaacaaaacagtgtcctggcactaggacagtacctccatgtacagtattaggctcccaataaacattaaataaatatataggagggtcacactgcaggaaagccttctggagaaggtaacgcatgaccaacttgtgaagcaggcaagttgcgaaggaggtgaaataaggggagtgtcgaatatagagttagacagggagggatgttaaagtttgcatttttaaagtaactatggagctgttgaaggaaggcttttaaacagagaattttttttttctgggctcttcgcaataccataagtgagccttggagttaactcatggaccatcctgaagacatgaaaagaagcttcagctattttgctaaatgaagacatgcatggttctccatcattacctgatgggaaatgtaacagagcattgtttttctcccttacatgtggcaggtgaccccagcatttcacctggacccagatattgttttatcacccttcgtagaacacattcttttgacaagcaggccatgtgggatcctcctccccacatccactcacttctttcatgttttcagtcaatagaaagttcaatttcaaatcctttgagaaatttattgggattcaatgaaatctatagtcttacagctgccaaataaaagagaaaataaaaatagatgtcttcttcttctaggcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaaggtgagttagggtaaggaatcagacgtgtcagtggtatggcctgctctgccaaggcaacactgcaagaaacagggaggcgacggttaagaaatgagaatttgcgaaaccaggggctgacctgactttgtagttgagctctgagctctggaagatcacagaattgtattcctttctgttactgcagagaagctgacaaaggggctggtgatacctgcctgagattgctagttagttcttaaatgttttccgatggagggaagcacagttctcccatggagggaaggacaatgagataaatctagattttgaagaagcagccctgagcatgcatggaattccccccttagctctgccacactgaatctgttagataagctgttcagaactcttactgtttcaacattcaagattcactgcattgctggaccctctgtgaaactgaagccttctctacttgtttttatctcaagtgaacctggagaagcaacaataatggaccttctcccctagtcaaagagcctgtggacctcccctcatagtcagtctccaaaaacatgtatctggaattaatttattacaaagagaagtttagtgtttcttcttttttacatgcgctcaatactgactactggccagacacagcaccatcctcttacaaacatcatttcatttacttttcacaaaaacaaacaaaagtatgaagtaggtagtgttatcccaatgggcaaagagacctcaacttaattttgaggagattggggctcagacagatgaaatcatttgacccagtcactgtcatatagctcaggcatgccgacctggaattcacaccttagttattctagaacaacttccctctcaagacattttgaaaacagctggcctggaaagcgtttgtaaagaagagccagataagattcacttccaagtgaagaaataattcccgtacattctaaaaaggtttccccccgtgatttaccacttgagaaatcaacacctctccatcatgaaagtgtatggagcattaaatcggaattggaagatgggattaccttggttttaatcaagcgttcattttcaacttagttttatagcatgaatattaaactccttggtgcgatggaaaagactggactctaacactgatagaaaattaatttgaagcatcaataaagaggccagtagctaaagaggagggaaggaccagtgggggaagacaggtcctgaaaggaatctttcaggtgggggagcaaggagtgacctgtgctaagaaactgacctttcacagacttttaaagtatgttggggttggggaaaatattatagagcacaaaacaaagaaaaggtagggggtgattgttataaaaaaagaaagaaaatgaaggatatggaaattggggtgaaatttggatacttggaaaagtctacattaatggatgaatggtaggaccgaggaagcctaattatcaaccacagggagctagggcagtcactaattctggtttctcctctggaaaagtagctgtgtgaattgtgtgttgcctagagctgtcaacttacttcgttaattaatattactatctcttctgcttgacactgacatatgaacattgacatcagcaattcctgcctcccatcctttgctgttcatgtaattgggtagttggttatgctaaggttgtcacctgtttttagtgtattcagggcataaacacacactgtatctctgaaatcctgaaacatttaaatcacccccatggaactcacacgtcgcaaatgagctctctgcatatgattaatttgcacatttgcctccaattcagtgtgtttattctaggcaaaggaataatcttctataaagcactgatgcttaggttttaaatagtgtaagatgttattgcatttgtaaaagaacatttgctcaaacttctagcacaaagttccaaatgtccaccgggggaaaaaaaagaaaaattatagatgaatttaacagagtaaaaatatgactccttgtgaaagtcattccatgcaatttaatactgtaaaagtctatagagacattatggcaatatttctgcattttaaagtattttttaacttagtgtttttatttatttcctaatttattcacccatttttccaccaagagttattgagttcttactatttgtcaggcaggccctttgccagaggctggaaatctaaagttgaagaggcagagtcttgaccacagggagttcacaatttaacaggacagtgaagtgatacaataattaaaaccgagagggttttctcagccttagcagtgttgatgtctagggctggataattctttgttgtaggaggctgttctgcgcattgtaggatatttggtagtatctagtatcccaggcttcccctcactaaaggtcattaagcacgtgctctaccccacccaacagtcctgataataataataaaaataattactctagacattgcctaatagccctggagtaactgggagcaaaatcactccccagttgaaaattgactgcaatagtgtgataaggcctatgcacatgggacatgaatgacttcttgtgggggcagttctcaagctgagtcttgatagatgaggagaaatttgctggatagttaaggacagaaaaggcagaaaaaataactcatgatgggctagtatcaatggaaacaggacacatttaagaaactgcaataccttcaatcttgagaatcttaagatatatacggtaaaaccaacaaacaaacttgttaaaattcaagggagatgttacaaagaattgaagaaggtagaagaggtagtgagatagtagtgaaggagaagaattcaagaaataattactagatagaatcattcatttattgaatattttagaaaacaataaatacctcttgagttctgactgtgtcttagtttaatagtgcacaggaaagagagaaactacccttggggtatttggacaatctctgtgtggttagctgaggaagaaccagggtcaaataaagatgaggttttaggtggcttcgtggacttagaggggaaaatccaatctgttcacgcagcacctttgactaaatgggaatcccatctatctcagagaaatcaccgcacagtgtctgagctatttattttcaaccagataaactccttgaaaagcagtgtcagagcagaattataaggcatttttaatattccctgttttaataaaactctttttatgtttgatttttctttatattctttgtccgcacgtatatagatgtggatacataacatttaacacggttgcaatcagagggtgatctgatttgttaacttaatgtcacatcataaacattttacatgctgttatataatgtacataatcatttttaatgactacataacatcccatcctattgacgaatcattatgtccttaataaaatctcacagttggatttggtgttttgtgtgtacatttccacagattagatataaccttctattatatctaacaaatatcatgcatttttgaatattgtttgttttggttttctgttgaattaatccctcagggaagattttcagaggtgggattagtaaactacggggtattaagaattttatggcttatgcaatgtgttgcctcatttagctttatttcaactactcataacatggatataaatgttcacatgggaaactacctcacatcttgttttggagggaggaagggaataaattgtaggcaaatgtctaaatgttaagcatctatcagccccactcttcattcagtcaaaatgatggatgcatatgatcacttggtacagtcattcttgcctactgtgggacaaagatcagcaaagagcagtaagactcagtagacttctaagggatgctcccctccattccactccaacccccacctcgctggggagggaaatgaagggctgccaaagggccactagggggccacacaaatctatctggggctgttgaggaggacttcacaaggcaatgaggcttgaactgactaccagacttggaatctcgccaaactgggaaagtacatcccacataaacctctgcaaaggcctggagagcctagcttgggatgtgaaactgcagcatgaggatattatcctcaacacccacagggcttcccagtgggaaaatagctccaggttctcaggcatatgcctaaaccaagtacaaaagtttctgctctagcaagatcaacagactatgtgatattagaaaatttccacttttctgattataaattacccagtctcagaactatcatattccagtgtttaatgctatctaatatttgaaaggattttttagaagttgcagcaatcttgtatgttcagcctataaatatcattcctttctgctgctcagtaacctagccaaggataaaggaactgctgggtcccaggatgatggaaaggctgggggcagatttagatttaggaaaaggtagtgtttcctgactctgggaagatggaggtgggaagatgatagaaaaagtatcaaggatattgaacttgcttaaccctgttgaaactgggatcatcagctttagtgtagagtactgcaaaattagatcaggaataagccccatgactatatgcccattcagaataagcgtttgccaggcaaatgacaacagcatggcaggcagatgctcgccttaaaagatgaaactctttccaaacatttggtagttcagcaacatccagagcactaattagaaagttgtttcccaggcagccgggcttgtttctctgctacaatgttactttccatcctttgctgactgattcactgtaactcctctcattcaaaattaggcagtgtttactatcaatttccctataactacagccattcaaatgctactactcattttttttctttcatatttgtgtaaaattttactgctttcatttgtttttctttaaatagaccatctttaatatatatgcattctttttttttttaaaaaaagaagcattttaaaaaaggaaacatttcccttattatcttgtcacttgccaaaaatagaaggtaacttaaaaataaatgcaatcaaaccaaaacgatgccattacattctagctagagttgtatcataatatctcacaaaagagattgtgaagcagagcagatgtgttaaaacggagatgttctacttggtgtgtcaaggatttaaagacttggaaaagaaagaattatctcactatgtgagttaatatcatttgacaacctcacctatcaaattacctataaaccaccctatgtcatcttatgggccactgctggtaagagtcccagacattgggaaacaacgtggtcagaaactttcaacatgaagctttcaatatgatcaagctggatggttgcgggtgggagaggtatgaagcagtcatcaaacaagacatgctttttggctgaaattcagtggtatttttgttaccaggattcttagttttcagaatgaggtaccaaatgtatttttgcaatgttttaattcccttccttaggtaattcttagtgacttatttgggcaacattagtgttgctatatagaataagtttcattttagatgacgtggtctttctgtgtctgttgtgctcttcgaatgacccattaagcacattctaggtttcagcaattgatttgtgtgattttctgaccaaatggctcaggtaattggaaattgagtagactctgattttctctctttgaggaatattcactcgtccctataaaacaatcgggtctttctcttccattattctttcaaggaattggttgtcaatcttctcttcattcttgccagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtacagacggatttattttaagagcttggatggggaattttagagtcaagaggttctgggaaagccctgtaggaaccacgtttttcaatttcaaaaagggttcaagtttatcaggttcaatagaatgtaaacaagattaagatttagaagacatgagcttcccttcacctctgttcctgactttttggataggattgttcaagctacatgactttgctctggagcagattcccccaggcatactaggtgacggagccctgagctgggcctgtctgcctcaggggactgtggggaaatataaataattattgtgaaataattatagtaattgcaatttattaaataccttcccattctctggttactctatgaggaggttaggtatgtgatctaatcaatcccctcaacttaatcgatgtataaattgctagtccttaaaatgagaggaaattggaggcaatgcaagacaaagtgacttgcctggaatgatacagccaccgagcaggaggcaaggaaagccagctctgtctaactgctgctgagtactttgtaaaagtagtaaagtgtccaaataaatttcaggtgattttattattatgaatacctttttttgtgacaaaaaaaatgtgatccagaactgtggctgggcaccgtggctcacatctgtaatctcatcactttgggaaggctaaggcgggtggatcacctaaggtaaggagttcgaacccagcctttacaatgtaatgaaaccctgcctctactaaaaatacaaaatttagctgggcatggtggcatgcacctgtaattccagctcctcaggaggctgaggcaggacaatcgcttgaacccgagaggcagaggttgcagtaagccgagatcaagccactgcattctagcctgggtggcagagtgagaccctgtctcaaaaaaaaaaaaaaaaaaaaaaaaaagaaagaaagaaagaaaaagtgatccaaaactctgcttctccactttcctcttcatcctgagctaatgactgatgaagctaatgacaaaaatgagagggtgataagaaggaggtggagaaggggcttgaatcacacgtttacagagtggaagttgatagtgccctggaatttcccctggaccggattctagcaggggtttcttttcccacagccactcctctcatttccttcttgcttggatttctttatatgcctccacagggtctcccaaccctcagtctttcatttacctctctgcatgaatcctgactctgcagccagagtgaccctcatacaatgcacatccaaacatcacatcttaccttagttaaaacacaagaaaaaattaatgattaaatggttccctgttgtctccctcttcaaaataatctaacctcattcacttagtttaaaaaacttctttgcacccctctacctccatctcattctttgaagctctcctgctgtctcctaatccctggacttcacatgttcctccttctagctggtagcccttgcctttccaagttaccacattggactcattttctccatctccacttaggtgttatctcctataggaattcttccagggctccctagagatgtatcggatgtccttcctcttgctcctccctacctcaccccccaggctacatcacagggacacttaggttatgtgaggtcctcactagaggatagtctcaaagagctggatgtctgtctagtttaggccttggcaaactatagcccataggccaaatctggctgccatttgcttttctgtctcactctcttttttttttctgttgtgaaaaaaatttacatatcatgaagcatgaactttacctgttcaacttgtacaatttattggtttttagtatatttcatgaagatgttcaaccattaccactgtctaattccagaatatttttattgatcccccccacaaaagaaatcctatgtccattagcagtcactccccgtttctcctgcttcccagcctcctgtaacaattaacttattttgtgtctgtatgtttgcctattctggacatttcatataaatggaataatacaacatgtggtcttatgtaactgaatttttgcatgtagcataatgattttgaggttcatacatgttgcagagtgcatcactaattcatttctttttatctctgaagtaatttttcattgtatgggtgcaccacattttatttgctcatttatcatttggatacatgtttgagttgtttccaaacttggctatgacagataatgctgaacattcctggacatgtcttagcctaaacatgttttcctctttcctgggcatatacctaggagtggaattgctggattacatggtaactctatgtttaactttctgaggagctgccaaagtgttttccacagtggctgtaccattttactttcttatcaacaatatatgagagttccagtttctccacattctcaccaacacttttttgcctcttttcattatagctatcatagtgggtatgaaatgatatatcattatagttttgatttgtattttcataatgactagtgacaccaagcatcttttatttatttatttatttgctactgagacatagtttcactctgtcgcccaggctggagtgcagtggcacgatctcagctcactccaacctatgcttcccaggctcgggcgagtcttgtgcttcagtcccccaagtagctgggactacaggtgcacaccaccaggcccagctattttttaaaaaaatagagacagggttttgccatgttggccacgctggtctcaaattcctggcctcaaatgatccacctgtttctgccttccaaagtgctggaattacacgcatgagccactgcacctggcctgagcatctttttatgtgcttattagccatttgtatgtcttcttgggagaaatatctattcaagaattttgcccatttcataagtggattatttgtctttttactgttgttgtaagagctctttatgtattctgaatggtagggccttatcaggtatatgatttgcatttttttctcattccatgggatatcttttcagtttcttaatagtgtcctttgaggcataaaagttttaattttgaggaattctagtgggtctattctttttttttaatgtctatgatgaaataattgtctaatctaaagtcatgaatgatttacacattttttaaaaataaactttatgcttttagctttcacatttagatttttatcagttttgagtataattttatgtatgttgtcaggaaggggtccaactttattattttgcatgtgcatatccaattattccagcactatttgttgaaaatactattttgtcttaattgaatgatcttggcattcaggttgaaaattgaccattcatagtcatagaaaccaggattgttttgtactgttgattacattgcattaattatatgtctatccatacagcagtaccacatagccttcataaccataactttgtactatgttttgaaatcaggaactgtgagttcttcatcttttttctcaccacctatttttgtagataatgttatatgggaagatagtcacatcatttgtttgcatattatctatgtcttctttcctgctgcaagggcagagttgagtagttgaaacagagattctaatttctgcacaagctaaacatttgctggctggcccttgcagaacaagtttgctggcccctgttatagatcatcactgcgccttccactaaacagagtacatggcccaaattcgatgtctaacaaatatttattgaataaataaataaaataactcctgatttggcttggaaggtcaagctcacagtttttgagtgtaaaacaggaggcgtgatagaagtgatgacatcttattcacacatttatttgacaaaccttcattgagcacacactgggggttcccaatatacctagggaggcactaatgaatttacttatgaaaaagtaaatggatctaaatatgaaaggaaattacacggacaatggaatttgtccatttatatcaaagaaaatagtggcaggaaagaaggaattcccaactataagtggtgttgggttgcttttggatctttgaacactgattcttctgaggaaaagagagataattaacatttactgagcatcttttcagcctcatacaacaggttttacaaagttatttcagtcagttctcactgacatcctttgtggctatgactgctctagaattgaacaggtgggaagagtgaggctcagagcaatgatgagacttctttaaagtcacgtggacagtcagtattgaacactggatttcagcccagatctgtcttgagttcattttgagctttttactttaacccagcagccactaatggaaagatttcccaagaaggtttgattactatattctctttgtgcagaaagatatgttacataatgactatggacccttctaacacctttaaatgacttaaaaatcttcacagtgtgaagtttaaatgagttatctctggcctagaatatcgaggtgcattagaaactttttagaagagcagtgactgtgacgtaaaaacactcactcatttcctctgcacctcattgtctccaaggattcacatctgcaattgattatttgggtcatgttttcaaatggtagctgttctgtgcatgtaggcaatttccatgtctataattatccaaggatgctcaataccacacttgaaccaaccgcccactcccacctacttgggtctttgttatttagaaataccagacaaattttaagagaatattcaaagcttttatatttgtttttgagacagggtctcactctgtcacccagcctggagtgcagtggtgtcatcatggttcactgaagacttgagctccctgcgctcaggtgaacctcccacatcagcctcccaagtaactgggactgcaggtgcatgccactgtgcctgcctaattttttttgttttgtttttgtagagagggggttctcactatgttgcccatgctggtctcaaactcctgggcttaagtgatcctcctggctcagctccccaaaatgctgggatttcaggcatgaaccactgcacctagtctattcaaagcttttttgttggttggttggttggttggttggttggttggttggttggtttttggagaccgagtctcactctgttgcccaggctggagtgcagtggcgtgatcccagctcactgcaacctccgcctcctgggttcaagcaattctctcccaagtagctgggattataggtgtgtgccaccatgcccagctaattttgtatatttagtataaatagagacaggtttcaccatgttaaccaggctaatcttgaactcctgacctctggtgatccgcccaccttggcctcccaaagtgctgggattacaggcttgagccatcaggcaaggcctccaaactttttatctaatgggtcttttatcttcccttcctaatttcctggttgtttctcttcaactttgaggacatttgagtctttggacatataatggaggccttgcaatatcaccataactcttaacttcttggacattctgcagttttttgtttttgtttttttttgtctcagactgtagcattagacacatttttgttcagaatttcctttctgaaatattatctccctttagttttcttggcactaacctgttatgcctcagataacactgtacctgatgtcttcactagtctttgatccctgtccaggcattgacttggtccttctctctgtgtccactcacctatagggcttttacccaagccgtaattgacctaagtggatgcttcagatttcctgctcctaggctgatctttctccccaactctaactctgcatttatgatactgtctgttgtgcatttttacccatttgctttttctttcactggctcactcatttatccaagacatatttttgatcttgtaattattgtgacatactttaaaacaaaaacagctgtttccacccctgacttcctgaagcctgcaatagagttgagtcttttctttctgagcattttgacatatccttaattaaatgtcaacctttccttcctggtaattgatttttcctctttttctttttaattttttaaataatttcaacagttatttttgattcagggggtacatgtgtaggttagttaatggttatattgtgtagtgctgaggttgggggtatgattgatcctgtctcattacagggcatatatccaaaggaaaatcaactttataaaaatttatttaaaaatatatatccagaggaaaataaaaacacacaagcactcaactgttcatcacagcactattcacaatagcaagcatgttctttttcaatgtctttaaatctccctctctcagacactcaggtgagaagctacctgggactctctcagcctcccctagatgcccaaatatccactaaatcctacttgggctttcatcatcatctaggattccatttcctctgttacccctgtacttcactctcatcacctcatgtatttaaaaacaaaatcaaatccttaagtttcctctgctccttcttctactctcacttcctcagaccatcttgcccatcatgcgttattgatctccttgagagcttgcgttcttttatttgctcctctgctcaaagccttccatgatttctcactggctctaggatgaaggtcacactcttacatatgagagcttccacagtttgttctcagtgtgtaacagcagcatcaacaacaaaaataatagcagttactgttggttgcaatgtgtgagtcactaaattatgtatcttaaacatttattattttattgaattctcacagataacataaaagttaggtactattaatattccagttcagccaggttcctacaatcccagctacccaggagcctgaggcagaaggatgacttgagcccagctgttcaagacaagctggggccacatagtgagattctgtttgggaaaaaaaatacgcattccattttagaagataaatatgctaaggctcaaagaacttaagtggcttttccaatatcatctagcttatatgtagcagattatgaagttgtacttaggacttccaaaacccaaaactcatgcccttcatttctgtggaataataccttgaattattaatgatctttcttcccacatgtgtgttgtcatgtcaactaaatagtgagctccttcatggaaggaaaaaaagtctttgattatttttttgactcctttccacatagtgttatctgctgagggctcagttgctgagcctctcctgacattgaggaggtgtatgaatatctttggttttgtcactgtgcaaggggactcattattctattcctatggggagctgtgaagttaagtgacatcatgaatgagctcatgtttgtatactgtgaagtgccgctcagtggggggtccctctttcctgaaaagaacatgatctgggattagaagatctggcttccaatattgtctcttccagaaactagacataggccaagtttcatcttttgtaaatccaggcaattaaaccttccgatattcatggcctctgctatctctaatattctttgatttttgaccatcactgaatgccttctgacatactcattttgtaaattttgggaaatcatagcttagacctctaagagcagaaaaccacacacttatgaagctcagcgtactacctgaattaacataacccatttttgttcttttctattttggagttagtataagggagtggaaagggaaggggtttggagttcaacagacccattaaaacaagactgtatcctgggcaagttattttaccttactacaactcagtaaatgccattcttccgccatctcccacctcactttgccacaaatacagcccaataatattatgtggtttttttatccgttattagtaaaaagttaacttagtgggtgggagtaactaaaatcttcaagctgtgctgttttgcacagcctggagtcattaaaatatgggaaaatgccctacaagtaaatggccaagcttactttgtacattacacgctggaactcagagccaagctaactgagaacccctgaaactaaatgaactaaacagatttactaaaatgtagtgaacatttttcttttgtcttttttttttcctgagacagagtctttctctgtcacccacgctggagtgcagtggcatgatcttggctaactgcagcctccgcttcccggattcaatgattctcatgcctcagcctcccgagtaactgggattataggtgtgtgccaccatccccagctagtttttgtattttttagtagagatgcgatttcaccatgttggtcaggctggtcctgaactcctggcctcaaatgatccatccgccttggcctcccaaagtgctgggattacaggagtgagacactgcaccaggctgcatttttctttaaataagacaaactgatttttaggtctatacatgatcttgataaatttaaatacacttgaacggatttaaaatttcatatgcaaaaatctggcaaaggtttgatacatttgtgactttctgagtagtttgggagcaaggcaaactcactttccaaatgcagtttcataaatattcagaggatgggtgattgtagtaaatatggagaaatatgcaccacattattgtacttctcaatcaaatatgctaaacaactctttcattcattgtactgaataaggaattccaatgtggcaaagttatttctataaaagaatcgtgtacaaagtttcaaaagtaaatttgattagaaagaaaatctagcttaagtaattcattgagaagcttgatttaaatatagcatggagaaaatattcaaatattaagctgctctgaatgtcttggtctaattgcctcatttgcattctgcttaggtattccatcgatcgtcacactgacctcgacagatttttcactattaatccagaggatggttttattaaaactacaaaacctctggatagagaggaaacagcctggctcaacatcactgtctttgcagcagaaatccgtaagtattctcctcatggttttgattctactttaccaagtattatcgcttcagactctatattctggaaagtaaaatagctgagatagactaacttttttggtcttaaacagatttttcagtctttaaaatgtgttttcggttatctttctaggagtacatataggcaaagggaaatgttcttgttttctctgacagaactgggtatagacttggcaagagagccagtagccctcaggagtttgaaactcataaccatcactgaaagatttcccactccatccagtcactagtcttcactgaacccagaaaagcaaagtccttaggcccaaggtttgtgggttcttgtttatctatagacaacaactcaaacttgatcatgcatcaggttgatcagtcatcaagcttgatttctggaccctgccccagagactctgattcagtaggtctgggatagggcctgagaatttttgcttccaacaagttcccagatggttttaatgcttctctctagactcccacatttaagaaccactttgatagacatctctctggggatcaggctccatgataggcctttagaattaaagctcagcatcaaagtcagcagatgtggaaaagtgttttagttcttactggtcttaatattgacatttattctaggatatgcctctcccactaacagcacccttcagctcttaaatcgattctgtgacaagaacatctttccctgcactgcccagataggtggctggagcttactctttcccaagaatatgcctggaccaatgtgtatttctccttgacctttcttgactgtctgcattctgtcttcccagacaatcggcatcaggaagccaaagtcccagtggccattagggtccttgatgtcaacgataatgctcccaagtttgctgccccttatgaaggtttcatctgtgagagtgatcagaccaagccactttccaaccaggtaatcctgctttccctattcttggctaggaacaatgcacttggaaatagagtgtgttttttaaaccatcacttggagataccaaccactgcccaaaaaggtttcagagccatagttttgttctgaagttatgttctctaattaaaatcaggctttctagccagccagaaatttttgaataaatgatgtgccaatgtcagcatgatttatttatgggccacctttctctttcagccaattgttacaattagtgcagatgacaaggatgacacggccaatggaccaagatttatcttcagcctaccccctgaaatcattcacaatccaaatttcacagtcagagacaaccgaggtttgtactaaggttcctacgcattcagagaagtagaactggaaaacaaatggcgtttacattgcatagcacaagtattttcactaatctttataatgtcttcctgttgaagaagaaaccggaaataataatgccacctctgttctgaaacatgggctcatttgatgcatgcgaataagtgagtctaattttatttacattttttggctttgatattcatgaagcagtgggaaaactaagtggggaagcttacagggtcaatatgcaaacaactccatttatcttttttttcaagaggttgataaacccttgggggaaggatagctttatgaatattgatatcaagtaaagcattaaaagagattagttcaactttgtaaggcaatttaatctttcagctggccttcctttccaagtacagttttaatgcagtgtggctgggtacagagctcaatatctaaaagtagttgcagaattgttgcctgaagggcatgaaacaaagcattgtttgtccattataaaaacggcaaaatttaatactatttctgcttcccctttcattagttaaggaggttctagacttgcagattattagaaatagatgtttttgtttttgtagtcccagacctgatgcagtccctagataaagttggtagcagagccaggaaagatgaatatatgtatatattttttactctcatccacactgtttttctctgtccattacttggtagtgaaattgcccatttaagtttgtgaaggtgcaggcctgtgaaaacagggagacaaatgccaccatttaacatgggagcaaaaggaggaatacagattgctatattcatgcaatccatgctaaccaggtactaggccataggttgattgctttccctgcgactgagaacaggcttagaggatcttaaactttctagtaagtattatcactttccccattactgttatcactatcatcagtaccataaataccagttgctgtgttccacgacccatgccaagatcctttccacactctgtccacttaattttcttaacaccaccataggtaggcattattgtcacccctattccacagatgagaaaaatgaggcacagaatcattaaataactcgtctcaaatcaatcaaccaaataaaagttacggctgggtttaaacccaggctctcagaggccagatgctatagccttaaccactgaatcctttcgtgctgatgattaaagcagacaggcgctccccatgctgcttggattttgagggtctatgatttgatttaccttattatttcttgaacttatgtgagtatttaattatgggccttataaatcaagcacatgccaaatgagacaatgaggcaaaatgccctaggtgttatgacagccttttctctcccaatgccttgctttctataatgaacttgctcttaagaactgaagtgtgaaggaagttatatgtagaaaaacgtgtttttaaagaagcctacgaaacaacccctgtttcaatttgtaaatgattcccatcattttaaaacaaaacgttacttaacactctttaagtttgtatttacactaggatttttcttttaccttttgtctttggtgaatgtgcacttgtaagtctctgaaagagataattctgcaaagcactaatgtaaatggatagttctcaaccagaaacacacaaccctcatgggacacacatatgtaatacaggaattcattttgtaatgatagttttctccaaaacaaggaaactcaggcacatagtgaacatttaaaaatgtgtactgagctgaattgaacagggtggcacaaatagtgtttgcataatgctttctaagatacgtatacatctgtatttgaatttatgaaaagccctgtgttcactcttagaattttctgcattctcaaatttgtttccagtttcaccttgaattgacagactgctatattttttcagcttaggcttatatcagttttctgacaaagaaatgcttgtaacaatatattgcataatggatttagttttaacaatagtgaagagattgattcggttgcccagaaaactcagatgttctcatatgactattagccaccatcttttgtctagcttctcaaatatttgtggtcaatcttctatctgtgttgatgcaattctcaacttacactggaggtctaactcctggggctgtattcctagcaatattactgtttatcatgggacacctacaaacaggacctttactaagctttccctgctgtgataactttgcctccatcacctgccctgtacattttctttttatatgtgcaatcatatttagttgctgttaacctctgaaaacattatactaagacacattgttctctagggagttataagtattttactttgtcacaatactttgcggataccatctatatttttcaaggagattatataaccctagatgagccaatttactgaacaattcatctcccctgccctctcctataagagactaataccactgttgagctactatttttgcaggaaattgctactttttaagaaaaattactttattaactatggcaaacagttaatgaaaactcccatgtttaaagctattacagaaacttaaagcaaatacagtcctataattatcatttaatagactttctttctactagctcctaaaagtaattacatattgaagtaatccaaaaggagtaatcacattccatatcctattaatagcctactgagttaccaaatttctcggctgagactgctttccatagaaaacatgagataatggtttatatcatgctgagtaaaagcatcaagtctctttctccttgagtgtttacttccattatgccatgtaaataatcagtattgtgtttgcctaaactccggcataagcattcagcgtttttagaaatataagaggaaaagccatcttaatacacacaagctttttatttcattttatcttattccgttctgcagcccgagcttcaaagccgactcagcaggcagcaggaaaatagaacactggatgattcttcaacatttaagtccatcttgggctgttaatatcaggaatggtgctatttgggcagatgaagagcatgtctgcccaggttttgagatgcatttactttgaaaataccaggcatgtggcatctcttaaatcacaagaaatatgtaatggatgagaaaagtgcaaagaaaaaaaaaagactgagataatatctctcctctatgtagctcttaactggtttataaaaccttctcatgtcattgtttcacctaattcttcaaacagtcgcatagggcaggcaggtggtatatttttatccaattttcagataaagaaagaatatgagacatcagaagggtcagtgatttgcccaaggtcacacagcaataagtgcaaaaactaaatttaaatatttggagggccctgttggttgtacatggcacactgtaaaatgaatataaagctcgtgtctcttctagttaattcatttcaaaagtctttgtttatcctattgtcaataataacaatcctcagaagaggcaaattctgaaatttaatttatggattaatctagggttccagggaatgtgtgaacagaacaggacaaggttcttcaattttcactttaatcacagccataataattgtagtaaaatatatttgcaaagaagtttataatttgcttctattacaaaattaatgcctatttcttgaaggaaaattggaaaatacaaaccaacaaaaatggtattaaaacattaaaataacttgataataggctacccagaaatagtcactgctatttgtgtatcctttctttgcatacatttcttttcttaaaaaaaaaagaaaagcaactgtgaaatatatgtccactaattttcccacttaatagtatgtaatacaaatcaatatatgtatgtcaatattttcaagttgtctttctaccttcaactatgaggatatataatatcagttgactgtaagtacgtacattgttttccacaccttcgccaaatatctaattattcttttaggataaattcctatagtgttttggaaggctgaggcagatggattgcctgagctcaggagttcaagaccagcctgggcaatacggtgaaaccccttctctactaaaacacaaaaaaattagctgggcttggccggtgtgcacctgcagccccagctactcgggaggctgaggcaagagaattgcttgaacccgggaggtggaggttgcagtgagctgagatcacgccactgcactccagcctgggcaacagtctggagtgcaacaaacaaacaaacaaacaaaactcctagagtggaattactggatcaaaagctattgctacttaattaataaactgatcatcagaaatgttataccatttttaataccattggtaaaacaggtgaggttttattttctcacatccaggtcaattctagttagtattactctttttaatcattggcaatttggtaagttaaatgtaacattttaagttccagttactttcatcatttaaagccaggtgtttttaataattattaatcagttcttcttttgttcttataagttggctatttatgtcctttgcccacctcttaaattatatatttgtcagtttgcaattgatttgtaaagtctgttcatctattaatgctattcacctttgacctaccatacctactgcatagattttcctaatgttttaatgttcttttaattctgactctgctgtagtcttaagtagagatgttacactttttgtatcagtttttgtctatttactattatccttagcaagatgttcctcacccaaaattgatatcaacattaacttatcttttcttctttcttatatatctttttcccccacctgttgggcattttaaaaatattatttatgaaatatttagtcatgtctcactgctttgtaagggtatctttattgtcttctacattttttatgattagatttttttaactttctattcttcccattctgtctatttactggtatcatatttttctttaataattttatacatatatatgttgaaacctgacagatgctttctccgcattatttttattttattactattttacaaatcttgctttttttattctttctgatataatttagaattatttttcaggtgccctacaagtacttttgtgaatcttattgagcttatcttaaatttatggatcaatttaagaagaactaaaattttaaaaatacttttcctgtccaaaaccatggtctgactttccattgaatcaattctccttttattaccctcaggaagtcattgtagttttcttcatttttgtatcatgcatttcttattaagtttatggttagctactttacattttggaagatattataaagtaatttttaaataatattttctatcatttttctggcttttgaggtttcaactcagtattttatgtgattctattttctgtcctttttaagcataccactgccactgtacttctttttttttctttttactttttaatgggttgacctagagtttgagctatacatttacaattaatccaagtctgctatcaaataacactataccacttcacaggtagtacaagtaccttataataagaaattaatcctaatttctccctcttgttccttatatcattgctgtcacttatttcacttataaataagcttgtgtgtgtgtgtgtgtgtgtgtgtgtgtgtgtgtgtgtgtgtgtgtttcatgcaccgcataacaatgtcttggacagcagcagaccacatataaaaagatgatccagtaagattataatggacctgaaaaatgcctatcacctaggatttaccataactacacttttaaacattattttagagtgtactcattctatttatcaaaaataaagttcactttaaaacagcttcaggtaggtcctttgggaggtattccagaagaaggcattgttaccatagaagacaacagctccatgtgtgttactacccctgaaaaaccctacagtgagacaagatgtggaggtggaagactgtgatactgataatcctgatcctgtgtaggcacaggctaatgtgtgggtttacatcttagtttttagcaaaaaggttttttttcgagatggagtcttgctctgttgcccaggctggagtgcagtggtgcaatctcggctcactgtagcctccacctcgcgtattttagcaattctcctgcctcagactcccaggtagctgggattacaggcgcccgccagcacacccggctaatttttttttttttttttttttttttttggtatttttagtagagatggggtttcaccatgttggccaggctggtctggaactcctgacctcaggtaatccacctgcctcagcctcccaaagtgctaggatttcagacgtgagccaccatgcctggccaacaaaaatatttaaaaggttaaaaaataataataataaaaattaaggttgatttatgcctaacgtaaatgatgagttaatgggtgcagcacaccaacatgacacatgtatacatatgtaacaaacctgcacgttgtgcacatgtaccctagaacttaaagtataataaaaaaataaatttttataagtttagtgtagcctaaatgtacagtgtttataaagtctacagggctgggcgcagtggctcaagcctgtaatcccagcactctgggaggccgaggcgggtggatcacgaggtcaggaaatcgagaccatcctggctaacatgatgaaaccccgtctctactaaaaatacaaaaaattatccgggtgtggtggcgggtgcctgtagtcccagctactcgggaggctgaggcaggagaatgacgtgaacccgggaggcggagcttgcagtgagccgagatggggccactgcactccagcctgggtgacagagcaagactccgtctcaaaataataaataaataaataaataaataaataagtctacagtagtgtaaggtaacgtcctaggccttcacattcactcactcagtgactcacccacttcctgtcctgaacactccattcatgctaagtaccctatacaggcataacattttttatcttttatgccatatttttactgtactttttctatgtttcaacacacaaatatttgctcctgtgttataattgcctacagtattcaacagagtaacatactgtataggattgtagcctaggagcaataggctgtgccatatagggtagatgtaataagctaaaccatctgtgtttgtttaaatacactacgtttacaggaggaaatctcctaacaatgcatttctcaggatgcttccctgtcactaagcaactcatgacggtatatatgaataaccatacctaatcaaatacattgttgcaattattactgtgaacaaattattgtgttaggtcaattaaaatataagaaaaataaaagtgtctgtttcttcatcacttattccttcttccacgctcttcttttctctctgtatatccagatttctgacccatgttcttccctctaaagaacttattctaacatttcttacaaggcaggcctactggcaacaatttttttttccatttttgctagtctgaaaaactatttctccttcacttttaaaggataattctggtagttagagaattctaggttggtatgtttttttctctcaatactttaattatttcactttattctctttttgctggcatgatttctgagaaggtggatgtaattcttatctttattcctctacgggtaaggtgggtttttttctcctgacctctttcagcatttttaaaaaatctttgatttttctgtagtttgaatatgatatgactaggtgtagggacttcctttttggcattgatacagcttgatgttctctgagctttctgcatctgtggtttggtatctgacattaatttggagaaattctgtcataactgtttcaaatagttcttctgtttctttctctcttctgtttctggtattatcatcacatatatattacaccttttatagtttcacagttcttggatattctggggtattattttttcagtcttttgtctctttgctttatagttttagaggtttttgctgatctattctcaagctcagagattctttcctcagctgtgtccagtctactaaggagccctttgaaggcattctctatttctgttgatgttttttatctctagtgtttcttttggttctttcttagaatttccatctctctgcttacattgcccatctgttcttgaatgttgtccactttatccattaaagaccttagcatattaatcacagttgttctaaatttccagctggataattccaacatctctgtcatatgcgtgcctggttttgatattttctctgtctcttcaaattgtaggattttttgttctgcctttagtatgccttgtaatttttttcttcataacggaaatggtgttgtgggtaacaggaactgctataaataagcctttaacaatgtggatagtaagttaaagaagggctagcattccatagtcctatgactgggcctcagtttttagtaagcttgtgcctctgaactgtaaacttcacaagtgctccttagttgtttttttctccctcctttgctgggacaggatacctgggatggcctagagttggaagtttcttttccccaggtcagttagtctctgataaaatcccagaagattaggcttcctttaaaagttttttctaagatcaggccttgttaagaacagaatgctctggcgtatttcaaaatggttcctttttccctcctcctactgatagcatgagggaatttttctctaatattcactgtgagaaccaggtagagttcctggaggtaaaaatcacacaagtgtgtatgtgcatgtgtgtggtagggggtcacgggagaggtcctgtgactgggttcccctagagattttaacttctccacactgggcctccatcaatttgtcaattacagttcaggtttttctaccccagcactggttcctgaggaagtttttgcttgttggttcctaatctagtaagttcgattctctgtatctacttgtctgtctccaatctggggacggctctttgccctgtaaactcaattctcttatgaatctaggaaaagttgttaatattctagtttgtttgtttttttatttggatggagaggtgacttccaagcttcttatgtatcagactggactgaatctgttctaattttattttcttagtcactatttttagtataagttataactgttttaatttatttactattgggcattgcaaagtgatataacttacctgattttcctgggttttctagagcaataactacataaaaattaatggcaatttgtttcaccttttaaaatacttgtttttcatctaattgcatagatttacacttttcaaatatgtgctatatcataacaacagtaatggccattcttggtttacttattactttaatagggaaattagttcttgagtttcatcattaaacatcatactgggtattagattaaaattaagatttgtgttttggggggtgtgtgtgtgagagagacagaacttcctttacattgttgtgttactaaaaaataaatgtttaattttattacaattttttgattctaacaagaagataatatagttttgtctgctggcctagtgacctggtaattataaatacaatattctaatattaacttcataattttaattttcaaccctcttattccaaacaacaatcatttgataaggtacagaggaaaaggcaaggcctagagattaaaggcttggctttgctcttcatctctaaagggagaacaattttaatattaatatctgaatatttgatatataatcctaataataatttataaaacagttgtaaattattacactatatgaattgagctgccaatttgagagataaaggcactgacatactaaaaactggtatcaaaattggaatgcatcccgggatctcagaaccccagggctacaagctttacaatgggccatctcaattagaattgaaggtttatcagatcatggggttacatggctatcagaaggtttttctgtcacttgagcagccaaggaaaattttaggagttttcaatgagtttctattataacgacaacaaaaatactcgagattttcaagtaaatcaattttaagagtagccttttgtaaaccatgaagcctcttccctgtttgatttggccttctccgtccttgatgcttcttctctagttagtgtcagtgtggctttcatcaaattctagatatttcttagattccctatgatagcctcttctttccatccttctgtaatcatgaaaagatgaaaaaatgagtgccaggaagcgtcctaaaagaaggctttcacagtgaatataaatctgatgtcagggaatccccaaaagcacatccagcaaaattagttatattgtgaaagcacaactaattttgatagttatcatgaatagagttacccacagagaagctgtaactacatggtgacctacaaacaggtctgtctgactccatccttgcccccacttcactcagccctcaataaacaaactggacaatgcctctctctctctcttttttaaattctttcctgcctctccatttcctatgtatttaactgaaactccatagcttagtgagcaagacattccatgctttactccttgtacactttacctctaccatgtcctttctcttgctaccttaaatcttaagattcagaaacttgaaaccatgtcaagtttctgaaatatgccatgctctcacatgtccatgtgcagggaatttactccccctgtctatccctcctcctttaagtctcactgtacataaagacatctcccaggtgacatctggcctaacatctcagaacatttgggctgccttgtcctagtgctccaggaatactgccctaacctcaatttttcttatcactctgaattctaaccgtataacacatttccttgtctcccactagaatctgagctctgtgaggccagtatcccaacacttaagaaaagtgggttgactaaatgcataaattaaaagtgaaggagtggttgagaaaacacttcataacatataatcttcttcaaaaattttaagaattagttattattatggaaagaatgaatctgtcatgaaataagctccaggatgaaaaagagaacaaatcatttgatgccagaatattctaaagaagtcagtaccccatcacccagcccttgcattctttcatccattcagtcatttacttttccacaaaattatattggagacctagggttagggggaagaatgagatgaccctctaatgtattagttttgcaaatgtaatatccaagttgtgccatgtggcagatcaatgagcactgaaacattcagagttgagtttgcactgcttaaacaaaaataaaaataagaaagcaggcaagcaaagacataaataaacaacaaaatgtttgcgtggaaagcaatgttggtttagtaaggatagccaagacagattcactcagattaaatcaattggcaaataaatgcctttctttctgttttccccccgaactaaggacattttttatgagcagcacaaactagcatgcaaatatgcttctgatttttcactttcataatttaaagatagccaaacagatttctgtaggatgtatttttcgcccttaattgctccaatatggaagatgctctgttgggagatcaaaatggcagatgtcttttaatgccctgccattttcacttgtgtaaataatcatgtttcttttctgcctaaaattcattgctgcagtttgtctcacacagaacagagtttatctttgaacccgctctctcctcaatccaacaacaacaaaaaaataaatagatcttcttggtagatcagacatcactctttcaaggttgcacgtggtcactgacttaactagttagcttaaagaccctaaatgtcaatatccccctgaatctcttggtagttttctttgtcttaaactaagaagtacgtgggcagtatgttcttttctctccatttaccctaccaacaaggagaaaattactatcaaacataagtgaaagcagagttgattttaagaaatgtgattaaatgtgacaatgaaaagtctcttaatgctaacaaactgcatacttcgatatctcatacacacatgcttgaatttcacatgcacacaggcaagtatttctatcatgttactctttattgtacttcttgttttgcagattcctcagtacaaaaggcaataattggaagaacagtggtgtgtagctccctaattcagttaggagacattatagccatcagagtcttggtaaattattttcattagtacgttaaggctcatcatttatagaatttgcatcattgtagcatatcttttattccaaaatattgggaaagtaataggtttcttcttgcctccttcacattggtttgtttgtgaagggtgtatgtttgcgtgtgtatgtctgtgtctggaaatgctatgggaacagctgttgaatgagtacccctgattgtttgtgggtctctttgccacaaaaaatcttaggtttctaagaactgttcttttatctagaaactgagtctagaaactgagtttttcttttttttgtctaattataggctatgatggaattcaactaattaaccaacctattgtggatattaaaataaactagtttaattagaatgcaataatgtcagtgttccagggtcagttatgtgcttataaaattcaatgaaacctagaggacttcaaattctagttctgttattttccatgtgcttgtgagaaattgcttccctcttagtttctcagttttgtttcttataagatatgggatattataatctttgcacagtttgaaaaattgtctgggataatgtatgtaaaagtaacaaacaacagcgtttgcccatattagcagttcaatcaatgttgcttagttaaatttgcttcaatttaaataataataacagaataataagatagcaagatgaagatatttagcaaaagcaaaatctgcaatataaatataagcaacattagaaggagttggagaatatggaaactagaaatggaccatgagataatgaatcagtaaactctgactgtgtggaaaagtcagactgatatgagattcattggaaagcacagcattcagccatttattctgtcaacacacacaacagtgctaaatgcctaaatgcacaaagacgactgaaaagctaaataagacaaggccccttccctcaaggaggttattgtctggtgaagaggtcagacattcagtcacgatgggctgtgaaatgtacaaactatgcagtaatgtgtacaggtaggtagagagctcacagggtattcagaaaggcaagaaaatagaggtgtacacacagactagtaagttcatcattgatcagtagtaacatcaggagtgtattgtcacaaacttctaaaaatgttctatgaaatttccattatttcagtcccttggattgaagatggtaaacattgactgacatcaaaacttaaaattaatttttcaaaattcacaaatgtaaatgagtgtaaagaaatcgaaataactaaatgctcaaatgatgccttttgtagttgtgtgtcatctatacttctgaaattattgaagcttataactctactaagaaattttagtcacacactatatataaattttatgtatgtgcttatttatgcgtatatatatgtatatatatatatatggatgggtgtgtgtgtgtgtgtgtgtgtgtgtgtgtgtgcacgggcatgtgtgggcacagaaatattttttccattatcttggcagagctattgccacatttctaaggaaagcagtgtaggccagagcaaagtaatcaaataatgtttattctgctagtgactgaatacctgtcttcaagtgtgtgggagcttttcatgtggtagatagatctacttcctctctgaggtttgggaagaaacgtagagtaggcagatttgggtcagcagtgaacaaaatacctccctgggagcaagtcttggcctacattctcggttttccaacagtctgcagagaggatcctcagactgaagtgccctgtggcctttttcataagatagaatgtctctgatcaggtcaagctgtgaggattgtttagcttcagagaagagatggacagaggaaaaggattggtaaggaagagcatctgcagagccttagggaagctgctgagtgactgatgccgttgccctgggataagcctctctcctgacaccatgatgagggcagagggtcctggtcctttgctttggtgcttcctgttttcaagttttcaatatgcaggagctggtccatatattgcccactttgatctgcttttaattttttccttttttatttttatttttttggctaatgcagggttgtcaccaagtgcagtctatctatcaaggtcttctttctctctccatcttaatgttccccttgattgccagtctcatatatttcctcattgggctacatcatcatctaacccctatattggtattccccaactggtaccatggagatcatcattattaggaacttttatattgtattagtataatgaaaaagtgtacaagtaaaagcagcatgcaattaggagtccaggttggactaaaacttagaagcctgaatttgtttttccattaatagaaacactacactttgtgcatgacatattctggtaattaatggccctatttgcaagttttggcctaagtgggggaaaacatgcaactggttacatatctgtggccaaggatgagaacactggtgtcaagatcaaaaaccaagatgcttgaaaaacattttcttgtcatgggaaatatattgtccaggactgaagaatatgaaatattttcttacctttgaatgaagagtccttctgcataggcaattacattcagagctacaatgacatttccaagaattcactttcctcctttgccaatgagtttctcttcctcattagtctactgctcaaagagaagaacttccagaaaagaattaatatttactgagcatcgccaacaggctggcaactgtgctaagtagctttatgaatggaatcaaatttaacctaaaattattagtttcacagatgacaatatggaaaatcaagacacctagataatatgtttaaagtcaggcaattaatatgtacaagattcaagattcaaacccaggtctgtttgaccccaaagattgagttttttgcttcttagaatctttatataagaaaaagatctaggaagtctctatggaaattttaaaattgatggaatatttgtcttttctgtttcatcttagtaacctggagccaatctgacactttcctggaaatatgtcctcactgaacctctttttttcttgggttatccataaaccttggtaatgcatatgtccaatgcaaggggacccactcaaagatggattgaaagctaatatgtagtcaaatatagggtgaaaaattggtgtctagtaaaggggtttcgttattgtttttagtttgtttatatttctatttgtgtgtccagatttgtttttcatgaagttcctgaccatagtagctattttttttccttctttttagagacagggtctcattctgtcagccatggtgtagtgcagtggtactattatagctcactgtagccttgaactcctgggctcaagcaatcctctggtgtcagtctcctaaggagatgggactatagttgctggtcaccccacctggataattgtttaactttttatttttttagagacaaggtctcgctatgttgcccaggctggtctagaactcctggctttaaacaattctcccacctcagcctcccaaagtgtcgagattacaggtgtgaaccaccataccaacccctagtggattttttttttctttttgattcagagtctcattctgtctcccaggttggagtgcagtggcacaatctcggctcactgcaacttccacctcccaggttcttttgtctcagcctcctgaataactggaattataggcatgcgccaccacacccagctaatttgttttgtttctttttgttgttgttgtttttatttttgtttttttgagacagagtcttgctctgtcacccaggctggagtacagtagcgtgatctcggctcactgcaagctctgcctcccgggttcatgccattctcctgcctcagcctcccgagtagctgggattacaggcacccaccaccaagcccagctaattttttgtatttttagtagagacggtgtttcaccgcattagccagtatggtcttgatctcctgacctcgtgatccgcctgcctcggcctcccaaagtgctgggattacaggcgtaagccactgtgcctggccttttttttttttttttattttttagtagagagagggttttactattttggccaggctggtcttgaactcctggcctcaagtcatctgcccacctggttctcccaagtgctgggattacaggcatgagccaccatgccaggccatagtgacttatttttgatcagtgatcagagtggatcacaagaaggacaggccgtgatactgaaatgccactcagaaatgccacttctgagagaaggctcgcactcccattggtcctggaacaacctggatctaaagggcgaatattttattgactcaagcaacacagaccacctaaatgccaaaccaggctgctagacacgtctcctacccactgtgttcacctttaccagctcaccagccctggaggatctcagtaatgtgtgttaagttttctggtagaaggatcccctgagccttctggaagcacagcacagaggataaacactgatttctatcatgttatttagttgcttaacaaccccatgaggcatgcttgctatcaatcagtctcctaattttaaagatgaacaaatggggctctagatgggaaaagttacccaattgaaagcagataattagtattcacccaggaagaaagccttagtccatttctttcccacttcttgaactgcttaaaatctatatgtgaagcatgttttaatagcagaggtttgaaaagttcttgcgatcctactgatctatcactcagagattttaaatggtttggtcagctgggtgctttgatgagcttttacgtagtggtttctgtgtgtcggagaggactcacttgttcagaatatgaaacatcttgaattcatgtgccaatgtcatgcccagatccatgttttccattggtgtttgagtttcaattaccttcctccataacccaacctgctgtgatctggaagtgcaggtctgcctggatggcacattgaagaatagattttaaattatgacttccacaagtttataaaaataaaaatattctgttcccataccctccagccataacactatgggtaacagagtaggaccaaatgtgtaaaccaagcaagtcatctgctgggcatgtcacccatatcaaagagttttctttgacctagaaattcaattaaatttttaacattcatttttatccatgatgacatggacatttcagatcattaaaatggagtagatattgtaactttcaatttgtgagagtctaatttaactatgaaaacatatacaagaagagaaaatatattttgaattaatttattatagatatgtaatttttattgtaattgctaagtatggaacaatggtgtgtaaagcctagtcaggtgactgcattttcagttactattttacttgactagcttacttttatttttttcatcctatttcatagtatatgcaatgtttttataattttccccagtgataagagaaatgtatgccaatcatacaaaattcagaaaatacagaattgagggctggctgttctgtgttgttttggatgaaatgttggcagtgaaggacagagaattggtcatatcaggtctactagagccagaaagtacaaaacctcaccatctgcaatattcagaatttctgcccatccctaaataagactgaatctgccatatatatatatatgtgtgtgtatatacatacatatatatatatctatatatagatatagatatctaacggaaaataaattgtagtaggccttccatattcatgggttccacatttgtgaattcagccaaccaaacatcaaatatatttggggagaaaaacagaaaacaacaaaaaattgtaatacaacaatgcaaaataatacaaaatttgaaactacagtatcataactatttacatggctgttacatggtattgggtattataagtaatttagagatcatttaacacatatgggagaatgtgtgtaggttatatgcaaagactgtgccattgtatataaggactttgaacatccttggattttggtattcaggggagggtcctataaccaattcccggcagataccaagggaagattatacattttctttaacctaaaatatattaaataattttgaaattctgagattttttttccctactacaggagctaattcaaaatcctgtcaacctatttaaagcctaccagctattgggccatgatgctagtcataatattcatattgctataaactctgattcttaacccacaaacagaggcagaccataccagaagttcagtgtgagtgtgtgtgtgtatgtgtgtgtgtatgtgtgtatgcatgtatgtgtaatttgatggaacatattaaaaatttctactgttttataataccaatgctttcccactagaaaataaatcttagaaaattagttgaggctggtagagaaaacatgatgaggaaatattttgggggcagaggctacaaaagattgggaaatacagaaaagccaacatctggaattttggttaaatccttcccagaacacagttatgccatttgttcaacaaatatttattgaatgtctgctgtgtttctggccttggagagactgagatgaatcagacaaaaatcccctattctcaagaagttcacagtcccacagaggtcaaagtggttatgtcaacaaatcatgacagaagagtaggttatgtatttctatacaaatatacagtgtggtgggtcacacaagagatgatgggagaggtcttggatggtctccctgaagagatgacttttgaattatattttgaggcctgagaagtacaactgttatgataaaaggaacagttattttgagcaagacagtagtggataaaaagaccaggcacacagaagagtgtggcattcttgggggacagaactgaattcttgatgtcaggctgaactggtccatgtggaaaaagtaggaggtgagcctgggaagcaaggtgaaatctaggttagggaaataatatctgatcctccaccatgctggcagaggtgcgctgtgttttgttatgtgagcaacaaacttcaaatcattctaagcaggaggagtgacatgtttaattgggtggctgatggtgttggggttttaaagaaaccataaatctcctgcaagggttataaaatagttcctctctttaaagcatgtatatttacatgactaatgagtggattcatagtttgcataaggtttgaaggtggacttggaatttcttttttaaaaatatatacaaacaaaaattggctaaacccttgtcataaagtaggaagtctgcacataggaaaaaactttttctcacacacacttgaatatttaattattaatatttcgtgtgctaacatagagtagattgctgaagctaatagcccagcagaaaatggtgtgacaggcttgcctttaaagggaatttccttcagtggcaagcctgccgcaccattttcggtgagaaaacgtagggtgtgagcctggaaagcaaagtgaagtctaggttagggaaataatatctgatcgtccactatgcaggcagaagtgcgctgggtcatgtgagcaacaaacttcaaatcattctaagcaggaggaatgacatgtttaaccgggtggctgagggtgttgggggaaatcccttcactggcaagccggccacatcattttctgctttgctcttgcccattcttcaatggaaattccctaccaaatccaaagagcctgtttctgagatttattccaaaatgcagatagcttgtttcgtgatcatgccaaacggctgtggcttccgcagatacttagatgaaagaacaagtaagaacgattctggcggttaacctttatgataagagagtgccctcaaatctgccgagcagagagccgctgtgattccaatggtcttgactgggcgcacggcctgtctcccctctttctgcagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctgggtaagggcgcttcctggtcccctgcaggaagggccaggcaaccggatgcccctccttgaaacacatgcttctcaaatacaggctggtaaccaggaccctgttatgactgtcgacacagttcaagaaaagaagtggggtacgggggcggggtgggcgttgtgggggcgaggtgggggatgtctgcctcttgcatttgatggaatattgcagggagcagacaactgagttccagcagagaacagggaaggtcatgatgagcattttgccgggccatcacagggctgtatagcaggagccactagggggcttcagggacatcagagaaggtttggcataagaggaatttgggcagaaacatggtgtattagcaatggttttgtcccacaagagaaagaataaggcttagggacattaggcccataagaaggagcaaaacacagcataggaaggactcgggaactggaagaaggaagaagcaggactctaacccctccactaattatcatatataacatctgttctaacacctcagctcatgggtaccccttggaagcttttcctgcacctacccctgcttaggtgctcttcttctgcacttctgtcttacctgtggtttattctgtagaaaagccatgtgctggtactcagaacatatgccattgctgggcctcaggaagatcattttatcccaaagtctcagaactagtgactgaccaaatcaggattcaaacctatgcatgtctgacaccaaacctacacttttgccatgatgcttggtcctacctcgaatgaattcatggagctttactccataggaaaaagccagtgaattcaattcagcaaatagttactgggtattctctgggcaacgggccctatgttaggtcctgggggataaagagaagaagtctatgagatctctgtgctcgacaggttcacagaatgtcaaggaaagtatgcatgaagaggcacacggtgggtgctgtaatagggacatgaacacaagatggttggaggacagagtagaaagcacctgacatgggccaggcgcagtagctcacgcctgtaatcccagcactttgggaggcggaggcaggctgatcacctgaagttgggagttcaagaccagcctgaacaacatggagaaaccccgtctctactaaaaatacaaaattattcaggtgtgttggtgcatgcctgtaatcccagctacttgggaggctgaggcaggagaatcgcttgaacccaggaggcaaaggttgcggtgagccaagatggcgccgttgcacttcagcctgggcaacaagagcaaaactctgtctcaaaaaaaaaaaaaaaaaagaaaaaaaaaaggcacctaacattgcctgggaaggtcaaagaaatcttcctggaggatgtgacatacaggttggctgctgagagttgtccagctgaggacagaggcttggataaatgaatatttcaaacagaggaagtaaaatacaaaagccctaaaaagttaatagaagtggaaacagatgtgtaaaccatgtgataaatattataataaggataagaacggggccaggctggtgcatgaaaaaggtgccagtagtcctgtctggtgtcaggatggcaggccaggaagtgtatccatgatgaaagaaaaaaagagtccgctaagcagagaaagtgaaaaggagtggtctgtgtgagtgaaagtgcccacaagaaaaaagcacagagctttgggagccacacgaagtccagggcaagtacaatctctcattccttcttctcagagcagtagtggagccagaggggcgctcagctggagtgcaagattcagccacaaacattttcttcagccttgctgggtgtatgggagagccttctaatggaatattgtagaagcctcttggggaaaagagggaatcaatgaagaattaaactgtgcctgaactttccttataaatgactctgatcacccctcctaggttgcccaagcttaatggaacccccctctcccagggaagacatgagattgctttatctgggcttccagctgatgctattttcctatgttaaagtaaacagaagattttgtcttctgggggtctttataaaacttcctttcctctatgtggtggctacagagagtccaaccacacttacggtaagacttcccattaagttagtataggaccaatactctttctcagacattggcagaagctagccatcaccccctataagatggtaggccctaagggctctgcatgtcctcatttttaaaccttggaaaaacagctaccttcctttgcaaagagaaattggcattagccacttctaagagactacagaccaacatatttagaatcttcctagttcttaggaagatgactcctaaatggtgtctggattcatttgttaaaagttcaaaattgtcccaacctgccaagttgttgggtgtaatgttttcatggcagcatttgtagaggaagagccaggcaggggtcaattttacacatccttagggattccaggcaaagctctcatttcctatactgtttcctgttctgagcatttatacctcatggtttatggtaatcagagttcctctggcagaagaacccaggaatactggacttaacgaatgcttaccttctttttctttccctccagtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagattttttttt

SEQ ID NO: 36906 - DNA, 3151 bp, Homo sapiens
aacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 36907 - DNA, 3041 bp, Homo sapiens
gccatgtcactggctcaggctcagctgctgggtcaccaggagaatggacgcttcctccacctcagctcagagcacagtgatgattcgtgactttcccaatagaacttcaaatctctgaagacggggggtggggggatgtgcttgagtgtttgtactcatggtcttattctcggagtgacaaagctggaacacaatacctctatgcatgaaaaggttgtcacttgtcacaactaacaggctttcacctcatggaaatttttttaccttgtgtacttttcccctggcagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaaggtaaggcatctgtataccctgcccccttcccaagaccagaccaggaaaaatcatttgtgcagttggcccctcattccacatggggattagctgctgtctggcacctaaaattgagatgcttcatcatcagattctcagccctgacaacatacagaatcacctggtgatgtcaaaaacaaaaacaaacaaaaacccgatgtctatgtcatgggttagacaagggattctctaaacttagtgtgctcagattacctggggatcttgttaaaatgcagatgctgaactgggaagtctcaggattgatcccactggcttggggactttgctgagtagcaaaaacatagagcaactgaatttgaatttctctctagcaaaggttcccaggactctaacattaaaatgggcctggtaattctaatgcacggtgaatattggcacccattgtacaaacaaccttaccccagggttgggaagagttgggaatggagcacctatggtgtttgtttctgtgagtgtggggagagtttcagacagtgttctcctcatccatgcgccatgggcttcaacagtggtcctggctacagaaaatactatacatctctataactctggagaaaagggacatttacatgaagagattatggtcagcctgggcacagaattacacctataaatggtggtgggcccctatgatgtccccgacactggtagcttctgccctgacacccacgatctctactcttccacctacccaaaactgactgtctctctgctgaaatatggaggacagattcaccctgcccaagtcatgtttggaaccctcttcctccttccttatccatgtccattcatttcattccctaattcaccatcaaacagcaatcaatctcttcaagtcttactgtaatctataaaatctatattggtgatcatatcagttttttgacttgaaggatcatatgttctgtagatttttttttttcagaatgttctggacaattaattttctctaggccagatcacattgcctccttcctctgtcatcacaccgtcagctgcagagatattccatcttctgtcagaactgtacacgattaatttgtttacaaacatggaaaacaaaggcctggactcatgctctagatactatttaaattgaagcaaaaaaatgtggaaacaaacatcatttaatatcgaccacttgcattgtcttatcatttatttgttcatgcatcaaggtggtagaaaggggggcatggtgtctgccttcaaagaccctccactctaaacgaagaaaaggccaatgaagcaaacacatgacataaagtaaaataagaattgctactgtgaataagggtcaggtattgccacaaagcatacctatgagaatttgaactagtcagggaagttacctcatgaagtttggattttgggggaagaagagaattaaagaaactaaagtcaagagatatttgggcctttgaagtagaagagaggcatagggttggtttctgtccatttgctgagcaactttttttccttttcacagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatc

SEQ ID NO: 36908 - DNA, 4571 bp, Homo sapiens
gcggcgagtggagcgggagccgactggaagaagggctctagggagggggctgtggctgctggggtccgaggtggggccgggtacaccagccccatcactgtttgcagagagtcagggaggcggaaaagacacgcgctctaggctcccatcagggcacatggcccgggcccatcccccgcgcgtctccccggctgcggggcgcggggggctgccgggtgcgcttggctgtggcgcggcgcgttggagactttattgcgatgggacgataagaggggcgggggcggggtcctgggggccgaggcggcagcgctttaattaaaacggaaattgcggccccgggccgcgcgggggccggagggttccaagcggccccttagctggaagcgtttctccaggacccccccgcaacccccgccacgcccgggctgccccctcccgccaggccctgccggacccggcgccgtcttctcctccttgtcacccgcggtcgcttcgggcggggatcggtgccaccgagcgcaaagcctgcctcgccccccttccccgtcccccccatctcccaccgcccagtccccggcggcgatgagacagagcggcgcctcccagcccctgctgatcaacatgtacctgccaggtaccagggaccagccggaggctggtggcaccggaacctggggcgggaagtctaggctcaggcatgggaagagagtgctggggtccaggggaaggagaagtgtccggagattcgggttgcatggagggccgattgtaatgtagggcactggggagacctaaaggcagatagagagctctgggtttcagtgcagggtctagaggagttgaaatgagcagattgggagcctgggggccaagagccgggactcagggacccgaaggagcctgagaggggaagcacgggtctctggcgtggtggagtactctgtggccgagccgtaccagaaggctgtggtccgcgggcgtctcccctgcgctctcacggctcctcaccttcctgctacgagcttcaggccggccctccaggcaccctcctcttctcttcgcgctccagctcggctggcgcagttccccgctcggctttataaggctccagccggccccttcggaaagcggatttcctttttcctggacgcgtttcctgacttgggctctatggaggggctccgcgcagcgcgcctggaccaggctccgggaggaggagccgggtggcccgggcccccagcctcgcgcctggggaccacagcaccccccttaagccttggcccggggcccttttgtcaagcccacaacttccgcccggggttctcctgattcttttcttctgctgcttgcagatcccgtcggagacggtctcttcaaggacgggaagaacccgagctgggggccgctgagccccgcggttcagaaaggtgagatggccggcgcgctgggcggcggaggcgaggttggttggggtcagggcacaggcggacagtaggtgggagcagtgtggacccagggttcacactgaagcccggagtcctggcctggttgtgcggaggccttgggaagacagtcacttggtttttggctcctgcatctcctgagcaccaggaaaagagttgcaggccaaggcagatggagaggatcccagccccaggcccttttgctgctgtgtatggttttccaggctttggggcaggggctgggacacttagcgtcctttccctgctggtagtaggagctcaaggccgcagcaccagccggcaatggaaccgggggaattactccccaaacacagcgggcttcccaatcactagaccctggctactgccacctgcttcaccctccggcgctgactcacgccggctgatctctgctggccaactctgccagacgattgcaattgattcccaggttcaccaccagcgctccacgggtagtcgctaaattacccttttgacggctggctcttcaagcagcgtctccccacagtccccatctcagtcgttaccctagatctcaccaagagacagaaaccacaaaaacgaggttggcgactgttttatccagaaggaaactatgcccaacaggaacggtcatccaagccgctgaggttgctccgcctttggtgccaggtgcacctttgtacccaaaccttcccttgcttctgaccctaaaacttaactctggggaccagaaaccaggaagctctttgctgggctggcttgaagggattgggattgaaattatggggaagggtagcgtctggattctaagccagtggctgaaaaagtaagaggggttcaaaagactatatttgaggcagtaagcagaccactttgaggaaaatccgttttattctaaaagggagtgggggtaattgtatcgggatttttctctgcctgtctgcttgaggctccaagacaggggagcaggaattctgggaccccactctctaaccactcgcatatcctggaaaaacctccttgctgcctccagcaaccgaattcggagggagatcacacaaagacaggaggaggttggtagccaagcacaacagctgctcggtccgttcccctcctcagagttgttcatcaggccccgagaactatggcaccttcgtaggcagggaatcccgcctgttccgaaaataagaggccaaattctcagggccagcgcagaggcctgcgcacccgaaggtggctaggatagtgagcccatgagagcttgcccctcctgtcacgtatagggggccactgttcgttcctactcctgtcggatgtggtgtcccaagggagccagccaccactccacctcaggagtagcctgtccaactacgtctttggggactcgggactagctgggccttgtccagcagtggttggggtcgtcctgctgcacgcctgtcccttcccacctctggatgtggtccagctgggatggggcagtccgatcattctgcccaaggccgccctgtacggttgtgcgtcttttccctaaataagggcgcccggctgagatggagagtggcggcggatatctgtccttgctcgccttggaaagccaagtgccttggtgcgccgctgcgctcacgtggggggaggcaatgcttccccttccccccaacccccaagttccacaaaaccgtgcatctggaaagctacgtgctcttcagtggaagccgcatttccattgtgcaaaagcgcggtaaggctacacaccactctgctgatcagcccctccggggccggcctctcccgccgaacgcagctgcagtttgacttgcacttttcctcccccagtgccggttcctgccggggtgggtcagtttcccgccagcactcttccccagttcccgcctccccgctcccgcctgtggctgaccgcccccctccccacaggcagcggacagatccagctgtggcagtttctgctggagctgctggctgaccgcgcgaacgccggctgcatcgcgtgggagggcggtcacggcgagttcaagctcacggacccggacgaggtggcgcggcggtggggcgagcgcaagagcaagcccaacatgaactacgacaagctgagccgcgccctgcgctactactacgacaagaacatcatgagcaaggtgcatggcaagcgctacgcctaccgcttcgacttccagggcctggcgcaggcctgccagccgccgcccgcgcacgctcatgccgccgccgcagctgctgccgccgccgcggccgcccaggacggcgcgctctacaagctgcccgccggcctcgccccgctgcccttccccggcctctccaaactcaacctcatggccgcctcggccggggtcgcgcccgccggcttctcctactggccgggcccgggccccgccgccaccgctgccgccgccaccgccgcgctctaccccagtcccagcttgcagcccccgcccgggcccttcggggccgtggccgcagcctcgcacttggggggccattaccactagacggggcggtcgggtgcctgcggcctcgcccgcacgcctagagtctcgcccgatcccatcggcatcccggggagggcccgggagcctccgtcaaccgtcctctaatccagagtttactccacctgccgcacttagcagggggacgggaccgaagctccctcaatccttgtctggtactagatttgctcctgtcccaccccgcagtcccctgaggagggcgatgtgcgccctctttcactttttttcttctaggtctccaggtcccggaggggatttgtggacctctcttgtctccccaccactccagtgcatttccgcctggctcctagaagccccattcaatatcactactctttaacgagtgccaaatcttttcccacttttgctcttccccaaggaactgctcccacctcagcacgtggaggcctctcacggtcctccttcctgggacctgagcaggtttggtgaaagccaccgtcctccgtgacacacggcccccttcctcctgtccccacactcccaggagaaactcccggtgtgtttctgaccctttcagccccattaaagctcctgagctctc

SEQ ID NO: 36909 - DNA, 219791 bp, Homo sapiens; identical to SEQ ID NO: 36476

SEQ ID NO: 36910 - DNA, 70466 bp, Homo sapiens; identical to SEQ ID NO: 36033

SEQ ID NO: 36911 - DNA, 144214 bp, Homo sapiens
gttgctgaagcttcatcctttgctctcattctgtaagtcatagaaaagtttgaaacattctgtctgtggtagagctcgggccagctgtagttcattcgccagtgtgcttttcttaatatctaaggtaagtgctcagttttaacttagattttatatcagtacaaagtactacctaaaaaccaaacgcttaagaggtttcttaatattctttcttctttggtggcataataataaatttaaaataatgttgaataaattggtgtatcacaacataatgacatatcaagtatcaatgaaattctcatttcaactaagttattctgactacaaatatgctacatatttttagcataatcctatatttctaacatttttaatttgtagaatgccaaaggtagcatttctgtattattgggcattgaattggatcctgtagttaatttaaacaaagtattatctttaagatcacctacttctaattctgctcttaaactttagtggtagaattacatttgctttagattttcttgatagttttgttatagacactaagaaataaactaaaatgaatgacaacaaaagtccagtggttttataagttggaaataaacaaaacaagagcaaaatagcaacctgactccttcactatttttggagtgaaaagggaagaatgtttctttccctaaatctggaaaatataaaatactgctcaaaatatgtatgaaaaaataaacataagtggggtaaaagtacacatgtgctaatgcttcagcttactgaagttatgagttctttctttgcgttttctaaattaatacatgacaactagcaaacacaatttttttaaaggaaggattagaaaaaaataatacggaaaaatataactcagctgactgaaagatttgccagcagaccagtacaaaaacgaactacggaatacaccgtttgttttttgcttattttcttgcaaacattttgtaggtacaaaaaggcacctttgtggaatttaaaaagtaatgctacaagttggggttcgttttataggttctaggattcatttcagattgtctttcaaagacaaatgaaaagtagcatttcaatgtagttagatatagcattccaaagactaacaaattcaggtgtccaaaagatatcagctaagcttgcagttaaaatgcggaaaatgaaattgttccatattgtcctttaaaaaatgtacttgctagtcattaaactaagttgttattaaattgcattaaaaattaaatgatagttgtaaattatagtgggttcccaatgtgttcagttttgcataacttatagggcctgaggatctccctccactccctaatctgtggctcatcacagcgcttgtgtcttctcagcttgaggcaccagggctgtggtttcccagtgggaggggagaaactacagcgtcctgaggatgactctgctactctcctgctccttcagaacccaccttgaccttcatgacaccttcctgtctctccctccctccctccccttctctcagcctctatagcacctgtctggctttattcttctccagacctactgcagggccagatagttctacgacgttctcatgaggattgcaggatccatcacttgctactttggccattttggattccagcttcatttttaattttatatgttatgctgtagatagttttatgggaacactggtacaggagtatttagtaatttgtgaatggtaaaggtctcaagacttttctcagaacctgtgaaaatctcactgcctgctcgacttcagtatgactggtgggtaggaccactgaggaatggggacaggagggcttgctgtgcccaaaggcgtttgtgcttcatcctaagcaccagtgagacctttgaacctctagaaaaggagagcagcccagtcacatgggtgctttggaaggatcactgcagttgacatggagaatggattaagggcagtggaggcggcagtgaagagtaccttaaaacctagcttcaccttcgtgacttctttaactctgtttttaaaatgctcaattaattttacttgagaaacatctctggaaagtctaacatcaatgaagaggctatgattaaaagtttaggctatggagccagactgccatttgaccttgtgtgaattacttaatttctatgtctcagtttcttcatttgtaaggtgagaggagttgcattgtagcagctaccattttaacaagtatcaaatttagtctatataaggcaattagaaagtttctgacttcttagtaaatagtagcttccatcggcatcacccatcaatgcaccctcttatcctgaccccacactgcggggaagtcaggaagacctcgggaaaatgacggtaactggtcaggaacttgaacctgcttctcacagtcccctaagaaggcgtaccagaaaggagccctaagcaggcaggagactccaggctgaggctatttctgctgtttctgtggagaacgttctctgcacgcagccatggctgctcagaaggggtgtgtgcattccaggatacaaatagccctcctggcattcctggtggctgcctgcctatccctagtggtaaggtctatgaaggaaagaaaggcaagtgactgtttacctttcccatgaaaatcttccttttcttcaacatttttgattgtaacgaaaactttatataaaatattctccctttatttttatttttttttgagacagagtctcgctctatcgcccaggctggagtgcagtggcatgatctcggctcactgcaaactcacctcccgggttcaagtgattcttctgcctcagcctccctagtagctgggattacaggcatatgccaccatgcccagctaatttttgtatttttagtagagacggagtttcaccatgttagtcaggatggtctcgatctgctgacctcgtgatccacccgcctcggcctcccaaagtgctgggattacaggcatgagccaccatgcccagcctacataaaatactctaaaatgttaatcttggtgaaacaatataagtgtgttgtctccatactggaatgcatttgaatgtttgtattttggcaacatttgaaagtcactttaaatcatcccattcatatctcaaagcaaaggtgataataaggaagtgaataaatggccctgaggccatctgaaactttttaaatgaactgccaggccataggaaaaacacatatataccacgtttgataaaaaacttaagtgtacctcaagaatttctttacgcatttagaagcacagtatagttgatacattgaaataacttccttttcttaaaattttaatttaatattgtgtgaatgtttttcagagttagaatttagttatacacaatttttagggactaggcaaattgaaggttttttttttttctagagggggcagtgatagttgatttgcttaaaaattttaggcttagtataaaaatcaaaatacttataaaatagattacaggctactttatttgctgtttggttaaacacaaacttcatgtgtaattttaatttaagaatattctaaactctgttctcctttgtaaataacagcaaatttaagagtcatgtctatacaggataaatggtactgcaatgtaggctggtccccttcacagggctagtacataatgaactggtttctggatggccagtaagggggtctttttaattctctctctctccctgtctcacttctctaagaagtgtccttggcctcagcccacaccttgcccatcttcctctcctaacctagccggcttccctcattgcctggtgccttcctcttgagagcattcccttaatacaacacctgaacaagaatccgcatctcaggctgcttccagggaacctgatgtgagatagtgtcaacctaaataacaagcgagctcccaaagaaaagatgttcatttgtgaatagagcattgcagtgggactatgaggattacataattgttctgaaattattatccttggctacagagatcaataacaagagtaacaccagtatgagattgtaggcagatgtcctcgcagaagtgtttaaggttgtggtttttgcaatcttttgtgataatttttgttatcagcatacaagcataaaaaatttttctttatggccttccctggttctgtttgtcagagttttcttaacattagtgatcctgacaactttcacatagataaagttgaatggtattctgagaattccatcagcatacctgatcacaggctggagtgcaatggtgcgatcttggctcactacaccctccgccttctgggttcaagcagttctcctgcctcagtctccagagtagctgagactacaggcacctgccaccatgcctggcttatttttgtatttttagtagagacagggtttcgtcatgttggccagaatggtctcgatctcctgacctcgtgatctgctcgccttggcctcctaaagtgctgggattacaggcgtgagccactgcatccggtccccgatcacttttaaattccaatttttccaacagcaattgcttcgacaggttccctgggaaacagactccaagctggagatatgcgtgccatgtattggaacccatcttgaaaaaaagaaaaaaaatccctgtaggacagcaaaggcggcaaagtgggcagaaggagatgtcaaatagtactgtagctgccacagagctggaggcctgcagggctgttcccaaatccagagaggggccgggctttcacccagtgcactgataaaacgttggagtgtgcctctcatggggaaacacagccatgggcgaggcagcttagtgcattctgaagtcattctcgtcatcagccatcacttccacaactgaaggaaggagtgtcttggttctgaagggtgatgggcgtgacatagcacgagtccacccctcgcatcactcagatcctcttgctttgtttacctaatttgggaacagctcctccaagggtttgattgatctcttttcctgggggaacactgagggaatattaatggcaggaactagagcctccccttatgcagatggtctcatgactacagctgatacttacccatcctttttccctcccaccgccttcacctacccattcagcatttgcttcattctcatctaacaccctggctggtctgagtagccttggggtgaccctgacattcaactctgaagggtcttagccttggtcaccaacccctaaccagtcccaatgcacttgtggttcacacatggctgagcatttgctctcaaaatggccagaggaataccagcaaatgccttgctggtccgcctgggtgacaaacatattcttcccagacaattcttgtcagaatggtgcatcgtgtcctcaccagtggtatccagcctgaggaggtgaagcgattgcagcagcttgaagatgactgggactcacattgtgtcctctggtagaagcactccctgctgggagcagacttccagatccacagagcccatggtaatggggatgggaggcacatacttcccagctggcaaacatgaccacttctacgctcaccattggtttccagagggatatatcctatccactggggatggagcgccataatggtcattgattttggatgtacagaactgcattctgaagtatcccccatcctcacaggggatcgggggcctcaacggcagctttaaaagattgttctatcaccctgtcaggccagcagctgctgggaaatacagaaagtggcaagaacaggggatcccgggctcatgtacctagcgcccctctgcctttgccataaggtgggtcatttggcttgttggcatctcctatgggattccacatcagtggatcacacattctgtaagttcttggatagtgatgctggccaaggccctgcaggtagaaaagaaaaatccaccccagcctacctgttagttcccctcaagatgatgtaaccccctggccaccgagtggctgcttggtcttattgagggatgctgctgtatccaggttcagcatcagtgtctgctgtggacagtttagacattcagcaggggcagtggctggatcagccttgccaagaggaggcctagctactgggcccatgcatggcctccctccctgccaccattctgggctgctctgtatatgaccccattgtgggagccctggagtggatggtgatgggccagctgtgtcaactgggtgagccactctcgctatggtgccccttctacagtggacggcttggaggctgttaacgtggtaaaagatcttcctccttgatgcccaataggtccatccacaagcctcttcctcagacttctctgtcctccctattccaaactctccccttccacccaagccattcaccaccatccatgagaccatgtatagtctaacctcagcctcaggtgatttctgtttccacaggaagtggatacacaggtgcgctgcctgtagctttgtcagcgaggaggttttctctcaccacaatctttcagggccacccattgcagtgtggcagccggccttctgtggattgcacccacagaggcctaccaaatgtggcccgtttcctccctggaaggctggccataagggtcacccctgtgtggccaggagaggtgcattagtggtgggtgaccgggactctgggtccctcgcacatgttccctctgcctgcctcatccctggtgccccacttctgacttaacagtgattgctgctggctcctgacctgaggccttggtgcatctcacagagctcaggtcatgatgtgaaattctgtgcatgggattatgctgtcccatgaccaggtgctctgtcttccaccaacacccagtagcactcggagaagtgttttacaaatggcatatatttctctgctgcagatggcatggcctgattccaaactcctggaggcctatgctgtgattcttccactgcagcttgccataaatgccacattaccttctttccatcaaggatgcatctaaccccacaggggcaccagcaggtccagcctgcagtatgtgcagccctgatgcagagccctgttctggccacactaaagctgtcattctgtaaatgggttaatttttccaaggccagaacctgaagtggtctaggaggcatcatttttcctttacagtggtggtaagtgcaagatacaataattaattctttactttgcaggggatttccctgcatgccctagaacactagatcctaaaaaccactaagttggcaggttcagatcttggtaggatttctctctcaccgtctgaacacatcttttactaaggctttttttttttttttttttttttttttttttgagataagagtcttgctctgtcacccagtctggagtgcaatggagcgatctcggctcactgcaatctccacctcccaggttcaagctattctcctgcctcagtctctggagtagttgggattacaggcgcctgcctaattttttttttttttttttttttgggacaggtattcaccatgttggtcaggctggtcatgaattcctgacctcaagcaatccgcctgcctctgcctcccaaaatgctgggattataggtgtgagccaccatgcccagcctaagaaggcttttaacatatttgtcgcattcactcatctagtccggtccacatggtatcatgaagttagtggacaaatgctgttctgagaatgtccaaaatggcctagatcccttctgaggataggaatgtggcaagtaaatactgcagcctagctcatgggcctatgaagctctgcagttcctctatgtgagataaatgggaggaagatgcctgtgccagttcaatggcacacatgcctggtgccacgccaatctacaggagcaaggatgcctcccccggcacagcagctgtgcagctggctttgaggcagatcactttcattctttacgatacctctggttttctagaggccagattggtgaattaaatgggaatatggtggagaccactaaccttttgttcttcaagagaggcactaatctctgccattcttcctaggatgtggagagatgacgggcggtcatcccccgtcctctcactacacagggacaggaactccccatgtggcagttctgccagctatcaaatattccctttccacttacatatttgttgaccagggaaatgaccgtttggtggttccaaaccctctgtcgtccaggctggagtgcagtggcgcgatctcagctcactgcaacctccgcctcctgggttcaaacaattttctggcctcagcctcctgagtagctgggactataggtgcatgccaccacgcctggctattttttgtatttttagtagagatggggcttcactgtgttgcccaggctggtgtcgaactcctgagctcagggaatccacctgccttggcctccaaagtgctggaattacaggcgtgagccactgcgcctggcctttttcctgaaatttttttggaaaataattttctttccctacttgtgttatttctgtagatatgaccaacatgtagtcctgtagaataacaattaaaaatagttgaggtagagatttcattgttacattatattcatgcattcagtcaacagatattggtaggatttctggacatggggactggcctcaaaaagggcttaacagagaaaactatcaccttgctttcatggaggtggggcaaatagtatgagaagatagatgcaatttgggaggatgttgaataagataagagacaagagagaaagacttgaacttaagagtaattttcttggtttcagaattagagaaataggttaaagctatcagcagaactgaactcccctaccctactccttcacccccctgcccgctccttcaggctcagagctgcacaaagtctaccttaaatagtggttatgctcaaagggttgtgtcaaaggacaactaaataattacccctttagtctcaacatagacaacttagaggtcattgatagtgtgattaaatattctgctatcaaactattttaaaagaataaaaatataaaataaacgtttaagtgtttaataatgaggggaatcaatactgaaaataattttagtataatggctctatttaaaatatttttgtatgagtatatgtggaaagtacatgaacattatagatcaattatataataattttagtaaattggtatttgagagtcttgattgattgataatattaataatatatggcattatagagttcttctgacttgatatgagtaacgtctgtagtagtaatctccagaactttgtcaagatggatgtagtatcatcatattctgtaaatatatcatctttgaaatattaagattgcctggattccaaaaccataaattttatacatgctatgcagtaatagcaagcataatgacttctctatgctaaacattattctgggagcattgtattttccatttggagctttggggataaattttaagaaaacataggcctccagacacatatgctacctgcatatattgggggtgcatcacaattacaaagttaactggattggttatgaaagttatatgtccggccgtaataaaatggctttgtttgaaataattatagtaagtgaggcatgataacctttatgaaacttataattctcatgacattaaattcttgtaattgacccactatatttacaatccacctgttgtgaggaagacagccagcaggtacaggagtcagataaaccttaagaagtcagattcacaattgcaagcctcattcacagcatcacaggactttgaagagaactattatatcactgacgatattaggaaaatgctaataaatggccctgtaaaatcctcgtgtgttaaagagttttttgaataattgaaaactatatttggtgaaacttttctgttgataataaccttcagaaaatactgtgcaatcaaacatgccacatgtttgcaggtactttctgagtaatttgcaaatattttctggataacagaacacaaaatcaacaacagaaactttaaaaaatacatctatatatatagtctactaaaaagttacatattaaatcaagacataaatcatcttcttcatttgacatcgaaatcaatttgtatattttaaaagcagagatcagccatagtaattccagttatattttatgagccaaaataatagcatgcctttaatctgccactttgtttggaagtcttattttcagaaactatgaataaatcttctacaccatcttcccgagagctttagtaagacctcagactggagtagagttgaaggagggaatgccagtctgaagaaggaaaggaagaggagagacagcaaggagaacttcagttgtcaaggtatcgggtgcaggggtcagaaagaaacatgactccatggaccactgcttggcccaagaccagatgtcaaaaccacagagccctgctgtagagcattacaaatgtattccaccaaatgttgggatgcatcctagacctgtgctggccagcagtccccagctgtgaggagaagcccgccatttgagttgatcacttggcagagttgatcatcataaaattatccttgtagagctaaataaggtttgtctttgacattcagtctggtttataggatagcaaaagggaagtggcctcagctagtagatttgaaaagcaaaagtaggaataatgcttttcagatactaatcttccttcccgatccaacacattcatcatatgaaggtagaattttatatgacgtcaagccctaaaatacactattcaaagacagtgcttacggattaacatatatgctaggaaacagagtagcgtactcggacactgagatgtaaaaagagggaagtgtcggccgggcgcggtggctcacgcctgtaatcccagcacttaggtgggcggatcacgaggtcaggagatcgagaccatcctggctaacacggcgaaaccccgtctctactgaaaatacaaaaaataagccgggcgtggtggcgggctcctgtagtcccagctactcgggaggctgaggctgcagaatgacgtgaacccgggaagcggagtttgcagtgagccgagatcgcgccattgcactccagcctgggcgacagagtgagactgcgtcccaaaaaaaaaaaaaaaaatgaaggaagtttcagcctatgaatcatggcatatgcatcaatcatactattacagaagttaaagggtctggaagtaataatatgtaactctatcattttctccttcattcgattcttttcccagctgttcatggagtttctgttgaagttggtaggatctttatttattttattttatttattttgttttgttttattttattttatttttgagacggagtctcagagtctcactcttgttgctcaggctggagtgcaatggtgcgatctcggctcactgcaacctccacctctggagtttaaatgattcccctgcctcagcctcccgagtagccgggattacaggcgcctgccaccacgcccagctaatttttttgtatttttagtagagacggggtttcaccatgttggccaggctggtctcaaactcctgacctcaggtgatccacctgcctcagcctcccagagtgctgggattacaggcgtgagccatggcgcccggctggtagggtctttattaaagaacagttatgagagatgtatgaagtatgagtaaagatagaataatttaggtctttaattgtaatgctatatcctaaacatggaaatctatttgaccaatacattgtggatgaggatatactttattctgccttcctttaacaaatacgtataactgagctgttactatgtgccagaccctactttaggtgccagttatataataagcaaacagacacccttcctgtcttcctggaggtgagtctaatgaggaccaggcaataaaaagtaaacaaataaatgcatcattatgtcctaaaaggaactttggaggaaatgaacaggacacagttgcagattgtacaggataaaagggacaagagcaggtgtttatggaaggctgaggtcaggaggacagagtggtggccacgtggtatggaccggttttcccggcagtgggaacaacgtgtccaaagactataagataggagaaagtttattccatttgagggatggaaaggctggtgctgttgggaagggcacagtgaggtgagatggagctggagaggctggctggaccagatggagtgaagcttcatctgacatgcagtgggaagccacgagtgactttaaacagggcagcaatggtcctcttgttgggtgccatgtggagattggattaagagaggcagagtgggtggaggagaccctgaagaggctgcaccgtcagtgttggagtggagcaggggcagtgcagatggggaagccaggatgagcacagctgtcctcaggatgtggcaggcagggcttgctgatgaagtagacgtgaggtggcagagagattgtgatggcactcatgcttctgagatgatcaactgggaatggccgatgccatggactgagatgggaatagagaagagaaggggggaaattcaggaggtgaggagaaagttattgaaaattacgttactttttaacaagtgcagttcgaaataccaagtggagatgtcaaacaggcaattatcagattagagtagagagttcagagatattttaggtagaaatataaatttgggaaccatcagcctgtaaatagtatttaaagacatgataatgaataggatcaccttgaaaaattgaaggaagagaagagatggtcccagaacagttcaggcaaaatccaccatttagaggccagagaaaaagagaagattatgaaagggcctgagaattaaagtctagaaaggtagagggtaaaattaggagaatactgattttaagaaaacaagaaaaaagtgttttcaaggaggaaatagccaaccatttcaaataaaatgaagagtgaaataaattttaaaaagtgagggaaataaaataggaaagtgaatattggatttggaagcaaggaggttatgtgatccctctgattgatattagccaaagctaaatatggcaaaataacttctggaaatacatccttctatctaaagatttgcctgttctttagaaggacctgtttggtgcagaaggaaaataggtcaaaaatagttgcaagcattccttaccatgttggtagaaggtgttcttactccatggtttaccatcataagccatcctgcctttatgcctcttgctatgtgtattatccaggactgtttcgggtgcaagtgacggaaacccaagtcgaagaagttcaagtgaagatgaaacttactaatttataaaataaattagacagtgctgaatttaggatctcaaatgatgttgttaggatttcacccctactctcacactctctccctcttctttcattcttcctgatttcttctctggcaagctctctccaagtggcggagggatgaatgttggcagtgcagtgttaggtccattaacttctgatagcagaggccagcttctctcttggagcattcatattaattctgggacaactgacactggcttgcttgtgtcccatgacttcctaatggtattcaccatgtctggattgatgacataccctgattggtcagcatgtaccacatacacacctgtgttactggacatgtgtccacatgaccgatagctggaccacaaccgtggggagctgaggagtgttctagggacagacaagaaaacagtaggtgcccactataacagtatacagaagaaaaaagtagacatcgactgtaataggacacagaagaaaacagtaggtgcccactgtaataggatactgaagtagacacagggttgcagctgagcttccaacagttcctccatatagttctttgttaacattaactcagctttcattgcagccaactactaacttaacaattagctatgtgagcactaagtcagagattgagggtaggtataaatcatgccaagagctagaggaaatttggtaccaaataacaaccggtcttggttaagaggctaggtatccataaatgctggtcttgctctattgccattctgtgtcttgtttttgctaacttgttaatgtttctggatgttggtattattctttagtcaagtactaacctaatgacaccataaaagctttagatttctgatttctgagagcatctaataaaaaccaggacagagcaatgagaagagtttgtctgaattgcctacccgtgtaaatataaaactgtgttttaaaatgagcctgtagctgaagtaaaaatcaaaacaagaccagttttataagctaacatttgtaggcctgtgggtttgagcttgtttttattttttttttcccttttagtcacttgctcgtttaaataaaggtttttgtttgtttgtttgttttgtttttttctcttttcaggtctgttagatacttaaagggcatttattctgttggtttggtgtattttgtagggaactttttaaaatggcagagtttgccattttattttaaaagtcagtcctattgtaaagaagagagaatgatttgatgatcttttaatctagatgtgtgtgtgtgtgtataataagggtattattattcgagaattatgctgattataactttggatgaaattgataattatgatccatctattttgctatatttagtgtgctgtgctgagcaatttgactaaaagataaaggagaactattcttgaaattatttggtcatcctaaatacagtaatgaagttgggatgagtatggtaaatttattaaatttactgttacaaaagaaatatatatatcaattctataaattgaaaaaatacaaaagaaatttgggaaatactattttaaatgaaaaaaggtggattataggaggaaattattaataattttttagtttccttacagtatttttcctatgagtatatattttaatatgtatatattctaagttttcatttaacattatatcactagaatttccctaggttgttatatgtttttcaaacatatttcacatacccaaaatactaattttgtaatactatagtaatttgatggattaattactctaattttaatccttcttcatttaatgtccagttttgccccagtacagataatggtaaattaaagatctttaggcacaaattctagtttttgtttctagttgtttcctttgggtaagttactagaattggaattactattgtttgtttgatgttcttaatacttagtgcccaatatcttttgggggggttattgttaactttcactttcttcatcagaggagcagcatgtctctttttcaaacacctggccaatattatctattatcagtttttaaatttcccttaatctttgaaaactgctgcagtgatggtgtttattggcatttctttaattcagggtgaagctgaacatttttggtatgtttattcgtcacgtgtatttctttgatgtatacgtgtattcattgcttgagttttattggatttttttctgtttttgcttggttgagattatttatattttaaggatattaaccttgtcctatctttaaggcaaatacttctcccaatttatctgccatggtgttctttgtgccacacatctcctagggcaggcacctctccactcctcctttctgaaatgttggagctctttcagaatgatgtaagttatgatgcaaacagtaaggcagaaaacacactgagaattactgccactaattaacgtgagatgagatgtttcttggaagtttaaaggaaaatagaagtaaaacccatgcagtcattcccaatactagcataacataggcagcctgaatttaaccatcccactagcttgctccttccctgccagctcacctcctggaagagcaacttgtatagactggatgcctcttagttctcacttttcattgccttattatgatctgtgtgtatgggcttgtttctagactctccattttcttttacttgtgaattatctgtcactagctcatttttttttgttactgtagcacaaagctgtatcatcacaacctgtagggtaagtcccactccttatgcattcgtgtgttcaacaagcacttactgattgcctattatgtgcacataactgatactggtcacggtcacctagtcacatcgttgtaattgacttctcacgtgggttaccttgtcatttggagggacgatgcaccatgatggtgcttgttacctagtaagaaattatctatctggatattagagctaggtgacatggcttatgaaagacagtttttgaaactgtggaaagtaatttttcaggagttttcagattgacatcataagtgctataagaggtttgctaagccctcagtcagcaagccctgtgaacggaaaggaccttacccaaggcaggtagaatgccatcgctaacactcaggtgaatctcccatgaagattagaaagatggcttactctcttatctgacagattgcatacagctgcaaagagaattagtatattggaaggtagatcttagaaaacaccacagagtgataaatctgtggaaatataaagctaagtttaaaaaacatgactggtgaatgaggaggtctaaatatatcttaattgaagccccagtggaagtaaccggagaaaatataggaaagacaatggttaaataagcaattgccaagagttttctataactgaagacaagttcaattgaaaacagacactgactcatgaacagaataaattaattcaaatttatgaaatgaaatcattctgaatctggaaaacactaaaagtaaagaaacttttaaaagtcccaatggaaaaaaaaagacgtaacactgaaaaaagctttgtagatacgtgttgaatgaactgttgaaagcaaagtggtggaaatttgtaccagaaaaacattgaaaccaaaagtggcataccaaagtcagtatcagacagataacttcgaactattataactcattctttgagttcttagatagaattaaatgtcatttctaaaaggtctgttttgttctttctcaaactcaccttttcaaaaatcatatgatattaactcattttgggcattatccttgcatttatcatctttgtgtctcagactcttgataatggcctacccaaactaggcatgacaataaatgttggttgaaatgaagaatatcatgaagacactatgttcgattcactatattatatgctatgacaataatcacataatgtagaagacagattatctgtccttaaggtcattttgttttaaataacaaactggggatcatgaattcagaagcatatgaaagcagatatttacaccaaaacaagtatagtgcttcacatctggagccctatccattaaaggattgaaaactatacctgagagatgcattgaaaagcaatcaaaattaaatatagcatggccgggcgcggtggctcatacctataatcccagcactttgggaggctgaggtaggcagatcacgagatcaggagatcaagagcatcctggctaacatggtgaaacccagtctctattaaaaatataaaaaattagctggatgtggtggcgcacacctgtaatcccagctactcaggaggctgaggcaggagaatcgcttgaacccgggaggtggaggttgtagtgagtcgtgattgtgccactgcactccagcctgggcaacaaagcgagactccatctcaaaaaaaaaaaaaaaaaatttgggaggccgaggcaggcggatcacgaggtcaggagatcgagaccatcctggctaacatggtgaaaccccgtctctactaaaaatacaaaaaattagcggggcgtggtggcgggtgcctgtagtcccagctactcaggaggctgaggcaggagaatgacggggacctggaaagcagaggttgcagtgagccgagatcgtgccactgcacttcagcctgggcaacacagtgagactccgtctcaaaaaaaaaaaaaaattaaatatagcaccaacatactttgaaggatggttagcaggagaaataatgtaatttttaatgacaaaatttgttttaatgaacaagtctatgaaaataaattttgttcatgatacattaaaaattagaattatttatcttggaatatagattttaagttctaatatacttatttcactaattatgttttgtaaagggtttataagaagaccacaaagtgctgtgtgttattccaatgcaatttcttgctgacatgaataccactaatgcagttgcctgacctccaagtgctgaagcattgatattcttctcaagcctaatttgagtaaatacctaaaggaagctggttaaaccagatagcctctgaaagtctctcctggcaaaaatttaatatagtgtctaataaaaatgaaagccacttgtgagttgtgagaaatataaacaaatcaactttttagagaaatatttaaattgagtgtttcacctagtgatttaactcatgcttatctagagtaaaaggacttttttatgcaatgcagtgaacactggtagatggcactttcaaaacattaaagaaggctgtcataaaacgatataaaaagaattacagctggcaaacttaaaaaaaacaaagattggtaaatacagctcaaatatgggaggactagaaagcaggtcaccagcttccgaaaagcagtgtgtggtcagtattttcttccagggatgtggggtccagcttcttactcaagctgtcagcagggcaggtgggcagatgtggggggactcaagagccaaagacagcacattccccaggctccccatttttgggcaagcctcaccagactgaaggagatcttgctgagtcttcttctgagtcctaaacaactaatcacactaaacgtactctgtttatgcacaggcttcaaattaactcattataaaaagttgaggaaattctgaagtaacactcaacctattttattgcttgttgtacgcttaaataaaaaatgtctgggttggccgggcgtggtggtgcatgcctgtaatcccagcactttgggaggccgaagcgagtggattacctgaggtcaggagttcaagaccagcctggccaacatggtgaaaccccgtctctactaaaaatacaaaaattagctgggcgtggtggcatgtgcctgtaatcccagctgcttgggagaccgaggcaggagactcacttgaaaccctggaggcggaggttgcagtgagctgagatcacgccactgcagtccagcctggcaacagagcaagaatctgtttcaaaaaacaaacaaacaaacaaaaaaactgggaatttttcctttcaacatttgtatgtagttaattcagcaaatgtttattaagcacatactacatgctggctgctgctctaggggccgagggtaaaacaaaataacaaaatagttgaaaacctcaccctctcagggcttataggtggagggtgagcatttacaataaaatatgtaggtaaaatatgtagtatgcctggggagttaagtgctacagaagaaaaaatgtcagaggagcatggggagctctgtggtggtgttggtggggcctgttactgaaataggaatgatcaggaagatcgttgataagcgatctttgcacagagagttgaggggagccatgcaggcatcgggagaccttccaggtagtgggaattataactgtggagtccctgaggtggggtcacacttgggggactcctggccgagtaagaccactgttcctggagcaggaggagtcagggcgagagggactggatgaaggcagagaaccatgtccgtcggggtgagaagtttggtttttactctgagtgaaatgggaagccacgggaaggtttgttgcagaggtggggcatgagccgatgcatgttttgaaaggaccactccagcctcgatgttagaaatggactgtaggagatttagagccacaggcagggggatagtcaggtggctgttgcagtgacccaggtgaaagacgatggcagaggtgctgattaggggacctaagagctggcctcataacaggattgctgtcagctctccagcaaaccacgataaaattgtcttaaatggatactgaagttttctcagtgttatgtaagggtgaacaaaagcattatctagtagacagaataatggcccccacagacattcgtgttctaataacccctggaacctgtgaagaggtcaccttacgtggaagaggaggctctgcaggtgtggttatgcccaggctctcgaaagggaaagaccatcctgggtaatccgggcaagcccagtgttatcacgggggtccctgtgaggggcagacagaggcatcggagccagaggagggtgtgtgatgatggaagcagaggctcgagcaaggaacgtgggcagcttctagaagctggaaaaggcaagcaacgtctcccctccaccctccagaaaaacacagccttgcccacgctttcattaagacctattttttgacctccacaactataagataaaattgtgttaagccactaggtttctgataatttgctacagcaacaataggaaactatatatataggactgggaatatgtagaaatagaaatatactcacatgtgttcttagaaaactttgctagttgtattcacctgtagcaatattgtaagtctgtgcttgcttttggttcagactccctggccacccttccccatccaattgcactctcctagtctgtcctttataggaattctggagccattatttcaaatgataagcactttggaatcaatataatagagggaagaggttgagagtgactgcgtgtccagagagggaggctgctttgaggagatggcatgtgtgctgctactgaaagatgagcaggaccagcaggggcagaccaagtccaggacaaaggtcctggggtgagaattagcctggtctgttgaagagtatctactctttgcttcagtcttgtgagcaaaggacacagtggtagtagatgaagccaaagacatcagcgaagtccggctcatatagggtcttgtgggtgatagaggcgtttggacattgtcactgtggcgaaaagccatcagaaggtttggaaaaatagagtgacaggagcttactgacattttacacattgactgctgggtggggaatggttttcaagaagggaaagaatgaaagtggacttttcagcagtgtagttacgagcattcagagtaacctaaactagtgtggtagcaatggaaatgtagagatgtagacagatttcagatatatatggaaggtagaattgataggacttgctgatatggggcttgagggaagagagaaccatcaggaatacatctggtagtttggttcgagccactggctctaatataaggaagactggaggagttcaaagaaatgagtcaatgaataatgtgcttacgaaatcattaaacatttaggggttgaataatgttggctgtcagtcctggatatttgaaaatactgtgtgatgaatagcctcattgtagataatcagaatatgtgaaaacgcctattgttaaattggaaggagatttaaagatttgttttagaccataacttatttttaataaggacaactccaaatcacccctaaaaataaatgtgtgacttttgcacaaaaaatcccagagaagagtatttatattctgattcatctttttactacatttacaatcaggaaagtcataatctccaattttagcttcatagctaaaaagtacttctgttatttgtataaagggaaaaatgaataattttttaagttttctttttttctttttcttttttttgagatggagtctcactctgtcttccagactggagtgcagtggcgcgatctctgctcactgcaacctccatctactgggttcaagcgattctcctgcctcagtctcctgaatagttgggactacaggcgcctgccaccatgcctggctaattttttgtatttttagtagagacggggtgtcaccatgttagccaggatggtctcgatctcctgacctcgtgatccgcccacctcagcctcccaaagtgctggaattacaggcgtgagccactgcgcctggctgcggattcctttttaaatttacacataccagtttgattttcctcccaattaacctttgtagaactcggtaacttgattattttaggttaatgtttcaattccaagtttaaccctgaagaattctgatagatagatacagagaatttattaacatctgaatttattaacatttgaaaatatggtcactagatttcaaacgtttatcatatataaaatattttaaatggcagattaaatatctccctgtgattgaaacacagtgacatgtttcaaaataatatttaattatctttttaaaaatcattaattttggaaatctatgactgggatgaaaaatatgttttcaggctcatagtaaatcagtattaaacaagttgcctccctcattccctctctgtctctttctctctcctctcgtgaacacactccgtggcagatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggttttctccagtaagtatcattattttctggtaagcatgttcttgttttgttcactgtatcacttagtctgtattgtattgataggagtttccttttgtaattaacattcatttctttgctgtctggctctgaatttcaggagcaaaatatgtatgtagcatttacgtttttcccttttccttaaacctcattgtgaactatagtgtgttggttttgtgtttttgctgtaatttttttcattagtcatctcgaaatagtgggaatattgtaatagtctttagtttgtggttgattgagtcaggattatttgctgattatttaattcagtttgtaaaatggtataaatcattttcttaatttcattaattcataaatatttaaatgacactcatttaaaaacttttttatttacagtggtaatcaagttacactttcattttttaaaaaccctatgctgatgtacagtaaaaacatcaatcctgaggaattcatattctattttaaacattcttatgttttaaagacagctacataattttgtattctttgataatattttgtgtacttttgaaaaaatgctaaatgtagaatgtcttaattttacaagatagctgcagtgagataaaaatattgcagagaacattgcaggcaggtcagtctgttgcttacatgcatctgaaggtgtgatatatgcacaggctctttcttttctttcttttctttcttttctttcttttctttctttcctttctttcctttctttctcttctttcccttcattcccttctttcccttctttctcctctttctctctttctttctttcctttttttttttttttttgagacggagtctcactctgttgcccaggctggagtgcagtggtgcaatcttggctcactgcaacctccacctctgcacaggctctttctgagagcaatgcttgaagtcattcattctgaaacaccttctattattcttcttcttcactttctatgcaactgtttctatcccactatagttctagccagtagatacattatttattttattgacatcataaataaatatttatgtttttacatatgcaaagaggtaaaataccaatcaaatcaaaatatagtttgaaatggtgttagcatatttgatatattaatatgaatgtaatcaatatagatatatgatataagctgttaaattacatatattataaatacatgaacaattatataaatatattcaaattaatccaatttaaattgtgatttcttagttaaaattcataaaatcactatttctacagcatcacaatagtacttagttccactggacaatgttacttcatgaaagtagcacaactaacaggatgcatgtttttgcacatcatatacattttagtatctaaatgtaaaatactctaacattttttggagagtgaagcagtgttaaagtcctcaaattataaactatgggatttgccagagacaactgaatagagagccctgcatcagcctgctgtaggaccgtcagttatgcagaaggttaagagaggcagtgtcctgggtaggaggcccatggaagggcctgggagtgacgagaagcccagcacgtgctgaacaaggacagactttatctggaatgaatgatgtgcattatttatgaaatatgggtgaattaattttgtaaacggtttgactgtaaagtgacaatatgtctactttatactcttgtcatgtagcatgtaaaacaactttgaggtattataaatttggattaaattaagttgtgccagcagctgagtccatttcactgatggagaagggcttcccacagagatcagcacagcctttccggccatcactgcagctgcccatcccctgccctttctagtgagatatggtcattgagcatggcatttgcttcagttaggaacctgttgctaattggtagcgagtattcaggattctttagtgctgtctttaacaaaataagaaaaactaccactaacatttatggaatcaaaaggcaagatacccaaagtcactaagctacagaaaatgccaggccttaattggaagatgctggttagactttgggtcattattctcaatgtggaatgacataaatgacgtaattaccttaggtgcatgagtttgatttcttacttttgtaattatcctatatgttttgaaacagtaaattgtaaattaacgtatgctttaattcttactgatttgaaagattttaaaatacaagatttcatgttttatttattttaaattttatttcaagaacaattaacacaagatctgccctcttaacagattttaattgtacaatacgatatcattaacaataggtacaatgttgtacagcagctctctggaacttactcatcctgcttgattgaaatgtgaagtccattgtttaatagcacccattctcacttcctcagctcctggtaaccaccattccactctttgttcaatgagtttgcctactgtagatacctcatataaatggaagcatgcaatatttgtccttttgtgcttatttcactttgcataatgtcctcaaggtttatccatgttgtctcacattgcagaatttttttcttgtttaaggttgaataatattctacggtattgatatacattttctttattcatttgttgtctgtagacatttaggtttttttccacatcttgattgactactataaatagtgctacaatgaacatgaaagtgcagatatctcttccagttcctgatttccattcttttggataaacaacaaactatctgaaaaggaaattaggaaaacaatgccattttcaataacatcaaaaagaatgcaatatctagaaataaacttaactaagaagattaaagacttatacagtgacaactataaaataactgatgaaaaaattaaagacacaaacaaatgagaagacctcccatgttcatcaattgcaagacttagtattaataaaatgtacattgtaccaaaagtgatctgtagattcagtgcaattcccatcaaaattccaatgttatattttttacagaaatagaaaacacaatccaaaaattcatgtggaaccacaaaagacctgaaacagccaaatcagtcttgagaaagaaaaacaacgctagaggcgtcatgcttcctgattttgaaatatatttcaaagctatcgtaatttaaacagtatggtactggcataaagaaaggcatatagaccactggaacagaatagagatcccagaaaaaaatccatgcatgtgtgatcaactggtctttgacaagggtgctaagagtatcaaattaggaaaagatagtctgttcaacagatggtgctgggaaaactggattttcacatgcaaaagaatgaatttggacccttatcttaaaccatacataaaaatgaatgcaaaatggattaaagatttaaacataaggcctaaaactgtaaaacttctagaagaaaacatttggggaaaagcttcatgacatggatcttggcaatgatttcttgaatatcaaaagcacaggcaaccaaagcaaaaatagacaaatgggactacattatactaaaaagcctctctgcagcaaagaaaataatcagcagagtgaaaaggcaacccatgaaatgggagaagatatttgcaaactatataactgataaggggttaatttccaaaatatataaggaactcctataactcaagagcaaaaagacaaataacctgattaaaaatggacaaaacatcagaacagacatttctccaaagaagacatacaatggccaaagtgttcagcatcactaattatcagggaaacgcaaatcaaaaccactataagctactacctcacacctgtcaagatggctattatcaaaaaacaaaagacaacaaatactggcgagggtgtggtgaaattggaaccctcgtgcactgttgataagaatgcaaaatggtgcagccactatggaaaacagtatggaaattcctttaaaaattaaaaatcaaacttccttatgatccaacaattccacttttaggtatttatccaaaagaatggaaaccaatttctttttattattttcatatataaaccaatgtattttcttgaacattaacatcccaaagaagtaatacgtctataaaagaacttttttgagccctttgatgctgaaatggtaaagttaaatagggctttgagcatttgtagagatctgcatagttttgaacttgtaacaactaccatataattatttacccaaactcagtgtaattgcttttctatcatgcattcagttgttagtcagaatatagggaaaaccataatttttcaaattaacaaagtttggcatggctttctctgctcagatcctcaacagtgtagcaatggcatctttattattttacatgtactgtcattgcaacacctcatcatactttaatgtttcactgtagaaaacagtaaaactaactacaaatgatatattcaaaaatgcccagataacattagacgagaaagccagtaaaacatcacaagatgaacgcataaggacaccaaagaatattaaaaatttaaaagagagaagactagagcaaaatgttgaccaagagaataaatctgaattcagataaggctgagcctggttttatctgcccagctggggttagaaagagcccaaattactagtatctcacaaatccaattctactcttagaattaaaacttgatgtaagataaattttcacaatttccaggaaagacatctgttgaatataatatttaggacattgtaacaactgatgctgagtataaagattctaaaatattccgttagccatcataatagttaaatcagtcaggaacacggttattaaatcagtgtagtagagtaccttattatgctttttccttattatattttcattctataaaaatactatgcaatattagtttagttatagtgttcatgagtatagaataatatacatgggtcatatctgtatgttaaaataagacatctttaatttttaatgatattgattttttagaagacctttagagttatcaacctttgtttgcatataaaatattttagtgcatttagtgaatgtaactttaggttatcatgaaggtaagatgaatgattctaagctaactatattaactctagtagttaaatcttgggggcacttttatttgggaaaaaagatataagtgatcaaggaagaatcataatactaaatgttatcattaagcttataattctataaaatacttcgttgataagtattgtttgttttaatttattgtggtaataagttacattgccctttttaggaggtcaggaaaccctggtagatctatccttaacaaggatttaaaattaattcattttggaaactagcaattaggaattctccattaaggactttcccattaagaatctttcatttagcaagaaagtaaacccttgctagacagcctttgtagatatttccttagataaatgttttgtcattaaacaattagtgattattcataggaagctgggaaaatgttattagatggcattttagtgacatttatttcagccttatattaacataatcatttgaaaaggatttttaaaacttaggaaagaatgcagatatgcaagtgaccacaggctgtctgtgaatgcacagtggtcatggagggttattaaaatatcacccttgtagtggtattttctgaaatcccatttgcattttatagactctcaacactgtaaaataggctttgtgtttgatgattttgcccaactgtaggttgatgtaagggttctgagcatatttaaggtgggctaaaccaagctatgcattagatgggtgaggtgtattaaatgcattttcagctctcttcataaatcaaaaagcatctatattgtttaactgctgtgttttgtcattaagcagttagtgatcattcattggaaatttgttacacagaaatagaaaactagtacaatgttactacactatgtgaagtgtttaatttctcttgctggatattgacaaaaacaaagcaaagagaaaaactctaaaattacctaaataaacgtacctgatgacccatactcttgaccatttattaacagagaaatggttagcttttaatcttttattactggatattgatatatattttaaataactagggaagcagcaataagataacatttagcctaatctaatcatgtatgttttaaccacttcctactgggaaattatttgtttatgaagtaaattattcttttttgaaatattttgaaatgaaattattttttcattttaacagcaaaaatgttctttgatgcattaatatgagtgatcattttagctcatcataattgaggaaatcagtgtatatattgatgtagtatttattgtgaaaaaagattgtgtttaaaagactgtcttttttatttttgtgacttaccatttagtatataatagatttcacggctgggcgcggtggctcattcctgtaatcccagcactttgggagactgaggcgggcaaatcacaaggtcaggagatcaagaccatcctggttaacacagtgaaaccctgtctctactaaaaatacaaaacattagccgggcgtggtggcgggcgcctgtagtcccagctactcgggaggctgaagcaagagaatgcggtgaacccgggaggcggagcttgcagtgagccgagatcatgccattgcactccagcctgggcgacagagcaagaccccgtctcaaaaaataaaaaataaatagatttcacaatccattcatgcctgctaactcagtttatcctcataatgatcccatgagtttgagattgacaggcatcagctttatgtatcgttatttcagtgatttcaaagctaagtgtatcctagcagatatcaggatccatgaagatcaggaaaaccaactcagaaggtggtacgatgaaggcagtacacagacttgttgtccttgaaccatgtccgaaaaaagtccttttggggtttcatgggacccaataaatacaaatttttccccatccaaattcaaacccaactgaaaggaacaaaaagaaatctggtagggatagcttaaaataccatctgtattactgataaaaagctgattggagggtactggcttggatttggccaaacgtcttgcaccccagaattagaaagatgacccatcaagtcacaggcagcatggaaaattgccgatgcctgctgcgaggcaaggacttgatattgtgacattcttcctggtgggattgcctatacccacagcagaccagaaatccgtgggtaagtagatccctggggaaggaggagaggagccagaagcctgtgcttctcctaactttccagccacacacatcactctcctgcggtgcagagaagggcagagtgtttctctcaggaaaggtccctcctgcatccaccacttaagtaatctcatgttgatttttcagtctgccagagtgaggatataagtcagaaaccggggagagggggtagaaaagtggagaggagagcttgaccccccctttcaccatagagaccaagtgattaatcattattcccacttacctgcacatcacttctggctgtttcaaagttctgcctgtgggaattgggaagacgaaatgccttcactgtatttatctgattttacttattattgaaaatccatgagtggatccattcctattgcactgaaaaacaaaagaaacaccagcttcttgaccgcaggctgggcacagttacctctgcagtcttgttctaaactgccctcctgttgctcattggctttcaatcctgcagacagttctctcttgcttcagtgttttggtatatgctcttctctctatctagagcatccactccaacccaggcacacacgtacagtcacatcattatggtttggatctgtgtccccacccaatctcctgttgaattgtaatacctagtgttgaggtgcagcctggtgggaggtgattggatcatgggggcaggtccttcatgaatggcttggcaccatccccttggtgctgttgtcctgatagagttatcatgagatctggttggttgagtgtgtagcatctcccctctctctcttgctcctgctcctaccatgtaagacgtgcttgctagggctttgccttccaccatgattataagtttcttgaggcctccccagaagccaagcagaaaccactatgcttcctgtgcagcctgtagaaccatgagccagttaaacctcttctttgtgattgacccagtctttggcatttcgttgtagcaatgcgagaatggactaatacagggtctcagctcaaaatgatactttcttgctgaggttatcttgatcacctctggtctaagacaggatcctcctacattctcttttgtaagactcggacttatttttcccagcatagcacaccacaattttctggttgttaaatgtctgctaaccccgtaggatcatgtcagttgagcctggtagcataaaacttatgctctgtaagtatttcttgagttgataaataagagattaaatgaccaagggatgtattctttttatttcaatatagttgttgttatatgattttagcaaatgagtatagaaagaggcaaagtaacctagaaaaagcacagatgcttaaaaattagtagaagaataactgaacccctcaaaggcaaattagacaggatgtgaaagcatgggcatgatatgagggagtgagaagagaggctccagttaacttgggaaggctcttagaaatggatactgctaagctgcttcccaagagaggctggtggattgggtctggggaggggctccagctaagtccgtgttgcagagcaggtttggtttgcagacactgcaaactttagggtcatctaaagtttaaattacactcagggaatacagcatgagtagcaggagtccttgactcggatttcacattctttcccatattatctcctttgtaatgttttttgctgacagtgttgatgtgatatagatagaggcattccatttcttaactggtgaaagggaagcaaaaggagtatgcctgaatgaaatcatacaacacacggaaactttctgtacggagctgtcagttttattaccctatctctgcagtggtctcactggcaaagtacccatatctttgcagtggtttcactggcaaataattagggttgcaatttataggattaattaatttaagaaaagacaacagggggcgtggtgactcatgcctgtaataccagctctttgggaggacaaggcaggcagatcacttgaggccaagaactcagaccagcctggcctacatggcaaaaccccatctctactaaaaatataaaaatataaaaattagctgggcgtggtggcacgtgcctgtgatctcagctacttgggtggctgaggcaggagaatcacttgaacccagaaagtaggggttgcagtgagcccagatggctccacagcactccagcctgggtgacagagtgagactccgtttcaaaaataaataagaaaagatgacaatgtaaactactaaaattatattgtatctgtccttgatcatttactgaacttaaagagatcaaatttatccaaaaccaaaatgacttctactaaaatgctttctgggagcgtgttatgaacacactttacaaatatattttataaataacatcagattggacagattttatttttttaaaaaacttactgtgatagttatttgaacaaaagactgtctatcatatttttagtgactagtgctatagtgtatcttaagatatctttgttccccattccactttgcttgccttcatcgagaggctggcaggtgcccctaaggcagctgcatgcagccacctgtaggctaccgaggctcagcctaggggtggttttgctctgctccctggggctggcttctgtgtgcttcctaaggaagggcagtgtggcctcagctgcaggaaggcctctaacaaacttggccatgaaaggaactctctgaaactgacccagttgttccatagatagttttttggataaacagaaattgacccttctggtcttaaagcttgaaacttacatttgttttatctgagttcctttctcaggaaagggccttcagacctctcaaagtatcaaagaactgaaacttaccaggtcaccacatccagacaataaaatgcctgaccccacgttcatcatggttgcttccttgtcccatcctagttcctgttttcctacacattgttaaatttcttccctgctataaaaacccctagttttagttgatcagagagattaatttgagactgagctcccatctcccagactgcagcacccaattaaagccttcttccttgtcacttcagtcattggctttctgtgcagcaaacagcaggacctaaaccaaacccctgctgtttcagtaacatctccccagggaaagcaatatgtgggaaggaagagcagtgcagtattatctggcacataaacaaaggaagacacatcaacttctttgctctgcctatttgacattcttggtggctccatttagaaacattttaccactggtcttccaactgcctttctctgcactgtgctggtggcagagatgtgtctggtgcccagaccaaccctatcccctgctgttctcctccatccctgccttaatgatgcccggctcacactgccatttgattttcagcagtgtgatattgatgccttaaaccacctgcatctccatcccatttgtttttcaaatgaatggaactatgattaaaagaaaaatacaacgctgtagcatttttaaccagtaccctggcattttctcaaattatttatgtctttctaaaaggtattatatcagtgctttccagtccaaaaatcattagaagacaagatattattaggactgagtttggaggaggaagataaacctaaagctattccaagtacagaggaatttcattatcatggacatcagtgatacaaatcccattattatcggtgtctaaagatacaaatagcactatagttttaatttttatcccagggatatgccttcaattttctcttttattataatttttatgagtgatttaaccatattacagcaattgggaaataaagaaggcaacagcacacttggtctcctaagcttcaggctcttgctgcaaggagggacgttcatcagcctgaactggaactgcagctcactttcctgtcacagggaatattcttataacaaaattaatgggctccagatgcagatctattcactttcttcccatttctaccaataatatgaaactgttaatgtcttctggtaacatagtttttttctcacaaatgctaataaagataatatcttgaaattacaaaccaactaatcttatttacttgattaggttttatttagaaaagcctactttgagatactgtaaaaatagtgaaaagaatattagcttaggattcagactgggtaagggtctcggttttaattaggattatgttcaatctgtgattctcccatagcacacacacactcagagaacaagaaccattagtgattacttattttaattaaatgctcagtttaagcctggcacaaaattatgaaatcctttggcgaaagttattctttatttctatttttagtataacatgaaaaagtacctgctaccctgttaaacttctcattataaaaataatgtgaaaagttacactcagacaaaaaccaccaccccattggtacaatatggaaatagggatcccagcatggatgatttagtaggtgttaatagagtaagctgagagttaaaaaaaaaaaaactaaaacaaagacatattttgtggatagtagccatcatcatatagcaataagatgtaggctatacataacggccaaatgtggaagaccaatttgagatgttcagtagcttacaagactatgtgcacaaaatgtgaaataacagaatttcaaagatgacagtactcagaaaacgagatatgtaaaagaggataattatctaccttttcttagcaatgaaacatattagaatcttgaacatgtttctccagagtaatctctccatgacagaattatcatggacattccactaaatacctaaaactctctcaagatgcacccttccagcttgacctagtgcaaatctcacgtcttctgagaggcattctccaaattctccaatactctttattcaagtcccattcagaacccctgaatttgtctatactacgggtgtatctatttatgtcagaggaattcaggggccaatagaacactatacttttttgaatcctgagccatatcacagtgccatatgtataatttggtacccaataaatattttatgattcaaaaaaagtgtaaatatgaaagataactttcacaggtgtatgtgtatatgaagttagcaatgaccaagaaggaatgacacaaatttattactagattgataacaaaaaattactgaagggtttgcagacaggttgatggagccaatataactgtaaaaatttattagtctattattttgttaacagaatatgatatttaatggaccatgatattccctcacaaatttttccatctctttgcaaatgcacttgagtaaactgttgtataaaatatgtattttcttaaagttgttgctttccaaaatttgctgagaggtatatatacattgttgtctaacattgacttttctttgtatgtaaaatgtccaggttagtagcaaaagcatcagtacagttgatgatacaactgtaatatagttctctgttgttaattacataaaatgatgtggactaattgattgattgtacacttacgccagtcatcctgacagtcttaatttaatcttaaagtatattctgtttgatcatctggtctgggttccaccacactgttcataatatattgagaagcacattcagctatgtggaaatgtgtttttaattcctgggtagtcataaatgacaattataatgatgagcatgatgataatgatgatgataacctttgtgtggtgtgttagaatgtgggaagtaccaccactccgggtatataaatactctttacaatgtctccttttccaaattaagagactactgttccaaatatttcatatgaggagaggttctaatttgatttttatcctcaaatagtttcctgaacacagtttattgaataactatgtttcctattagttattatgcatttgttatcatactataagctcttatgaatagagactgtttcagagctacatgttgtatctacctttctgttgcctcttttgctagtgttttagaacccaacatttccaattataataaatttatcattgttttcatatatatatgccagtcccccgattaatttttgcctttacagtctattatgaaaattttcaaatgcatattttaaaaacacgaattcttcatgaagttgtgtgtcatccttataaggcgccacgtcaatcttttctgattttccagttgtatcatctgtactgctaaatgaacataacatctgagaattcctgagtcttttctgtcccgtgattctcttcttgtgtctggagttgttgtcctatggtagctgctctcctgcatcttttaatcagctctactttacaagacatgaaagtaggcttgtctatttttattatttttactagcatctagtatactgctaccatgtaataggtactcaacaaatacaggtacacttcaactgaaatgtcagaaattaaatgcttttactgagatcgcacaaccagaaaatgagagttaggatttatatccattccatttgattcaaaaatcaaccctactcaatggccctatatgagatgtcataaatggtggtagtgagaataagtagctgatgagtatacttccctaacatgatacaaaatatttacaacaaaccagcagccaagaacatactaccagaagcccacaggcattcccactgaagccaagaacaagaaaagtatgtctgatatcactactgtaatttggcatttttctgaaagtttgacaaatgcaacaacagagttaaataaggaatagaagtagattaatggaagatgatttgagaaaaaaacttgcaagtaattttagtgttaccttatgcaacccagagaattaaaggaaaactattgaaacaaataaaaagtttataatatatgtatttagtaagaaaacatgttagtgttcattatacatctatattttggtctcaactagctagaaaatgggctagaagaaaaatcacacatcatactggaagatatatgtaagttctttataaaactacaataattcaacccttatggcatataaacaccaaatataccactggaacataaagagatttcagaaagagttggtggggatataaactggtacattcagtagagttacaatttgttcacttttctgaagatgttatgcttcactaacataaatgtaaaataaactgtaacactaaaattatttaagttgtttattaaggtagtaatgataaatattaaattcataaacttaaaaaataaaatttgttgggaaagggtagtaaactcaacatattgttaatttaaaaatcaatatcagagagtgaccaatatttctgcacacactcaaatataactgctgattgaacagagattggacatgccatacttacttgtgttcatttccttccatgacaggtattgtgctgcttttattgtattaatacaaatagaccaaggcatttgaatgatggttgatagggacaaccttactttgttgaaataagtatatccatttgagtataggaaaaactcaggaaaattattgttttttgatattgagaattctatggtgggaaaattatgagccaaaataacaatataaatatatatattatttagtataaatatatattattttggctcataattttcccaccatagaattctcaataccaaaaagcatagttttttttaacaaatactacatatataatatttatatgctatatatttttatgggttgtttttttttcttgagatggagtcttgatctgtcgcccaggctggagtgcagtggcacgatctcagctcactgcaagctctgcctcctgggttcacgccattctcttgcctcagcctcccgagtagctgggactacaggtgcctgccacctcgcctggctaactttttgtatttttagtagagatggggtttcatcgtgttagccaggatggtctcgatctcctgacctcctgatatgcctgccttggcctcccaaagtgctgggattacaggcgtgagccaccacgcccggccataggttttttattagctttttatcctaaatgatttgggatcatttctagaattacttttaatgtctaaatagaggtattcatatttatcagaaaacaagttttccagcaagtgggatttcaggggattttgtttatttatagctgcggtagtattaaaggaatttttcttcctctagaagaggaggatattttttaggtttattttattttgcatagcagggtgactatagtaataacatattgtatattttaaaatagctgagaggattttaaatgttctcacaacaaagaaataaatattttagataatggatatgttcattaatctgatttgatcattttataatgtatacatgatgtatcaccatatccctttaaaccccataaacatacacaattattattttttttttttgagatggagtctggctctgtctgataactaacttttactgaaactaggtttacatttcttttccttttttttttttttttttttttgagacggagtctcgctctgtcgcccaggctggatggagtgcagtggcgccatctcggctcactgcaagctccgccttctgggttcacgccattctcctgcctcagcctcccaagtagtgggactgcaaggtgcctgccaccacgcccggtcaattttttttttctgtatttttagtagagacatggtttcaccatgttagccaggatggtccggatctcctgacctcgtgatctgcccacctcggcctcccaaagtgctgcaattacagggctgagctaccgcgccaggccaatatttaccaattaaaaataaaagaatatggctgggcgcagtggctcacgtctgtaatcccagcactttgggaggccgaggcaggcagatcacctgaggtcgggagtttgagaccagcctgatcaacatggagaaacccgtctctactaaaaatacagaattagccgggcgtgtggtgcatgcctgtaatcccagctacttgagaggttaaggcaggagaattgcctgagccagggaggaggaggttgcgatgagccgaaatcgcaccattgcgctccagcctgggcaacgagcgaaactccatcccaaaataaataagtaaataaacaaaaaaataaatacaagaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctcacaatttagatgatcaactccaccaatctttaccctttcttatgcttaaccaacaagaaaattcatgtccagtcttctgaatgattcagaataaacaaaaggtcaaaatctcacaaaatattgaaattgctatggaaaggggagtgagttagtctctttgtgagtattagaagatagataagccaaatcaatcactgactattttcagaatccatctttatagaaaatatgctttaaccttcccgctaaatcctaggaattccctgtctgcatatatgagcaaccaggatcactgtaacattgagaggaaattttataaaaatcgtatcattgaaggagaaaattatgttattcatctacagcaatgttttaggatgtgtcagatttaaaatgtgtaagcattcatgcatgcaatcattattccttttacaaggaaaagaattttataaactgcaacttaggtctgatgcctaaaattgttactaacatcctagcaagaaatgaaagtttagaaaactaccagaagtgactaaaaacacgaaaccctgaagtaagaaaagaatagttgttaggataattaaagataaagaaaatgggtttgatataattatatgttacctaggaattgttggtgtgaagttatgaaagcacaagttaaaagtttttttgaattaggactatataacacaaactaaaatgcagagtcacttactatacactatttatcatcttaggcctgtgaattctgaagcaatgccaattattaacctattaattttaaaaaatatatactgagcacctaatataagcactgtgctgtctatggtggatcttagagctgccagggccattcagtcattgaacacagttttcttaggttctatgatgtataaggcacagtgctaagcgctacaaatacaaatactatttacaaagcccattgtggaatagaagtttacatacatgtggcacaatgtggtgaggcttatatgagagataggctcaaacctttgtagggatcctatgagggactcaaaatggtttaaggaggttaggaaaggctgcacacaggacttagatgatttgaggatgctgtatacagaaaacaagaggttgctgagtgagaagtttcctgtggctaaaagagttcaacaaaggacaggggaacctgtggaaatagtcagggaccagatgtaagaactatgtatgccctagtacccattcatatattatcctgtgcactgactgaaagccatcggagacttttaaagagggaaataacttgttcgattagttttcagggaaatgatttagggagcactaaggagggattgctgaagtggaaggtgataagtttgagtatctatcatgtattaagtgttgttaaattaagtttagcctaaatctgcctccttgtagttttggcctagatgtttccccatgtatcagatttttggatactctttcttatgaagggccgtcgattgtctatctgttgtcttatatttttgaaggagtatgctatatattcagaatgctagtcttaggtacacgtattgcaacatcttcttccactctgtggattgtctcattactctattaaatgtgtcctttgacaaagtgatgttcttaaaatggttttctgtgccctctttaagaaatgtttgccttcttcacagacatgcagatgttctttgtccttttctaaaagtttgttttatttttacatttctatgtgcaatccatattgaattaatttttatgtatgatgtgagagagattatgattcatttatttccatataggtatctaattcaatcagcacttttttttacaaaaatgttctttccccccttctgattaagaagagcatttcttggccaggcgcagtggctcatgcctgtaattctagcacttagggaggctgaggtgggcagatcacttgagaccaggagtttgagaccaccctggccaacatggtgaaaccctgtctctactaaaaatacaaaaaattagccaggcgtagatggcgtgtgcctgtagtctcagctactcaggaagctgaggcataagactcgcttgaacccaggaggtggaggctgcagtgggctgagatcatgccactgcactccagcctgggtgacagagcaacagtctgtttctaaataaatagaaagaaaagcatttcttatactttgaaacttccatgggcattttttatattattatctcttttttaaaaggtatatgttcttcctattttttatgactaactccttattcagaatgggcttctcaacatttcgggggcccagaataagagtacaaataggctgggcacagtggctcacgcctgtaatcccagcactttgggaggccaaggtgggcagatcacgaggtcaggagatcgagaccatcctggctaacacggtgaaaccctgtctctattaaaaatacaaaaaactagcggggtgtggtggcgggcgcctgtagttccagctactctggaggctgaggcaggagaatggcatgaacctggaaggcggagcttgcagtgagctgagatcatgccactgactccagcctgggcgacagagtcagactctgtcacaaaaaaaaaaaaaaaaaaaaaagagtacaaatagaggcccatattttatgcccctacattctccacctatagatgaaataatttaaagcattcagactaataatgactaataaattaggttgatatttgaaaaattaattttacattattacttttgttccctgccaatgactttaaattatcacaaatgcattaagttaaaaagaataaaattttaaagattagttcaacagtgaaaatgtatatattagattctattattttaaagaaattacttgttaatagaaaaatagtcacgtttcagataataggaaaaacatagaaatttccatttttggtctttagagcattgacatagcttatggttttgcctcacatattttgttgccacttaaagataggaggggctgggcgtggtggctcatgcctgtaatcccagccagcactttgggaggctgaggagggcagatcatgaggtcaggagtttgagaccagcctgaccaacatggtgaaaccccgtctctactaaaaatacaaaaattagccaggtgtggtggtgcgtgcctgtaatcccagctactcgggaggctgaggcaagagaatcgcttgaacccgggaggtggaggttgcagtgagctgagatcacgccattgcatgccagcctgggcaacaaagcaagactccatctcaaaaaaaaagataagagggagattcaatcaaaggtgttgtggatctaacttttgtttaggtcaggcatgtatgtgtcatgctggtatctaataggacattttagtggtttccattttctatgtatgtgactggaacagtaggaagcctgcacgatggtaacagatcctgctgtttctgagtcagtctatacagattgaagtagcttcaatcaggtaattttcaattgtatttgattttgttgtaattacaaaacccgaaaaccccaatattttctgaggttttactccaacatatgtgttagttgaagagccactctaataaggtgaaactacaggctcctcccattccacactgttctctacattatagtatacacatctactacagttcttattattctttctttctcctgccgaagtatgaatgcctccagatggggatctagtctaatacagtagaattcaacaagcatttatgatgttccaggcacagcgctagacacgcataatacagagaggagggggcaagtgctggtggaatgggcccccagcacagagcacaatatgtgaaatgtttggaaaaattagatctcatttatctttacttctagcccagagtgagcctacactacatgggcaaatgcatcagaatggaaatctcccaccaaccccaaattccaaccccaaacagggcacacatacacacacacacacaccccacaccagtgcaagcactgctaactagcgagtacattttttcctactaagccaggcacaggccatagaaaattctcacacaacactcaaggttttcaaccctagctacacaatagaattacctggaagcttcataaattcccaatgcccagatcatacaatagagtaatttcatctcaacctccgagagtagggcccaggtgtctgattcttacagctctccaggtgcttccaacgtgcagtcaaggttctgaaccattgctatgctcttgccagtgagcacggtccctggagcagtagcagcacccactacgagctcatgagaaatgtacaatctcagttcccaccccagatccactgaatcagtgtctgcacttcaactagatcccagctggtgtaaatactcatggaagtttgacaagaacctcagcaccttccaccacctcatcctcagtgagtgagtgttggtaggttgaatggtgattccccaaggatgtccacatcctaacacccaaagtccacatcctaacacccaaatgttaccttccatggccgaagggactttgcagatgtgattacattaagggtcctgaaattgaaacattattttgtattattcatcactttcaccagctgattaaagggccaggcttcactgtaaaattatgagtttcccacttataattatttcgtgaggaggtagtttgaaactacttaagtgtcttgttcttcatgcacctttcaatttattcattaatttatgcacatccacttggactcataatttccaattttatccaatgggctctcatagtcttttactgacatttattttgatgctcaaactttctctgatttggcttgtgggagcccttctgagcaggcttttctgtcatttcactgtccataacactctttgagcccttcctttctgacacaagatcttccatgctcacctcgtcctttccttactccagccctggaattagctgtttctccaaggagctcttgctccttttagtggagaatgagtccagagccagatatgctcactgctcttgtgattctgctcccaggccctctgagaggacatgtcatacacacacacacacacacacacacacacccctacatacatcaacatttatttctgtgcctatctatatatgtatagaaaatggtgagttcagacaaatttcaatttctgttcaatatcacagggtttaacctggttttctccctttctatgtttgtaccttccttcccctacaatgaggagcttggctcccattgttcattcatttacttattcagtcaatcccattcatgtttccattctcctacctctgccacaccctctccttcaggcagatgcccttcctgttccacttgtgctccaacaccccgcactgggggatttcagtgctgggcagtgggggttctactcacccagtgattacagtgactataaacatcaaactattactacaagacattatcaatttgcatttttaaaaagatcgtctattatgctgcttataagagacagttaaaagaaaataactgaaacagtttgcaaataaaagaaaaagcatataccaaatcaatactgactaaatgaaagctgatatgaaaaaaaattaaaatcacttataatgtcaccaagagacataaaataattatgcaaaaaccaagaaaaatatatctgtatgtattataactgtataatatctgtaggctgagagcaaaaaaaaaacactgatgaaagacatcttaaattaaataaatggaaaaatagacagtgttcatgcactggaatacttgatattaagatgtcaattcttcccaagctgacacttgtgttcaacacaatgccaattgaaatcccagcacaaatgtttgtagaatcaacaagcttatttaaaaacttatatttaaaggcaaaggaactagaataaggtgaaataagtggaaaaggacaaatatttcagattccacttacacgaggtgcctagagtagtcaaattcatagagacagaaagtagaatgttggttaccaggggctgggggcaggaggaaatgcaaagtgttcagtgggtaccgagttgcagtttaggaagatgaaaagagttctggaaggggtgatggttgtacaacaaaaaagaaaactgagctgtcaacaaaaaggaaaacaaggagggttcagcaagtcaatttgaggatatttttccttttatatgtgggaagctgtcccggaatgaggcagctggcaaattttaggacaatgaatcatgtcagtttttctttttatcttcacagtgcattgtttttctacctgcttgtcttatttttagaataatgtagaaaaagaaaatggaggctctttttcctaattttggcatgaatcccccttgttccaaatgaagatggcatcatgaggcagctcaaagaggagagcttaggtaatgcacaatgtgttggctgcctgtccacatctgtcctgcattgatgtggtaggtgagcaatctttttgtgaaaatcatgtttgtgaccataatcatttggatgaattcttttaaagaaattaaaatcccagaaagaaaaaaattcattatacacctattaagaatgggaaaaaaaaaaaaaacaaaaacctggcagtaccaagtgctgacaagaatgcggaacaactataactctcctatattgcttatgggaatgcaaaatggtgtggcctctttggaaaacaacattttgacagttcttgttcttaaaaagttaaccttagacccgccatacaaactgtatgtaaaagtctgtagcagcttttctcataattgtcaacaaacaactcaaatgtccttgaatggacaaaccgtttggcacacaaccaatggaatacaactcacccatagaaagaaacaagctactgacatccacgtggatggacatcagatgtagtattttagtgaaagaagcctatctggaaaggctacatactgcatcaccatctatgttatgtcctggaataggcaaagcttcagggacagaaatgagatcagtggctaccaaggaatgggcatggtgaacaagaaaggagcctgcagaggggcacgggacattagtattgttatttattattattcgagacaaggtctcactccaatgccaaggctaaagtacagtggctcaatcacagctcacttcagcctcttcctcctgggctcaagggatcctccccgctcagcctccagagtacctgagactacaggcacccaccaacacacccaactaatttttgtattttttgtagagatgggattttgccatgttgcccaggctggtcttcaactcctgggctgaagctgtccgcccacctagacctcccaaaatgagccacagcacccggccacagggcattattttatggtggtagagctgtcctgtatcttgatgagttgtacaactatatgagcttgtgaaaattcacagaaatatttactttcagggacattttatttagtgaactttatttcatgaaattgtatttagggtaaatcttattgtttgtaaattacacctgaatttgtccgacttgtaaaaaactaaacaaaaagctaggcatcttctttttatttcaagcatttatttggtgatttgttgtttgcagaagtttatagatttattttttatttaaataacagaatcttgcaagtgaaaggaaacaggtcatcttatgtcaattcctactttttttctttttaaaaaatattttaacttttattttaggttcaggaatacatgtgtaggtttgttatataggtaaactcatgacttgggcatttggtttacagattatttcgtcacccaggtactaagcacagtacctgatagttttttgtttgcttgtttgttttttgaacctctccctcctcccaccctccaccctcaattaggtcccagggtctgttgttcccctctatgtttccatgtgttctcattatttagctcccacttataagtgagagcatgcagtatttgttcttctgttcctgtgttagtatgctaaagataattggcctccagttccatccatgttcctgcaaaggacatgatctcattccttcttatggctgcatagtattccatagtgtatatgtaccacattttccttatccagtctactgtttctttatttgtttgtttgagacagggtcctgccctgtcacccaggctggagtgcagtggcacgatcttggctcactgcaacctccacctcccgagttcaagcgattctccagcctcagcccccgagtagctgggactacaggcatgcgccaccacacccaactaatttttgtatttttagtagagatgggttttcaccatgttggccaggctggtcttgaactcctaacctcagatgatccacctgcgttggcctcccaaagtgctgggattacaggaactgtaatcccagtgtgagccaccatgcccagcctatctagtctactgttgatggacatttaagttgattccatgtctttgctattgtgaatagtgctgcaatgaacacaacgcatgcatgtgtctttatagtagaacaatttttattctttgggtatatatccagtaatgggaggattgctgggctgaatgttagttctgtttttagttccttgtggagttgccacactgctttccacaatgcttgaactaatttacactctcaccagcagcatataagtgtttgctatttctctgcaacctcaccagcatctattatttttcactttttaataatacccattctgactggtgtgagattgtagctcattgtggttttgatttccatttagtaacactgaacattttttcatgtgctttttgaccacatgtgtgttttcttttgaaaagtgttcatgtcctttccccactttttaatgaggttgtttgttcttcatttgtatgtttaagttccttgtagattctggatattagactcttgtcagatgtaaagtttgcaaatattttctcccattctgtcagctgcctgtttactctgttgatagttccttctgctgctcaaaagctctttagtttaatgaggcctcatttgtcaattttggcttctgttgcagttgattttgctgttttcatcatgaaatttttgctggttcctatatcctaaatggtatttcctagcttatcctccaaggtttttatagttttaggttttacttttagttctttaatccatcttgagttgattttttttatatggtgtaaggaaggggtccagtttcactcttctgcatatggctagccagctctcagcaccatttattgaataggcagttatttcccctttgcttgttcttgtcagctttgtcaaagatcagatggctgcaggtgtgtggccttatttctgggctctctattctgttcttttggtctgtgtctgtttttgtaccagtactgtgctcttttggttactgtagccttgtagtacagtttgaagttgggcaatgtgataactccagccttgctccttttgcttaggattgtcttggctaattcgggctcttttctttttgttccatatgaaccttagaatagttttcctaattctgtgaagaatgtcattggtagtttgataggaataacatcgaatctgtaaattgctttgggcagtatggccattttaatgatattgattcttcctatccatgagcatggaatattttccatttgtttgtgtcatctctgatgtctttgagcagtgtttcgtaattctcattgtagggatctttcaccccttggttagctgtattcctaggtgttttattctttttgtggcaattgtgaatggcactgcacttctgatttggccctcagcttaggggtgctgttaatgtatagggatgctactgatttttgtacattgattttgtatcccaaaacttagttgaaattgcttatcatctcaaggagcttttgggcagagactatgggttattctcaatatagaatcatgtcatctgcatacaggattactttgacttcctctcctcctatttggataccttttctttctttctcttgcctgattgctctgaccaggacctctaacactgtgttgaataggagtggtaagagagggcctccttccttgtcttgtgccagttttcaaggggactgcttccagcttttaaccattcagtatgatattggctgtgggtttgtcatagaagtctcattattttaaagtatgttccttcaatacttagtttattgagagttttagcacgaaagggtgttgaattttattgaaagccttttctacatctattgagataatcatgtgctttttgtctttagttctgtttatgtaatgaatcatatttattgatgtgcatatgttaaagcaaccttgaattgcagggataaagcctacttcttcatggtggattagctttttgattttctgctggagtcgatttgctagtattttgttgaagatttttgcatctgtgttcatcaaggatatagaactgaagttttcttttttgttgtgtctctgccaggtttgagtgtcaggataatgctgcctgtttgaatgagctgggaatgagtccctctttctcttttttttttttttgagtagctttagtattttcctgcatgtttttcaaataaggaaagtaacagccagagaaagaaatgacaatgaacagtcagctttggcaatctgactatgtaaattagctaccacagaagctaggattaacattagggtttttttggtgatataacaaatagagtccagaaaactgccaccatatgtttacttgaacccagaaatttggcagcaaatttttggaacagaatttgtagtcttgaaattctgctttgtttaactctaggccataaaatctttaatggaaatgtttgctttaaaaagtggcttattatgcatacatgatcgatttttataatttactaatgttggtttaagtttataaactatattataaatgcctggctggatcccatgagaaaatcccaaacagcagttgtcaacctctttagactctgagccctttcttcaaacaaaatctcccagtgcatcacacgtataaaagagctcagaaggccaggcacggtggctcacacctgtaatcccaacattttgggaagctgaggtgggcagatcacctgaggtcaggagttcaggaccagcctggccaacatgacgaaaccccatctctactcaaaatacaaaaattagccaggcgaggtggcacactcctgtaatcccagctactctggaggctgaggtgggagaaacacttgagcccaggaggtggaggttgcagtgagccaagatttcactactgcactccagcctgggagacagagcgagattccataaagaaaaaaaaaaaaaaagctcagaaaagctcatctacccagtatgggaggtagctgcacctagcagtgtgtggggcttccacatgcacactgctaatgccaccactcccaaatgtcagttcgaatcgtagtttatggattgaaccacaaggcataatcacatatttaatttggttcttgttaatggagctttcaactgatgatgtctttgaaagtagaagtctattgcctagcaggtaatattcagttcagggtaacatatctctatcctagaaattcacctgtcacaacgtaaaatgtcccttattgctttgtttcatcctttggattgtcctgctttccttttttaaataatgctttctatttggggaagagcgggaagatcaaagctcaactggttgaattcagatgcttttaagacagtgggaggctgaagtgagcggatcatgaggtcaggagatcaagaccatcctggctaacacggtgaaaccctgtctctattaaaaatacaaaaaattagccaggcgtggtggcaggcacctgtagtcccagctactcgggaggctgaggcaggagaatggtgtgaacccaggaggcggagcttgcagtgagctgagatcacgtcactgcactccagcctgggcgacagtacaagactccatctcaaaaaaaagacagtcagaaggggaggacagttaggcaatcagatatatgggtatgaagctcagaacagactatttaaaataaaatacagataaaaatggattcttccatgtggatggctgctatcaaacagaaaataccaagtgttagggaggatgcagagaaattggaattcttgtgcactgttagaatataaaattgaataactaccatggtaaacagtatggcagttctcaaaaaattaacaatagaatttgcatatgatcgatcaattctgcttttggctctataccgaaagaattgaaaacagggcatcaaagagatattcgcacacccatgttcatagcagcagcatttacaatgcccaaaatgtggaagcaacccaagtatcaatcaatgggatgagtggatgagcaaaatatggtttgtacacacagtagaatattattcagccttaaaaaaacagaaatgtcatgatatgctataacgtgaaagatcctagaggacattatgctaagtgaaataagtcagccacaaaaagataaatatgatatgattccacttacataaggtacttagaataatcaaattcatagagacagaaacgctataagatttgaccttatagccatatacatatatttcaaattgtaccccaaaatgtgtacaattacaatgtctcaattacatattaaaactttaaaacaagaaagtagaacggtggttgccaggtggttgggtggaggggagaatggggagttagttgtttaatgggtatagtgtttaattgtgcaagatgaaagcagttctagagatgattggtggtgatggtcacacaacatcacaaaggtacttaatagcacagatctgtactcttaaaagtggttaagatggtaaaatgtatgtaacatattttaccatgatttttaaaatttggaaaaaaatggataagcctccaaactgaaatagtaatggaagccaattcatagcatgaacgcaggaaagggcctaagactgaacttgagggagccggtagtcaagggctgggtagggaggacgagcctgttaggagatgaagaatgtggttctgcaggtgggaggaaactaaacaagcacagcatcatggaaaccaaaggaggacagtgtttcaaggaggaaggggtccagtgccaaatgcccctgagaatgcaaagggcatgaattgggaaatgcccacaagttttaacagcacagcggtcattggtgacctccagaatcatgtcttccatccaatctggtaatctttcatgactgtaaactccttgagagcaggcaccttgaacagacctctatatcctcctgttttgcttttcacttaagaagtgttcaataaatatttactacagagtgaactcagatgatggtatttatggtattttggggcaggtgatggaactatactgtattctgattgtgttgatgattagacaaatctatatatgtgttaaaactcatagacctgtacacctcaaaacaattaattttattgtaccttaatttaattttttttaaaaaaatggattctttttcttacatggtgatgggctcttgagtattataaaatgactcttgaaattttatatatgttttctaaagagctctttgtatttatacaagatttaatgacattgaatattcaattaaagatgcaaagttttaaatacactaggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgtgtgtaacaaaagatggactgcgcttggaaggggaatcagaatttttattcccattgtatgccaaagaaatacactccagagtggtaagaaaatgttaagacaaataatttgtgctttatgaaaaataaatcatgtttaagcacaaaaattcagtacagtttagagaagatttttaaagcgcatacatgtgcacatattcatgatatgctctttataaaaagcttgactattgcagaatttatctctgatattaccttctaaaaatatttcaatttaatatgcttcagatctgaatttggtggcctcagtagtttagaccataataaactaaaggttttagaaatgaaaatttttaccaagaacaatttaaacttctttatgttagatcaactaacttaaatatatttattttagggtattcaaaattatctaagaagcttagaaagaaattcgtttcagctgggcgcggtggctcacgcctgtaatcccagcactttgggaggctgaggtgggcggatcacctgaggtggggccagcttggccaacatggataaaccccgtctctactaaaaatacaaaattagccaggcatggtggcgtatgcctgtaatcccagctactcgggaggctgaggtaggagaatcgcttgaacccaggaagcagaggttgtggtgagcccagatagcgccactgcattccagcctgggcaacaagagcaaaactccatctcaaaaaaagaagaaaaaacaaaaaaaaaaaagaaagaaatttgtttcattgtattatgttctgcacttattatactaattacagattatgatcctgtaagattctgaacaagtagattcagcattgttattaaatacttatgtgactttaaaagtaaatcaaggttttcttcatttacctccatggagcttataagaaggacagccaagaataaagtgcaaatacgttcaaacaatgttggcaatatgttctatttttacttaagtgatgctatgagcattatagtaggcacgaacattttgctagattattgataaatggcattacctccctgacgcacaaaaagttaaaacttcacccagctataactttctagttatgtgaagagcagagtcttcattttcctttcatatttctgaatatgaaagggtatttcagtatctcctaactgcagaggctgtaccagccactataggagaattagaaaagaaacaaaagacttactaagaaacatgaggtcttgttagagacataaaacacactcctgaaccagacattcgccaagctctgttaccaattgcaaaatgacatggcatgtgactaacacataaatatcacaaagagagatcccagtaagtgaaaagtacataagtagttttaggtgctgttatgttacttctggggctatcttattggcagtgggagccagaagatgacctgcagtataataggcaggtaagagcctgattctgtgaggcttacccttaccttatgtcatacacttaccttaattgtgatggcatttcagtgtgaaacaatcctgtcctacaggatttcccttttgtaaaaggggaagtcagacatgaatgaagcattcaagtgttagaacttggtcttcttttttccccagagttgtgttggctgatctcctgccatattttgggaagaatcagactggtagaatggtccagtgactgaaatcaggtgactaggtcacagcaaatttaatattctggaattaataataactctcagttggccaggcgtggtggctcacgcctgtaatcccagcactttgggaggccgaggcgggcagatcacaaggtcaggagatcaagaccatcctggctaacacagtgaaaccccgtctctactaaaaatacaaaaaaatcagccgggcgtggtggcgggcgcctgtagtcccagctacttgggaggctgaggcaggagaatggcgtgaacctggaaggtggagcttgcagtgagccgagatcatgccactgcactccagcctgggccacagagtgagactccgtctccaaaaataataacaataataataataataactctcagttatattttatcaggctttttcatctccagtatgcttttaaaaaaagcaaaattatagcgaatatcttagataatcacatattaaagtcttagaatgtggcattaatgagtatgtcaatcaacacataaaattcagtaacaatttgaataatattatgtgataacagagctgtacagtgttttataactaacatggtttccaataagagccatcccagaacaaaactatgcttcctaacttctgtatggattgatatattagttataaatttccttttcaaagatgagtctaggaagcaattttccataaaattacagaaaagaaattactttatgaatttgcaaaatttgacacataactcacttatgtgtactgatgagctgagagaatttcttctttataaatataattcaacatgctactctggcctctaacatctgatcacccagtaacccctcaaaagtaatacatgagggcctgtattgaattcatactttgaattcatggcttaaacccatccaccatgcccattagttcaaacacataacaattatttcctttaaacaaaaagggttttaaaaaactacagagccatgatgaaaaactaaatgaaacaaatacgtggtaataaagccttacttgaaatgatcatctgtgaagttctcagccctgaaaagaagctttagcttacagccaaagcccacagtgtgacagggaccaaaagggcacctcactgggactccaggcaagcccattgcataagacagtgctgaagacagaaaacaactacaactatttgaataaagttgctacaactatttgaataaagcagcatataaaaaagtagctacaactatttgaataaagcagcatacctgaggggaggaggctacaaagatgccagtccagaacctgaatgtcatgaggacagaagccctaagccaccactgaaagactgggaggccctgtggaccaagtgaaaacaacaggacagactttagacagactggtaagagccaaaaggtagacacatccacacagtggaacataaaacttgaaatttcatatgatgaaatcttcatctaaaaaaaaaaaaaagcccaataaactttacataaaggaagatcaatatccaactaaataaaaagtcaatctgaaaatgactagaaaaacacacttaagattctcaaagagataaagctatttttaaaggagttttccttaaaataacatgaaattataaaatcagaagagaaattacagggcagaaataacagggaataggtttaccctcctgcattaaacaactaaaaaatgaaaaaaaaaatatatgaaacagtggttttcaaatattggacaatgggcagctcaggagagttatccctgcaagaggaaaaacaagagtgactcctcaaattgccttaactcactgcatgaagagagtttccaggctgcaatgagggaggggagccaatgcagacacaggtggtctccctgagttgaagagacagggttgggaggccaaggaatccaaggcagctgcagtttgcaaggcggagtactgcagaggaggggcttgctgcacgtggacagcgctccagagatggcagagacttcacctcatcccacccccaccaagtctatggataaatatttaccagtgtgtgtgtgtgaggaagctaccttgagactagtgaaatacccactctaagggagcagaaggaacaatgcctggagctcacacagggtggggaacagttcatattcccaccagtcagagtggaaaacttcataaattatgggcatcaggtagaatacagaagggcatggctcagaagtggtacaagatcaacactaggaaaaaaatcctgctctggtccattctaacaaagcttaacaggaatccttgaaagtggcatgctttttccaagtgatttgctccatcccagaacagagttctaaaaaactacatttcatctgtgcacaaaagtcgaggaaagcataatcatgttaaggagagacataaaatatggaaagacagaaaaaacacaaaagaatcttctagagatgaaaagtataacaactgaaatttttaaaaagccaatggtgggactaacagattaataacaatttaaagtatagctatagatactctccaaaatggagcacagagaaaaatgactagaaaaagaaagcaacagcatatcagtaactttctttttctagaaaaagaaagcaacagagtatcagtaactagagggacaatgtcaaggggctttatgtatgtgtaactggcatctccaaagaagaagaaagaagagaggacaaatattatttaaaaagaataaagtgtactttttttccaagcatgataaaatctttaagcctacagataaaacatgttcaatgaaccccaaacaaaagaaacaaggaaaactacaaggtacattgtaattaaattgcttaaaaacaagagagaaaaatcttaaagagaaagccttagaagtagctagagaaaaaggatatataacatacaaaggagtgaaaaaaatatgacatcagccttctagtcagtaacatttaaagccagaagacactgaagcaccgactttaaagtactaaaagaaaaaaaggccaacctagaactctttacctagcaaaagtatctttaaaagacaaagtcaaaataaagacttttttggacttactaaagctgaaagcaagttacttcagcagactagcaccacaagaaatattaaaggaagcctttctggcaaaaagaatatgatgctagaagaaaaatctagatgttcaccagaaaaaaattttaaataccagaactcataagtatgtggttatacaaaaaataattttaaaaaatgttagaagacactttgctcaaagccaaaagaacaatgtatttgggatgttataacaggataggcataaaatgtatgacactaatgaaacaaagaccgtaacagaaaaagatagaggtactgctataatgttctcacatcacacgtgagtggcaaaaattattgaggatggaccttaataagttaaagatgcttagtatatctaaagtaaactcgtaaaacagaaagtatagctaatacatcaactaaggagataaaaatgaaatgataaataattaatccaaaaggaggcaaaggaaacaaagagaaaattagttgaatatgaaaacaaatagcaatttggtatatttgaaccaattcatagtcacattaaaataatcacattaaatataaatggtcaaaacaccccaactgaaagacagactgtgaaactgaacacagaagcaaggtccaactatatgccatctagaagaaacctaccttaattataaaaacacaaataggttgaaagtaaaaggttataccatactgtactaacctatactatactaacactaattaaaagaaaattggagtgactatattaaaacagacaaagtagatttcacagcaaacagataaatattttagagatacagagggtcatttaagatgacataggaataaattcttcaatatttatggttctaaacactcatgaatccactatcagagcatcaatatacatgaagcaaaactgatagattgtaagaaaggaatagaaatattcacatttagactcagggatttcagcacccctctctcaataactgataggagaaatggatatagaaacagtaagcatatagacttgaacaatgctatcaaccaacttgatataattaaaattttcagagcatgctgctcaacaacagcagacagagttcttttcaagtgcacagggaacatttatcaagatagatcatattttgaaccataaaacaatctgaataaatttaaaaacattcaagtcttccaacatgttatctgaccatagtgggtttaataagacaactataacataaatatatctgaaaattttttgaataactggaaattatataaaaatttataaataaccatgggtcaaagaagaaatccaaagggaaattaaacagtattttgaactgaatgacaattaagaaaacaataacattaaatttgggaggatgtagctgaggcagtgcttagacggaaatttatggcattaaatgcctatattaaaaaagaagaaaattggccgggtgcggtggctcacgcctgtaatcccagcactttgggaggccgaggcaggcggatcacgaggtcaggagatcgagaccatcctaacacggtgaaaccctgtctctactaaaaatacaaaaaattaaccgggcgtggtggcgggtgcctgtagtcccagctacttgggaggctgaggcaggagaatggcatgaacccaggagtcagaacttgcaatgagccaagatcacaccactgcactccagcctgggtgacggagcgagactccatctcaaaaaaaaaaaaaaagaagaagaagaaaatcgatgacctcagtttcatccttaagaaactagaagaagaacatgttagaccaaaaatcaaagacagaagatccaaacaaataaaatcataaatgaaaaaggagacatcataatggataccacagaaatacaaaacatcatcattagaggctaccatgaacaagtatttgtcaataagtttgaaagcctagggaaaatggataaatatttggatacatacaaccttccaagattgaaacaagaagaaacaggaaatctaaacagaccaataatgagtaacaacatcgaattagtaataaaaagtctccccaataaaggaaagtccaggaccagaaggcttcaccgctgaattctaccaaacatttaaagaagaattaataccagtccttctcaaactttttcaaaaacttgaagcagaggagattcttcctaactcattacacaagaccagcatagccatgatatcaaaaccaaacaagaacaaaacaaaaaagaaaactacagaccaatatttctgatgaacacaaatgtaaaaatcctcaacaaaatactagcaaaccaaatacaacacatttatcccaagaatgccaggatgagtcaacatatgcaaaacaataaacaccatacatcacatcaatagaatgaaggacaaaaaccatttggtcatctcgatagatgcagaaaaagcatttgataaaattcagcatctcttcatgataaaccaaaagtcaaagaagaaaagaaagatgagagaagaaatcaacaaaatagaaaacataaaacaatagaggaaattaatgaaaccaaaaatggattcttttagaagatcaataaaaattgataaaccttgaaccagactgaatattttaaaaagagagggcacaaattatcaatatcagtgatggtagaagggacactgctatgaatcccacagacattcaaagaatggtaaggaaatattacaaataactttatgccaataaatgtaatttttccacatactgtttgacagaattcttgatataggattgctgcttcaatgattaaattagtttctgccattcccatattaggttcaagttggaagtagttaattatgtatataaatgaagtggtgaattgtacttgccctctaatctacattttcaaaaagtatcttaaaacatcaatctcatagggtattgataactcctatagcagttttgatctatctttgggccataccaattaccccttacattattaatggtctttttatacacctctttctttcacagctccttctatatgtcatgcactgttgagaaaagtaataaaaagttctacgttctatgattctttcacctactccctaaggtgtagtgttgacacaacagctgtattcaaacaggtacattcagagttcaattgagatgaatagaaaaataaaatgttctccttataccttgctgtcattctctaaatggcgtaaaatttttctaaaaggcatcattagctaatgataaaaactgaaaatcccttatgtaaaattttagaaatgatatagtggtggttgtacaatactgtgaatgtacctaatgtcaatctactatacacttaaaaatggttgaaatggtaaattttgtgctatctataacttacatacatagtatatttatattttaatacaataaaaatagttttaaaaagtcaaaaaacaaaaacaaaaacctggaaatcacattcacaatctataaacttcagttttcttacctagaaaatggaaaataaagtctctggacttcacaaaaaacatcagtttttattaaaaatgtacacgttgattgttttaaggtacttcttaaaaatatagattaaagagcaagtataattcaatataagaggtttcattatagcagttatgaatacaattttgttggtaatatagatacagagtcaattctgctctgtcaattaaaagagctttaccgtgtgaacacagaatacccagctagccgtggcataaactaataggagcttttagtctcacataacaggaagctggagggggcagctgcagctttggttcagcactaaaccatgttaaggccagagtatctaccagccacccgcctgcccctcataatcactagacagttatgaggccacatccaagacacacagccgggaaatgtgcagtgctggtgcatgtgcctttttcacaaggaatgcaaaagcttgcctagaaaccctgagctccaccctctgcagatctcagcttatctcccattgaccagaattgtgtcccgtgggtacccctagcctcaagacagtctgagaaagcaggcaacccctgtcgtggaaagcagaaaaagaaaagggtttgaaagtgactgttggattagatgacaggaagtgaatcccagaacagcttactttctctgcgcttgggagtggatctcactgctctcaccagaaccctgtcctcccattccaggagaatggtggagagagcctggaagtgggcatctaaagattggctccaccacggaactgtcatctgcagctgtgtgtggctttgaggcagctataatttattccctgggatctcaatttcctcatccctatattagcaataatggtgcctactttataaaatacaggataaaatgaaaggatcaatgctcaatttaattgataaagtgttaactcattatcatgctaattattttctaacattgcagaaacaagtgttaaggtgacatcattggataccataagaagctgataggtccatctgcttccacaaagctagttggagaatttctgacatcctagatagagctcccaagggctcttaagactattttccttttgaaacatcacataattccctaccactctggaagatatttggtttcctctgagtgaaccgtaaacctacctgcatccaacagcaaaattagtgaattccttttgaagaaaattgtgtatataaaaacaagcaatcttctctaaaacaacaccaccgtatcaggattacatatcatatcaggattacgataacagagaaagtataaacaaaaccgccgtatcaggatcactgtatcgtatcaggattacgataacaaagaaagtataacacttttgtgctcataaagccactttatcttcaacaaaaagtgcaaaaaacagagccatccaaaaatgttgcttaattcatttgaaattatgagaagcctttgtgtttttaaagtaacatggtatttcttatagaaaagttaactatttctcggattcatcttcttaaagtatatcatgtcctggacataaataatccctaaaaatagaattttaattccttgaaaaagcaaaagcactggttaaaacgtggttgttttagatctttaccttgtgaactgccttgacacattgtaaccagtgcgcacaagcactgtaaacccatgggattctcacattttatgagaaaagttaatacatctacttccttaacaatatgattcaggtgaccatttggggcagccttaggagtatgttgtgggctcagacaccatacagggcctggatcgttacgacttctccaaggcgctttgaaatcatcatggaagggctttggcatctctagaacaccaagaactgtgataaagagttgaaaaaaggaggaaacattcctgaggcgccggagtggcgtgaaggccctccagctctggggcccatcagcacccggaaaagtaccactggagtggcacttaggtaggattccccagcaaacacaggtgccccgggagctcagtaacgtggtttggaaggggacagaggccccaaaggcctgaaagcccaaaaggagtactttgtggcctgcacaccaaggtttttcctaaggttcatcctgccacagaaattctttctcctccttctcctcccattcctcagccactggcgtgattaggactggctacaaagactgcctaatttggagcgtttggggttcctttcgtccttgtgatccccaatgcattctgccagcccctttctaaaagaaatggcttctctggaggagggcatctacagccttaaaattaattccaaacgtagctcctataatttcatgaaccctcaatttgcagctggaagtgagggtcaaaatgaaactgaggaaccaaacaagttccagaacaggtagggtagacctaaagatagcgacgcttaattgacttatgtgagggttctccaggagatcctgggagatgacatgccaaaaggaaaggaagaggctgtcactagttcacaatcaagcctaggagagtgtctctactacggagaaggacgagccaggaatgccactatctttgctcctcaaaaagagaaagagtcagccccagagatgagcagctcctgtgacaagagggtgattgttaatcctcctaagaaattcagtaaggggcgacctaataaccaaagtagagtcatttatgaaaaaagctctccgcctttaaattttctgggtgattataacccccattcaataatccaaaagcgacttagcaaccaaagtagtcatttgtgaaaaaactctccacctttaaattttcccggaagactagagctcccattcaatgttccaaaagcacaaagacaagatggtgattgagcgcccctctttagggtgtgactgatctgatgtaggtggaaccacagtcgtattctctgaagagaagccattctcactgtgtcttcctggagtgtcagagcctctgtactacgccactgactataccacttttccacctcattatagtccttggcatgactacaccagctcttggttcagcaataccaagtcttcttggtatccctccttgggcagcagcagtaacacattccaggctgggaagagcagcttcagcagcagcagcagcaacaacaacatattccagaatgagaggagcagccaccagagcttcctgagtgattattccaccagttttccagtgagtgcccaaaacatgtccagagacctgaagatgacagaggaaggcagatccaagaattcctccttatttcactactccagaaatgtggaagcagatgcgaaggaggagggagtgtatcaagaggagacattacaacgtccttatggaggacatgcatctagctttctgccaagtaccctctggcagccaaagcaacagggtttcattgttgatacccactgtcacttggacttgctgtattccaggctgcctttcaaaggcacctttaccaaattcagaaaaatgtatagcaacaccttccccaaggaatttcagggttgcatttcttgcttcgacaatcctcaaaacctaagggacaggctgtgggagcatccgttgaaagatgatcagcctttggctgatagcctttgactgttgccctcattttgcccattattataatgactatcaagaaagaagtattttaaaagccttacaacaccccaagtctgtggcatttggagaaatgggcttggattactccaacatgtgcaccacacatgtcccagagcagcagaaggtatttaaaagatagctgcagctggccgtctctcttaaagaagcccatgatgatccactgccgagaagccgatgaagacctactgggcatcttgaaaaaatatgtgccctctgaccacaagatgtaccagcattgcttcactggcagttacccagtcatcgagcccctgttgagccactttcccaacctgtatgtgggcttcatggcaattctgacttactcttctgctgagcaagcccgagaaactgtgaaaaagatcccattagagagaattattgtagaaaccaatgctcccttcttcctccctcactaggtttccaaaagccgttgccagtatgcccacccaggcctggccctgcatacggtgcgagagattgccagaatcaaagatctgttgctttcccacaccttggccatcttgcaggagaacacctgtcacctctaccatctttaaacagaaaaggcacagtcaggagtcttcctaagaaaggagaccagtagcctgacaaaacacatgaactagatttgaactctatgtcccgggtcaaggatgtgtttgaagaattcgttggcatggagtaaaccaggacaggatattttcctcaaaaccttttcgtaagacttctgcttctggctggtagggtggggtacaatgggatgggaggaaggctaaggtaaactgcccttgatgttattaaggtttttcttcccagcaaaaatgccttaaggtagccagtaaagaagagagtttgatagaatacaaagagtttcccaatctaaatccctgtcctctgcagcctgcttttgatcacttggtgaataaagtcacccttctacttgtctttaaaaaaatgtagaattttaaaagtgaggtaggtgatttgtatattatattcgtatattataggaattctatttaaaaatttaaaaatcggtcgggcatggtggctcacacctgtaattccagcactttgggacgctgaggcaggtggatcacttgagcccaggaattcaagaccagcctgggcaacatagttaaaactcatctctatttaaaaaaaaaaaaaaaaatcagctgggtgtggtggcacacacctgtaattccagctacttgggaggctgaggtgggaggatcacttgaatccacgagtctcaggctacagtgaactgtatactcacaccactggactccagcctggcaacagagtgaaactcccatctcttaaaaaaaaaaaaaaaaaaaagttttttaacaaaaaataggccagatgtagtggctcacgcctgtaatcccagcactttggaaggccaaagcgggtggatcacttgagcccaggagtttgagaccagcctaggcaacatagtgagaccctgcctctaaaaaacattttttaaataaaaaatgtaagtatacactcaaaaagataagcgagatctacacaccgagttttcctttccaaaaaaaatttctatcaaaaaaaaatttttttaattttagatggaaaaccaacctactcctctctccctgcatttttgtgtggcaaatttaagtgttacactctgcggtgtttataacatgcaggagagaaccttgctgtaatttatctttttttcttcaggaaaaggaatgagcattgtagttctgagtgtagtattatcaagagtagcctaaatcaaaaagcacaatctggccaggcgcggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggttcggtggctgatgcctgtaatcccagcactttgggaggccgaggagggcggatcacgaggtcaggaaatcgagaccatcttggctaacacggtgaaaccccgtctctactaaaactaccaaaaattagggggcgtggtggcgggcacctgtagtcccacctacttgggaggctgaggcaggagaatggcgtgaacccgggaggcggagcttgcagtgagccgagatcgtgccagtgcactccagcctgggcgacagagccagactctgtcacagaaaagaaaaaaaaaaaaaaacaaacctcaattttcatttatttattccattagtgaggtaaagaacagttcacctactcatgttactagtaaaatcttgcaatgcaaatgtgcaaaatttgggacactttgtaaatagttttctacttaagtgatagatattccatttaacctcaaagaattattatttagcatttatttttatggcatttggtgtgactaccctcccatcctggagacatcagagttgtgaaggtagccagtaatctagaaattcagtttactcttagtggtccctgggatattagtctggagtcacagagcctctcaaggcccattaacaggctcccccaaccttagcagtcctttcagggcatgtcaacatttcgcttcacttaaattttagaaaggcagctatttctacctttaaagctcaaaagaagcaaactgcccattttgtcttgggagacagaggaatttgctttttcagttggtttttattcatatctaacttcaaaattcatacctgcttattataaaagttttgagacaagtaaagcgaaaaaaatgtgatttttaaaaaacccaaacaaaataaaagcaacagaaggaaaaacgtacatggtaaaattgattttttttaaatcaatagtagagtcaaatattggcaaaatctggatatacaaaatttgactcaggaaaattgatcttggtagaaatgtgatcaacaaagaaaactcagactgtcaaaagccacaatggacagcattcatatagacaaaaattaatgaaccaaatgtttttagtaaattttattgtagaaaaaatctgttgaaaatatttcttaataggaaaatatggtaatagtttacctgcatggaaaaattgttcaaagaattaaagtagcttgcagtggggaaaaaagtaaaaatttttttgtttaggtataattctgtttgttttaaataatcaactcagactgcatgtgctttttcaaaactattgtttactgatacataaaattgtgctttgaaatttatttttctttctgttctctgatgtcgattttattgtgtattttctaatgtcttaagctaaatgcttagtttattttttatctggagagcaagaacaaagcagtcaataccacaaatgtgtctgtaattataactctgctgtatacatagatttttttattttgataaagtttactttacacattataaaaacacaaatgtattacaaaaatatggaaatagagagtagcaggaaaaagtatatggcatttctattacctagaaccccactgttgtaggtgtctttccttgacatagctgtgaccatatagctctgttaaattgcatatttgtctaaataattcatatttttttctatccctatcttgcgtttggagctcattttatgattgttattcttttatctttcaataaatactcaaaatgttaaaaaaatatgattcaggaatttttaattgtcttagccacaaatttataggatttccaggatctgtaacaatggataaataattttataaaaatcctaaatttacacagaattataaagatataatcattttaaacagcacctattttgcaaattttataaatctctttctaggactcatctctgcttctacaatcaacccagaatgtgactgtaaatgcgcgcaactcagaaggggaggtcacaggcaggttaaaagtcggtgagtccagcttcatcatggtgctttgcatgcatgttgtccatgaatagtgctaaatgaatgcattgttttttcttctaaagaaatcaaagctacttatgaacaaaatatgaattttctaaatatcatgctgtgttgaccacagactagcaccacagagtggggtggggggtgaggggacagcctgaagtgctttgattagagttatttttgttccaagaaatagaggacaattaaagctagtacaagaaacaaaatgtttattgtgggttaccaaagactcttgcagcaaccaaagggaaggaacccaagtagctggcctcaaagagcacagagaccagtggctgagagccacgaatacattcagttccctccccgttctttcttctcttttctctcctccccatgtgctccattctcctcctttccagtttatctttgccaccattttcacttggctgtatcacttctcactgtacagaacctatagggcctccctgattcttacctgctcggctgtagttatcaacatcaaacagtttagtcttcaattacgcaaattctaaatccacaaagtactctaattagcccaattcatctgtcccaccacattcctttgggtcagtcagctatgtacacccatccaatcaactaaggccagaggataaggtcacatgggagtgaggtcacatggaatcctgcaaagggagaaaaatgtcagcaagaagaaatacagatgaaagcaatatcagaagagcaaaccagctggtaagaaggaatgcaggccaggcatggtggctcacccctgtaatcccagcactttgggaggccaggatggaaggattgcttgaatctaggtgatcaagatcagcctgggcaacatctctaaaaaaataattttaaaaattagccaggtgtggtggtgcacgtctgtagtcgcagctactggggagtctgagacagggaggatcactcgagcctaggaattcaattctgtggtggaagagaccctttgtttgaaaaaaagagaataagaataacgaagatatatatattcactatactattaacattggatagatttgctaagtctaggaaactggatggcccttgtcattatcagaaaataaatgagaggtgtactgccaacacaaacttccaatgtctctctttttaatggtacttttacaaaacagaataatgttacatgggaaactacagccttatgttaatctgatgattcctttttcttatactaatacaagatgttctgtactttatcctctgctttataacttattcttgatcataacttgtatctctctttggcctggaagttttgtttaataactaagtccagtgaaattctctgtggatcaggagatgaactccagtttttcctgcatatacgttcttaagatgtatttaaaacaaattatattttcttgataaattatacagtattatcatttatctttaccatcatttcttgaaaatcttcaactgcctatagctttcaagtgtttgaggaatttttgcccattttttctcattcattccaacaaatatttgttgaatgactatgggctaccttatatgctatcaagtaataataataaagactatgtaattatttcttagaagctataaaagtagaagaatcttcttatattcctataaaaattaattagcggccgggcacggtggctcacgcctgtaatcccagcactttgggaggccgaggtgggtggatcatgaggtcaggagatcaagaccatcctggctaacacagtgaaaccacgtctctactaaaaatactaaaaattagccgggcgtggtggcggtcgcctgtagtctcagctacttgggcggctgaggcaggagaatggcgtgaacccgggaggcggagcttgcagtgagccaagatcgcatcactgcactccagcctgggcgacagagtgagactgtgtctcaaaaaaaacaaaacaaaacaaacaaacaaaaaagttaattagtacaagtacacattcctctgtttatctttttgttgggtgtggattttcgtatattatgcaagggaatttagatataatataaacctgcctctcatttcatagatgaaaaaactgaaggactaaaaagcagatttgctcaagagcacatagctagttagtagagaagtcaaaacaggaaagactgagggcttacttctctcagccagctgtttccactggccctcctctctaatcagatttcttgaaattatggcatgctagtaactgttctagttgcttcaaatatagtttccatttcatttttgtcaccaagaaattaccaggggttttaaaggttttgttttgtttagtttttctttttttaaaaaggctgggtcagtggctcactcccgtaatcccagcactttgggaggctgcagcaggaagactgcttaagcctaggagttcagggcttcagtgagctatgatcacgccattacactccagcttgggtgagaaagtcagaccatctctaaaaataaaaataaaataagttacacatcaaaatctctttggtttgaactgttcgcctcaatctctagttttaaccttggtgtctcatgcctgagaaagtgatttaattagtgatttctagtaaatctttagttggaaagtctctgttatattgagaaccttgagctaggaaatagcaccaagctcaccaaatccaaggttttcttccgtacatgacttcccacagttgcaacccttctagtctcatatttcctggaagaagttaaattttgccaatttgggtattaaaatgtaatttatgtgaactagccatattaatctcatttaattaagtgaataagtgttttctacaaaaccactgaaaacaatttgcattcaatacagtcaaaaccaaaaatcccaattaaattctgacatgatttggatgtgcgtcccctccaaatgtcatggtgaaatgtgattcccaatgtggaaggtggggcctaatggatggtattgtatcatgagggtggatccctctcaaacggcttgcaccatacccttggtgaagagtgggttatcactccattagttcacatgacatctggttgtttaaaagagtctgggacctctctcttctctcttgctcctactcttaccacgtgatgcacctgctccttctttgccttctggaatgataggaagcttcctgaggccctcactagaagcatacgctgaagccatgtttgtacagcctgcagaattgtgagccaattaaacctcttttctttataaattacccatcctcagttatttctttatagcagtgtaagaatcgagtaacacagaaaattggtactgaggagtgagccattgctataaagatacctgaaggtgtggaagcagctttggaactgggtaacaggcagaagttagaagagtttggagggctcagacaggaagatgacagaaagtttgggacttcttagagacttagtaagtggctgtgaccaaaatgctgttagaaatgtgggcagtgaagatcaggctgaggaggtctcagatggaaatgaggacgttattgggacctggaataaacatcacctgtgtaatgccctaggaaagagcttagctgcattgtgtccacaacctaggaacctatggaagtttgaatttaagagtgatgacttcgtgtactgcagaagaaatttctaagcagcaaagtattcaagaagcagtctggctgcttctaataacctacaatcagatataagagcaaaaaaaaaaactttaaaatttgaatttatatttaaaagggaagcagagtggaaaagtttggaaaatttgctgattggcactgtggtagagaaagaattcaagcaggctacagagcaatcacttactagagagctcagcatggctaaaagggagccaagtgctaatatccaagacaatgggggaaaggccctgaagacatttcagagatcttcgtgacagcccattccatcacgggcacagaggcctaagaggaaaccatggtttcagggacactgcttcccacatcacagctgctctagctccagctgtgcctcaaagggccccagatactactcaggccatcgctgtggaaggcgcaagccataagccttggtagcttccacatggtgttaagtctccaggcccgcagaatgcaagaggaagcttggcagcttgcacctaggtttcagaagacgtgtagaaaagcctggatgtccagtctgaaacatgctgcagggacacaggccccacaaagatactgtactagaacagggctgagaggaaatgtgggggtgaaagccccaaagtccctactggggcattgcctagtggagctatgggaagggagccactgccctccagaccccagaatcgtcgagctaccagaaacttgcatcttgagcctggaaaagccaccggcactcaactccaacccatgagagaagccactgggactgcaccctgtaaagccacaggagtggtgctggtcaccttgaggtgccatcttattgcccctttcctttgactgatttctcccttttggaatggcaacatttacccaatgcttctactaccatcatatcttggaagtaaataacttgtttgtattttataaactcaaagtggaaagagatgaatctcagatgagacttaggacgttggacttcatgctggaatgagttaagactttgggggacttttgggaagggatgattgtattttacaatgtgagaagaatgtgagatttgggggagcaagggaagagtgatatggtttgaatatttgtcccctacaagttgcatgttgaaacgtaacctccaatgtaggagttggggcctgatgggaggtgtttgggtcatacaggtagatccctcatgattggtttagtgccatccccttggtcatgagtaagttttcactcagttagttcacaaaagacctggttgtttaagagtcggggttttaagggtttttttccaagatggaagattagaggcattattagcatgcctttcctacttggaaagacataacagtttgtagagaattatgctgtgaacttgcttccaagaaacaacacaggaacttaatttaaaaagctgaaagaaagcacactttgaaagaagcagtgggcagcagcttacaccatgaaccaaatgggaagctccccacaggagacagtgaacctgctcacacacccagcatgtcactactacaaccaacatcttagaaagccatcacacagattctctataaccaaggaactcatacagactcttcaccactgaaagtacccatagccaaagctagttgacaataacctataaatattaaagtcatatcctcaaggtgcaaaaaagaattttaaaaatcccagcagaatcaaaaaataaatgcaaaattaattagaagaaatagttacccaaatgagaaggaaccagagaaataattctggccatatgaaaaaacagggttttataaaacttgcaaaagctcacattgagtctccagcagtggatctaaaccaatgaaatctttgaaataccagataaataattcaaagtgtttattattaagttactcaaggaaatacaagaaaaaagtgaaaactaacatgaaaaacttttttttatatactttaatttctagggtacatgtgcaaaacatgcaggtttgttacgtatgtatacatgtgccatgttgctttgctgcacccattaactcgtcatgtacattaggtatctcccctaatgctgtccctcccccattcccccaccccacgacaggccccagtgtgtgatgttccccttcctgtgtccaagggttctcattgttcaattcacacctatgagtgacaacatgcagtgtttggttttctgtccttgcaatagtttgctcagaatgatggtttccagcttcatccatgtctctacaaaggacatgaactcatccttttttatggctgcatagtattccatggtgtatatgtgccacattttcttaatccagtctatcattgatggacatttgggttagttccaagtctttgctattgtgaacagtgccacaataaacataggtgtgcatgtgtctttgtagtagcatgacttacaatcttttgggtatatacccagtaatgggatcgctgggtcaaatggaatttctagttctagatccctgaggaatcgccacactctcttccacaatggttgaactagtttacactcccaccaacggtgtaaaagcattcctatttctccacatcctctccagtacctgttgtttcctgacttgttagtgatcgccattccaactggtgtgaaatggtatctctttgtggttttgatttgcatttctctgatgaccagtgatgatgagcattttttcatgtgtctgttagctgcaaaaatgtcttcttttgagaagtgtttgttcatatcctttgcccacgtttttgattcgcttcttataaatttgtttaagttctttgtagattctggatattagccctttatatactttaatttctagggtacacatgcaaaacatgcaagtttgttatgtatgtatacacgtgccatgttgctttgctgcacccattaactagtcatttacattaggtatctcccctaatgctatccctaccccattcccccaccccatggacaggggtgggcatttagtgctgtaaatcagatgagtagactgcaaaaattttctcccattctgtaggttgcctgttcactctgatggtagtttcttttgctgtgcagaagctcattagtttaattagatcccttttgtcaattttgactttggttgccattgcttttggtgttttagtcatgaagtccttgcccatgcctatgtcctgaatgttattgcctaggttttcttctagggtttttatggttttaggtctaacatttaagtctttaacccatcttgaattaattttcatataaagtgtaaggaagagatccagtttcagctttctacatatggctagccagttttcctagcaccatttattaaatagggaatcgtttccccattgcttgtttttgtcaggtttgtcaaagatcagatggttgtagataagcggcgttatttctgaggcctctgttctgttccattggtctatatatctgttttggtaccagtaccatgctgttttggttactgtagccttgtagtatagtttgaagtcaggtagggtggttcctccagctttgttctttttgcataggattgtcttggcaatgcaggctcttttttggtttgacatgaactttaaagtagttttttccaattctgtgaagaaagtcattggtagcttgatggggatggcattgaatctataaattatcttgagcagtatggccgttttcacgatattgattcttcctatccatgagcatggaatgttcttccatttgtttgtgtcctcttttatttcgttgagcagtggtttgtagttctccttgaagaggtccttcacatcccttgtaagttgtattcctaggtattttattctctttgtagcaattgtgaatgggaggtcactcatgatttggctctctgtttgtgtgttattggtgtatagggatgctcgtgattttggcacattgattttgtatcctgagacattgctgaagttgcttatcagcttaagaagattttggactgagacgatgaggttttctaaatatacaatcatgtcatctgcaaatagggacaatttgacctcctcttttcctcactgaataccctttatttcttcctcttgcctgattaccctggccagaacttccaacactatgttgaataggagtggtgagagagggcatccctgtcttttgccagttttcaaagggaatgcttccagtttttgcccattcagtatgatattggctgtgggtttgtcataaatagctcttattattttgagatacatcccatcaatatctagtttattgagagtttttagcatgaaggctgttgaattttgtcgaaggccttttctgcatctattgagataatcatgtggtttttgtctttggttctgtttatgtgatggattacgtttaatgatttgcatatgttgaaccaatcttgcatcccagggatgaaaccaactagatcttggtggctaagctttttgatgtgctgctggatttggtttgccagtattttattgaggatttttgcatcgatgttcatcagggatattggtctaaaattctgttttgttgtgtctctgccaggctttggtatcaggatgatgttggcctcataaaatgagttaggagaattccctctttatctattgattggaatagtttcagaaggaatggtaccagctcctctttgtacctctggtagaatttggctgtaaatccgtctgctcttggactttttttggttggtaggctattaattattgcctcaatttcagcgcctgttattggtctattcagggattcaacttcttcctggtttagtcttgggagggtgtatgtgtccaggaaatatccatttcttctagattttctggtttatttgcgtagaggtgtttatagtattctctgatgatagtttgtatttctgtgggatcggtggagatatcccctttatcattttttattgcgtctatttgattcttctctcttttcttctttattagtgttcctagcggtctatcaattttgttgatcttttcaaaaaaaccagctcctagattcattgattttttgaagggttttttatgtttctatctccctcagttctgctctgatcttagttatttcttgtcttctgctagcttttgaatttgtttgctcttgcttctctagttcttttaattgtgatgttagggtgttaattttagatctttcctgctttctcttgtgggcatttagtgctataaatttccctctacacactgctttaaatgcatcccagagattctggtacattgtgtctttgttctcattggtttcaaagaacatctttatttctgccttcatttcattatttacccagtagtcattcaggagcaggttgttcagtttccatgtagttgagcagttttgagtgagtttcttagtcctgagttctaatttgattgcactgtggtctgagagacagtttgttgtgatttctgttcttttacatttgctgaggagagctttacttcccagtatgtggtcaattttggaataagtgtgatgtggtgctgagaagaatgtatattctgttgatttggggtggagagttctgtagatgtctattaggtcaggttgctacagagctgagttcaagtcctggatatccttgttaaccttctgtctcattgatctgtctaatattgacagtggggtgttaaagtctcccattattattgtgtgggagtctaagtctctttatgtatctctaaggacttgctttatgaatctgggtgctcctgtattgggtgcatatatatttaggatagtcagctcttcttgttgaatttatccctttaccattatgtaatggccttctttgtctcttttgatctttgttggtctaaagtctattttatcagagactaggattgcaacccctgcttttattttgctttccatttgcttggtagatcttcctctatccctttattttgagcctgtgtatgtctctgcacatgagatgtgtctcctgaatacagcacactgatgggtcttgactctttatccaatttgccagtctgtgtcttttaattggggcatttagcccatttacatttaagattaatattgttatgtgtcaatttgatcctgtcattatgatgttagctggttattttgcccattagttgatgcagtttcttgctagcatcgatggtctttacaatttggcatgtttttgcagtggctggtactggtttttcctttccatgtttagtgcttccttcaggagctcttgtaaggcaggctttgtggtgacaaaatctctcagcatttgcttatctgtacaggattttatttctccttcgcttatgaagcttagtttgaaattctgggttgaaaattcttttctttaagaatgttgaatattggcccccacactcttctggcttgtagactttctgccaagagatctgctcttagtcttatgggattccctttgtggataacctgacctttctctctggctgccgttaacattttttccttcatttcaaccttggtgaatctgacaattatgtgtcttgggattgctcttctcaaggagtatctttgtggtgttctttgtatttcctgaatttgaatgttggcctcccttgctaggctggggaagttctgctggataatatcctgaagaaatttttccagcatgattccattctccccatcactttcaggtacaccaatcaaacgtagatttgatcttttcacgtagtcccatatttcttgctttgttcatttctttttattctgaaaaattttttttttaatttcagttatgagtaaaaaaaaatctctaaagagatagatcaaaaaacaaaaaccagtcagaacttttggaaatgaaagacacatttagggaactataaaatgcagtggaaagttttaaaaatagactagtccaaatagaagaaagaatttcagagctcgaagacaagtcttttgaattaactgaatcagacacaaataaagaaaaacaaatttaaagaaatgaacaaaatctctacaaaatatggaattatgtaaaacaaccaaactaacaatcttaggtgtcctgagagaaaagaaaaaacaaaatgtttggaaaatgtatttaagggaataatttaggaaaactttcctggctttgttagagatttagacatccaagtacaagaagttcaaataacttttgggagactcattgcaaaaaggacatcaccaaggcatatagtcatcaagctatctgaagtcaatgtgaaggaaaacattctaagtgcagtgagacaaaaggatcaggtaacctataaaggaaaacctatcagactaacagcaaatttcttagcagaaaccttacaagtcagaaaggattggggtactatctttagtatcattaaagagaacaactgtcagccaagaattttgtatccagacaaagtaagtttcataaatgaaggaaaaataaagtctttatcagacaagcaaatgctgatggaatttgtcagcactagactaaccctaaaagaaatgctgaaaggaattctaaatgttgaacaaaaggtcaatacacaccagaatagaaactcctgaaagcacaaaattcacaggggttataaaacaataacacaatgaaggaaaaacagtcactaggtaacaatcaacatgataactcgaacagtacctcacatctcaatattcacattgaatgtaagtggtctaaatgctccacttaaaagatacagattagcaaaatggattaaaaaatcacaaaccaaatatctgctgttttcagcagacaacatggaaggattctcatagactcaaggttaaggggtcgaaaacaatatttcatgcaaatggaaaccacaagtgagaatgagtagctattcttacatcaaataaaacagacttgaaagcaacaatgtaaaaacaaaaccaaaaaatgtagttatataatgatgagaggatcagtacaccaagaagctataacaatcctcaatatatacgtacttaagtccagagctcttagatagataataaaaaattactactatacctaagaaaagagatagacagcaaaacaataacagtggaggacttcaatactccactgacggcattagacaaatcattgaggcagaaagtcaacaaagaaaactggacttaaactgtactctagaacaaatacacaaaatatatttaaataacattatactcaacaagtgcagaatatccattcttcccatcagcacatgaaacattctccatggtagatcatatgataggccacaaaccaagtctcaataaattttttaagagcaaaataatatcaagtatcttctcagaccacagcaaaataaaactggagataaattccaaaagaaaccctcaaaattatacaaatgtatggaaattacagaatctgctcctgaatgattttggggttaacaatgacattaaaatggaaatttaaaaatgtttcaaagtgaataagagtgagtcaacttatcagaacctctgggatatagcaaaagcagtactaagaggaaagtttatagcccaaattcctacatcaaagtttgaaatatcacaaattgcaaacctgacatcacacctcaaggaactagagaaacaagaataaaccaaacccaaagctaccataggaaaagaaataacaaagatcagagcagaaacaaaaaaaaaatacaaaagatcaatgaaacaaaatctgactttttgaaaatattttttaaaatcattagctatattaatcaagaaaagaagagagaagattcaaataagctcgattagaaatgaaaatggagacagtgcaactgacatcacagaaatactaaggatcatttgagtttcctgtagacacttctgtgcacacaaactagaaaatctagaggaagtggataaattcctggaaacaaacaactcctttagtttgaatcagaaagaaatagaattcctgaacagaccaataacaagcaatgagattgaatcagtaatagaagaaactgctgaaaacaacaaaaaagctcagggctagacagattcacatctgaattcaaaagactgaggagaaagaaatcctccctaactcattatacgaacccagtattaccctgatatcaaagccaggaaagaaaatattagtaaatgaaaactacagactaatatccccaaagaatatagatgcaaaaatcctcaacaaaatactagctgactgaatccaacagcactccaagaaaatcattcaccatgagcaagttggtttcattctagggatggttcaacatatgcgagtcaagaaatttgattcgtcacctaaacagaattaaaaacaaaaaccatatgatcatctcagtagatgcagaaaaagcattaaacaaaatctagcattcttttctgataaaaaccctcaaccaactaggcatagaagaaatatatctcaaaataatagaagccatatatgacaaactcatggccaacattatactggaaggaaaaaagttgaaagcattccccctaagaactattacagaacaagacgaggatgcccattttcaccacttgtattcaacatcgtactgaaagtgctagccagagtaatcattgcaagataaaaaaacaaagggcatccaaattggaaaagaaatcaaagtatctctgtttgccaatgatgcgatcttatagctagaaaaccctacacactcctccagaagactcctagatttgatgaatgaattcagtaaagtctcaggttacaaaaataaatgtacacaaattagtagcactgctatacaccaacagcaaccaagccgagaatccaatcaagaagtcaattcattttacaatggttacaaaaaaaaaataccgagaaatatacttaaccaaggagatgaaagatctctgcaaggataactacaaaacattgctgaaagaaatcatagatgatgcaagcaaattgaaatacatctcatattcatgtattagaagaatcaatattgcaaaatgaccatactgaccaaagcagtctacaaattcaatgcaatttctattaaaataccagcatcattcttacagaattaggaaatataatcctaaaattcatacggaaccaaaaaagtgcctgaatagccaaatacatcctaagcaaaaagaataaatctaaaaatatcacattaccggacttcaaattatactacaaggctgtagtaacccaaacagcatggtagtggtataaaagtagatacatagatcaatggatcagaatagagaacccagaaataaagtgaagtacttacaactaattgatctttgacaaaccatacaaaaacataaactggggaaaacacatcctattcaataaatggtgctgggaaaattggattgcctaggtcgtgtagaagaatgaaactggatttctactctcaccatatacaaaaattagctctagatgggtttaagacttaaatctaagacttgaaatcataaaaattctagaagaaaatctatagaaaactcttctggacaatgatttaggtgactaaaacctcaatagtaaatgcaacaaaagcaaaaataaatggaacctaattaaactaaaaaacttctgcacagcaaaataaatactcatcagagtaaacagacagcctatagaatgggagaaaatatgtactaattatgcatctgacaaaggactaatatctaacttgggaaaaaagatttttaaaaaagttaatatctggaatctacgaggaaataaaacagatcagcaagaaaaaaaaaatgaataatatcattaaaaagtaggcaaaggggccgggcacagtggctcatgcctgtaatcccagcactttgggaatccgaagcaggaggatcacgaggtcaaaacatcaagaccatcctggccaacatggtgaaaccctgtttctactaaaaatacaaaagttagctgggtgcagttgcacgcacctgtagtcccagctactcaggaggctgaggcaggagaattcgcttgaacctgggaggtggaggttgcagtgagccaagattgtgccactgcactccagcctggagacagagtgagactccgtctcaaaaaaaataaataaataaaataagtaggcaaaagacattaatagacatttctcaaaagaagatacaaaaatagccaacaaatatgaaaatacactccataccactagtcatcagggaaatgcaaattaagaccacaatgagataccaccttatgccagccggaatggccattatgaaaaagtcaaaaaacaatagatgttgatacgaatgtggtgaaaaaggaatgcttagacactgctgatgggaatgtaaaattagtagaacctctatggaaaacagtatggagatttctcaaagaactaaaagtagatttaacctagcaatcccactgctgggtatctacccaaaggaaaagaagtcattatatcaaaaagacacctgcacacacatgtttatcacagcacaattcaaaatcacaaagatataaaatcaacctaaatgcccatcaaacaatgtgtggataaagaatatgtgatatacctgaggtcaggagttcgagaccagcctggacaacatgttgaaaccccatctctaccaaaaatacaaaaattaggtatggtggcaggcgcctgtaatcccagctactcaagaggctgaggcaggagaattgcttgaacctgggaggtggaggttgcagtgagccgagatcacgccactgcactccagcctgggcaacagagcaagactctgtctcaaaaaaaaaaaaagtgctatatcacatatatatatatgatatatgtaattgtggtgtgtggatatatacaccatggaaatatattcagccatgaaaaagagtgatataatgtcttttgcagtgacttggatggaattggaggccattattttatgtgaagtaacactcaggaatcaaaaatcgaatgccacatgttctcacttataagtgggaattaagctatgggtatgcgaaggcatacagagtggtaaaatgagcgttggaggctcagaagaggggaaagtggagggtgagaagtgggtgagagatgaaaaactacctattgggtactatgtacactacttgggtgatgagtgcactaaaatcctagacatcacaactatacacacataaccaaaaaccatttgtacacctaaagctattgaaataaaagaatagtaaataaataaatttaaattctctcttctctcttctctctctcttgcttctgttcttgccataagatatacctgctccctcttttccttacaccatgattggaagcttcctgaggccgtcaccagaagtagatgctggcatcatgcttgtacaccctgcagaaccatgagccagttaaataccttttctttgtaaattacccagcctcaggaatttctttgtagcaatgcaataatgaactaacacaaattccaaagaaagtcaaacattgaaaagcaagcactagtaactagcatttcaaatctgtgaaataaaagataccaaattataaacaacagtggaatcttaccactgataaatacagctctggttactgttgttcactttctttctatttccaataagaaaaatcaattttgttaaacttaaatatgagacacacccagaaagatgcaagttgtgcccacacaagttgatgaagtttggcagttgggttttctgagacccactgagccaggctgcagctaatttgtcccaactgcctagcagcctgatgcacgaacagaatctgatccaccaggaccactggcctctactctgaggagtgtctacaggagcatggtcactacagacctgatgtggagattgacaaattacaacgaaatcaacccctgggggagctggtgatgtttgtagcacacattggtcactgccacccagataatccaagtcacttttttcaattgctgaacgatctgctgtgctacagccacaccgtcttggatccagaacttcaatgacattttgcaaatctttgatcttcctttgaaataagaatcacagcattcaaagagttgcagttacaagcttctcagaaggcttgtacactcagagtgtggctgatatcaagaatataaatgtaaaatacaagaacaataaagtgaatataggatttcagaattccacgcacacctaagagacagcaatgccatcacagctaaaatatccttgtgtgtaatgattgaactcaatggaagaaacatttggaatgctgcccaaactgtcagtgttatcttaagtgtgtgtttcactaaagtcaccaagatacaggctgctgctttgaaattcttctaaggaaacggggtggcaactcaggatctgagtatgaaggaccttccagcgtagatgccacagggaggagaagcttcaaacgcaaggctggaacaggctttggaagtgctgatactagaagaagaagaagaaataaaagaacagtagcagagatatttaaatttccagccattacttgattaatgatcctcaaagttctgcagaaaaatgactaaagcagctggagagctgtaaggagaggtatgaagtgaggctgatgcccaggaacctaatctccagattggtggaaatttatgggctttttctcttttgtgttgatcctctcgtgcggagatttctgcagcctaatcgaagagaagtaatcagatccttctgtctgctccacaagtaggtggccaacaattctgtaagggagaggagccctggggtgtcatgacagtaggaatcaatgctataaaaaaagtaacaacttgataccctcacattgtgactaaagaaccccccagttttggcccagtgaggaatacacaaacataaagatgtgatcatttctgctaggattttgattctgttcttctgagtgccaaattctcagatactacagaagagattctgagacaagcctacagaggcctcaaaagaagcaagagtgcaagaatatggataactaaatgctacagattacatttcaggagggggaattctgaagtcaagaaagagaatgttgtgaacagtaaagaagggtggggaagtaccagtcctgaggaggagggagatgcccatggtgggtgggttgacgtgtgtcactcttctgtgaaaaacagcagggactttccaaggaggtgcccagcatgcctgtggaggaggagggagccaaatctgctgccctcagcaccagttgccttctaagccaggaagacttccagaaaatctacatggcccaactgtataatgaacccagggctgccctgggaaagccacaaactgaaagatactgaaataaacagcattgatgggccaagagacaagttactgtcagttgaggatattgaacgctttaaaaaaaaaaaaaacactcatcttcaggaagactagccgctgcagtggctggaaagactgactgaaaagaatatgttagaaagaaaaccaatatgagtgcagtttccagtgccccaaataaagagaagaaaactaactttatatgataatgtattatagccagaatgtccagtcaaaaaatagatgttccttcagaaaaaaagcaactggcaccatgagatgtacttttggaaaaaagggaaatagaataaattatcttccaaaccagtttttcattccaaggataatgctgaatttgtgtaattgctctgaatattagtcaatagtcaatccaaaaatatttgcttatgtttaaaagtacagagataagatatttttgaaaaccacagtttgtaaaaagataaagggaattttatttgaaggacaggataacacagtggctattttggagggtgtgtgctgcagtggggtgcatgcatcgttactattggttgcagactcagatctgaacaaaaagatatagtcaagaaagtgtgacttcttcatcccgtctgcctcagtccccagccccttcctacctcttgctcacccacaccctctcagtagccagtcttttccattttaggtttatccatcctccatttcatttgcaaaaaatgaccacatatatgttttcttaggctcccatcatacttacatgaggatagcatacggtaggtagtcttttgaactttactttttcactgaatagtatggccctcaaaattactccatattaattcataaacatcttccttattatttttcacagctgcatagtaccctattatgtggagttgccgtgattattcagctattcacccatatatatgaacatttaagttgttctcactgttgtgcagttatgtcacaaagagtaacaattgcatatgtattttgtttttttttttggtttgcttttttttgttttttttgttttttttgtttttttttgaggcggagtctccctctgtcgcccaggctggagtgcagtggcgcagtcttagctcactgcaagctccgcctcccaggttcacgccattctcctgcctcagcctcccgagtagctgggactacaggcgcccgccaccatgccgggctaattttatgtatttttagtagagacggggtttcaccgtgttagccaggatggtctccatctcttgacctcgtgatccacccgcctcggcctcccaaagtgctgggattacaggcgtgagccacgtgcccggctgtattttgttttcttggaggtatatcctcagggtagattcctagaagtgggattgtggatatgtacatacttagttttgttcagttttatcaaattgtgctctagaagatggtaacaatttagattcccagcggcggtgtaggagagtatattttctgacagcctcagacaacacaatgtgtctaaattatttccagtctcacaggtgagaaatggcatgtcagtgttgctttaatttgcatttctgtaatgatgagtgtgtttgaacatttttttcataagtttgagggccatttttgtatctttgttgtgaattatctcatgactctttttccatttttctatcagaattgtcattttttattcctcagtagttaagaattctttaccaattaggcattttaactttctgcccagggtatatgttgctaagatttttctatccaatttttaagttgtcgtctaacttaatcaggtattttaaatcatgtaacacttttatttttacttgttattgttatgtattcaaacatagaatctttttttcattgcctctagatgttgagtcattgcttgaaagacttccttgtaccaaggttataaaggaattcacctatgttttcctgtagtgtttgtatgatttcactttttaacacttagttccctaatttatgtgaagtttattcttgtgtggtatgagatatgaatctaaatttatcttttctaagttgttatctgaacatcatttacttaaaagtccatccttaggccaggtgcagcggctcacacctgtaatcccagcactttcagaggctgaggcaggtagatcacctgaggtcaggagttcaagaccatatggagaaaccccgtctctattaaaaatacaaaaattagccaggcgtggtggcacgcgcccgtaatcccagctatttgggaggctgaggcaggagaattgcttgaacctgagaggcagaggttgcagtgagccgagatcacgccactacactccaacctgtgtgatagagtgagactctgtctccaaaaaagaaaaaaaagtccatctttaaacttgaaatgccgtcattatcatatactagatttccatgtctatcagagtctaattattactttatcccactagtccagtggtgtccagtcttttgccttccctgggccacactggaagaagaataattgtcttaggccccatataaaatacactaatgatagctgatgagctaaaaaaaaaattgcaaattaatctcataatgcttaaagacagtttacaaatttatgttgagctgaattcaaagctgtcctgggctgcatgcagccggcgggctacaggttggacaagcttgcactagtctgttcgtgtttccatgcctagataccacattcttttaattatagagacttcatggtatgttttaatgtctagtggggctggcctttcttgtgttttctttttccaagctattcttgtatgtttgtttttacatatgaacttttgcatcaatttgctcattctataacatagtttattggcattattactgtattgcattgaatttataaattaactctggaagaaatgacatcctataatgttgggtcaccctatccaagaatgcggaatgtcttttcatttattcaagtgtctttcagaagtattacaaatttttcctcatatatttttcacacacatcttattaaatgaatttctaaatttttaatcatctttgttgttattgtaaatggcactttctccactattatttattttaacttttgtttgtatgtattcaagttattggttattgtatgttaattttatatcctgccagtttgctgaattttttattagttgagttacttttatcagagactttggggtttgtcagatacactattatatcatctgcaaatatacaatgttactttactcaatcacacacctctaactgattttactttataaataagtttcattgactaaaacctctgctccacaatgttgagtagcagtggacaaagtggatatccttgccttgtttccaatcttagtggaaatgcttctagtctttctgtattaagtaaaatacttgccttagggttaaaatacatcattttaccatgttaagacagcatccctcaatgcctattttctagaatgttcattgatcataaatgtgtgctgaattttgccaaatactttttcagcatctatgaagataatatgatttatttttattagattaattagtatgatgttaatcattcctcacttaaagtcaatcttgcattcctggaataaatctcactttatcaaggtatattattttcttaatgtggtgttgcgctgtgcttctttctggtacttctatttagaattttttgcattcatgagtaatactagcttatagtatttttttccttatgcttgcttttctcatttaagtatcagtgctaagcttacttactttcaatactctggaataatttacagagcattgtgactatccagcttttgaaagtttgttagaattcgcttgtgacaccatctgtgcttggttcttttatgtggggtagttttttaacttccccatttcttgtataaacacaggtctgatcaaactttctcatttaatgagatcaattttagcaatcactatttccctgtggaactgcctgtttcatcatggttttcaagcttatttgcagagttctgcatagttgtctctccttttttatttcttctaattcaatggttacttttcacttgtcattccatgtgttgtgtatttgtgttttctcatttttatcaacttagctagtgttttatttattttgctaattttctcaaaaaacagaattttgatttattagatctcttttatactgttttcttccttgttaatttctgcttctatctttattatttccttccttgtgctttcttttgactcactttgttgttctatttctaggcttttgaattacgaacttagttcttttttttttttttctaaacagaattttcgctgtgttgcccaggcttcagtacaatggcacggtctcagctcactgcaacctccgcctcctgggttcaagcaattctcctgcctcagcctcccagatagctgggattacaggcatgtaccatcatgcccagctaatttttgtatttttagtagagatagggtttcaccacgttggccagtctggtctcaaactcctgacctcaggtgatctgcccacctcagcctcccaaagcgctgggattacagatgtgagctaccacgcccagccagttgatatttttattgacagagatgtttagtacaatgaaatttcctcttgtcactgctttacatgcatgccacagattctaaaatatagtgttttcaagtcataattttccttaattctgtaatttctgtttgtatttcacccaaaagttatttaaagagagacttttaaatttctgggtgaatgggtctttttgctttttatttgtgtcagcaaattctagatttattgtattgtgtttagggagtattatgtgtggtctttctacgttatgaaagtcattgatgtttgtttaccttgtgccctgatgtgtgatcagtttcagtgaatgtgccccgggcacttgaggagagtgtgcatcctccattatcaggacttcaccgtcagtatatgtcataagacttgccttgttgagttctttttaggtcatctcctcacttgttattccacttgacctgtcttgtactgaaagttgtgtattaaatctagcattattagtgtgttctgtgggtcctcacatcttttatttttgtttcataaaggtggtgtctgtgatatttgcgggataggtatttgtaaatattatgtctgtgttgtgggttgtaattttagcattaaaaatcttttttgtcatatttaacgcttttgacttgaattccactttgtctgatatcaggatttttatcccagctcatttagtattcatttcctgcattacttttgtccattccttaagtggcttctcactaagtctcctcatctgtcctctccgtggccttcactcaccataattcctgtgatggagcaggtgtgtgagaagttgtagtcctggcacttgttaatttttctccctcaactcacagttctgcctttaagtaatgcaagggtgtgtttttctttctttctttctctttttttttttttttttttttttttgagatggggtcttgctctgtctcccaggctggagtgcagtggtgcgatcttggctcgctgcaagctccaccccccaggtgcaagctccaccccccaggttgacgccattctcctgcctcagcctcctgagtagctgagactacaggagcccaccaccatgctcggctaattttttgtatttttagtagagacggggtttcaccgtgttagccaggatggtctcgatctcctgacctcgtgatccaccggcctcggccttccaaagtgctgggattatgggcgtgagccactgtgcccggtctgtgtggaatttttatggctgtgaaactattccttagagtatggggatgaccttttgggaaactgattactatatagccagcgtggtcatcagccacccagaagtccatccttttccaatttaataatgctatgaaattttaaaaattcatagcattattttaatggctatgtaatatttcaaggaatacatgtataataatttgattcactaattgaaattagattttttcagttcagttaatgccacaattcataattcaggctacccttttatatttaataggttatacaataaatttttgttaaataaatgaagagaggaatgaataaaagattgtgtaggatgggatgggctgagaaaccagttggcaggtaggatagtgttctaatggatggaatatatatatatatatatatatagaaatgaggacgttgtttaacctttacaatgattgattattacagtcagggtttccagatggcagaagattggttaaaagtgatcatctggctgggtgcagtggctcatgcctgtaatcccagcactttgggaggcagaggtgggcggatcacttgaggccaggagttcaagactagcctgggcaacatggcaaaactccatctctactaaaaatacaaaagtcagccgggtgcctatagtctcagctattcaggaagctgaggcaggagaatcgcttgaacccgggaggcggaggttgcagtgagctgagatcatgccactgcactccagcctgggcgacagagcgagaccctgtctttaaaaaaaaaaaaaaagtgatcatcttacagcatttttggaaggctgtgtaagttttgcatatgattatcagggacatttactagaaataacctaagtttcactggcatagcataactagctttgtctgctcaggaaattctcaagcctggtctcttattttatttcattttattttatttaacacaagtaaaggtcattagtgccaggcttatgaagtagaactgtataatacaagattttgccacaaaagtagtagagctaacaagcacagctttgtgcttccagcccagtcctttctctgtgataccacatttgcaacagcagaatatacgtttcctttttttaaaaggactttgcaatatttgtttctaaatgattttattttaaattaaagatatcctgaggaacaaaagaagtttgctaatgagacacattgtatataaggaagaatttgatggtattttcaccagaaaaacccttaagctaatttcccaaacttaattaatcagatcacaaaaccattaactttttctctttgtaccaaagcctttcattaaaaatggtgctgtacagatagctcttttcttatcaacaaggtagaatttaaattttatttcttaaagacctctactgcaaaagacgattacatcctcagctctaatcaatgtccaactaggttaaaaaaaaaaccgctagaatattaataaaagttagaagattaattacaaactccataactattgaagaaagtgcagttgcctctgaagtggaaagcgtatttaaatttaaacatgcagggtctatttttaataaaatggaggtgggattttattcaccgctatgcctttgctcaagtagtttcctttacctggagatccctgttcttccttcatcagggaagcatgaacgctttcttttttagttttctttttttttttttttttttgagacagagtctcgctctgttgcccaagctggagtgcagtggcctgatctcagctcattgcaacctccacctcccgggttcaagcaattctcctgcctcagcctccccagtagctgggactacaggcgcacgccgccacacccagctaatttttatattttcagcagaaacggggtttcaccgtgttgcccaggttgtcgcgaactcctgatgagctcaggcaatctgcccgcctcggcttcccaaagtgctgggattacaggcgtaagccaccgcgcccagcaggaagcatgaactctttcttccaaatcagttgcaggcatcgcgtctccggacgctgctcttagcctcgatggatggaccatggattcctagtcaagactctctcatgcttgcatcccaatgcttagcaaattgtcctgaaaccaggcttacatgcttttctttttagtgaaccacagaattctttaagctgtgagctatatctcactcatttgcacattgtcaatgcttagcacagaaccttgtacataaaaagcatgcaatagatttgtattgaatggaaccattcactttcctgcattttctttgatttgaggaacagtttatgtggatttgctgctcagacttactatgaaaataaacttatttgttgactattttattgatataataactatagaaaaaaaattgtcacagttcaaccccttatacttaataaggcctcctagaattgtaagatgaacctctagtgagcaaaacagtgaactcttactggattaattattccaattatttctcaattttaaagtcagataacttgatagtcaccattaaatgcaaatcagtgtttatataataaatacataggcatatcagtgacccagaagagataaacaggaactctgagtctcagatggggaaaataacattacaaataccaaaaaataaagtgaagcttttaaaaaaaaaaaggagatgtaacatagagaaaaaagtcaactttataactggcactcttgccaaaaatatttatttatttaaatgaagactcactggagggttttaaatacaaattaataaaattaagaacacttggatgaccatgtccaaaacggatcaatgcattaatagaaaggctttacttaatgtctaccaggtatccaaaaatttttatgagaactgttagggtcagaggggacacacacaaaaaaaattataacatatgacttattttctcaacttccttttttttttttttttttggagaggtagtctcactctgtcgcccaggctggagtgcagtggcgtgatctcggctcactgcaagctccgcctcccaggttcatgccattctcccgcctcagcctcccgagtagttgggactacagatgcctgccagcacacccagctaattttttgtatttttagtagagactgggtttcaccgtgttagccaggatggtctcgatctcctgacctcatgatccgcctgcctcggcctcccaaagtgctgggattacaggcgtgagccaccgcgcccagcctaatttttgtatttttagtagagatggggtttctccatgttggccaggctggtgtcaaactcctgacctcaggtgattggctcgccttggcctggcaaactgctaggactactggtgtgagccactgtgcccagcctcaacttacttttacagataagaatataggccagacatggtggctcacacctgtcatcctagcactttgggaggccaaggctggcggatcacctgaggttaggagttcgagacaaacctggccaatatagtaaaaccccgtctctactaaaaatacaaaattagccgagcgtggtggcgcatgcctgtaatcccagctactctggaggctgaggcaggggaatcacttgaacttgggaggcggacattgcagcgagcggagatcgcaccattgcactccagcctgggcgacatgagcgaaactctgtctcaaaaaaaaaaaaaaaaagaatataaagctaacataaacaaattggggaactcctaatttcttaagtagatgatgaaggctgtgctctaggaagattaatccatgaggcctgggttagaaagtgtggaagcatcaaagaggaattggggaacacataattatgagtgcctgaggtgcgtgtgtagctgagtgagtgggaggtgtgacctcaccctcacatgtctggatggcacagggtgagtgagcacccacaaaacacctgctgaatagatgaaagagctggaaggcaatgggtctagagctcaggtgaagggcataaccttggatacaaaagtgaaacagaaggcatggcaaagacaaaaatgtcttaggggaagggcaaaaacaggaaggtgttcttccacagtgatgcctgttttccccgtggggtaaggggtgagcagcccttctgagaataatggcagagaaaagtttcaggatatgatttatcttctaggttaactttgaccattaaagtgagccattcgtaagatggtctttcacaaatctcacatttcagaatgcaagattcttaggtggttaataaccaaaagaatacaagtttaaccatgaataggaaaactatattattttgggcaagtatttaaaatcttaaagaagaaactcttaaataatgtatttgtacatatattgatataggttaacatatgtttgacacaattaattttaataatacaatagatttagacttaaaagttgcaaagtttaatcacagaatcaatcaataccactaatggtaacaaataccaagtctttagatacttggtattgtagggttgacgtggcatgtgtaaaaatagagatttggacactgcttgtagtgaacagtttataataaactgttttaattcttcaggtcccaaaatggtagaagtccagaatcaacagtttcagatcaactccaacgacggcaagccactatttactgtagatgagaaggaagttgtggttggtacagataaacttcgagtaactggtatgtactaactcgagaaaaacacaacattccatggagtacacatctgcaaaaacacattgtactattgacaagtttatgtggaatctttcaagcagataagagagtttgaatgtgttgcattttctccattgcatttctgttgaactccctcgatgctctcctagaagaacaaaatcctccccacagatcttggcccacccttcttccatcacagttttaccctttgtcccttccttcctcccttccttcttttttttttctttttagacagagtctcgctctgttgcccaggctggagtgcagtagcacaatctcggctcactgcaacctttgcctcctgggttcaagcaattctcctgcctcagcctcccgagtagctgagactacaggcacccgccaccatgcctggctaatttttgtatttttcgtagaggcagggtttctccatgttggccaggctggtctcaaactcctgacctcaaatgattcacccaccttggcctcccaaagtgctgggattacaggtgtgagccacaacaccctgccaccctttgtctttttctaattggagtaacccacagactcatcaaatgtcactattatctgtgcagttcaagtacctgtttcccaagtttcttttattctcatcacatcatgtacttgaattactcatatttctacaaaaaaaagttctctttttgaactaaaagttgaataggggtctcatagcactcatttttaagactgagaagagaaaattttatgaaaaaaatgtttcagaacatattctaaattcacttgccaaagactagaagacacaggcagatacttgttaaatctatcccagtgcctttctgtactactgtgaaaaccaatagcaatgttattgtctcacacaatactaccaatactcccaaatgaaaaagaaataatatttcctggccaaggaagtagactccaccctattacaggccctaacaaactataaagatcataacctaatgttgcatactctaagacagtaatgtatctggttttgttactaaaatgaaggacactagcgcatttaattaacggaaattggtaattgtccaacaaagcaccttaagcatcagaaatgcactgttgtgtaggataaagaatatgggctgggtagacttggattccattcctacctctgcaattactagctgcgtaatttcaagcaagttaatttttattttctgtttcctaacttctaaaagtgagttgataatatcaactgtactatcattgctgggttaagtggattaaatgtgcaaaggacagcagagttcttggtagagtatcattgtactgcagggcagtgaaatctgcagggaaaatagtctaacagcttagttcacttcaaacccaagccctcctactcagagaatcaataagatgaacttttccttagcccagggctccttccgggccatgacatcaattagaggaacaggtgagaaaaattgataagcaactgtattatttattacctgtatgcatgcatcagagccatccggagggtttgtttaaaatatactgctgggggccaggcagagtggttcacacctgtaatcccagcactttgggaggctgaggtggatggatcgcttgagctcatgagtttaagaccagcctggacaacatggcgaaaccccatctctacaaaagaaaaagtacaaaaattatccaggcgtagtggtgcgtgcctgtggtcccagctacttgggaggctgaggtgggaggatcacctgagcctgggaggcagaggttgcagtgagcagagattgagccactgcactccagcctgggcaacagagtgagaccgtgtctcagtaataataataataataataataataataataataataataatagtgctgggcctcatccccagagcttctgattcagcaggtctgaaatgtgacttgagaatctgtgtttctagagagtccccagttgctgctgatgccacagctctggggaccacactttgagaaccactgctgtggactaacatgaatcagcaggagaaacaacaggtcagcaacatgttgacgctctctgtagaagagcagtccccaaccattttggcaccagggactggtttcatggaagaaaatgttttcacagtgtgggagatggttttgggatgaaactactccacctcagatcatcaggtattagattctcatcaggagcacgcaacctagatcccttacacatacagttcacagtagggttcgcactcctatgagaatctaatgcctctactgatctgataggaggcggggctcaggcagtaacgctcgctggcccactgctcacctcctgctgtgaggcccagttcctaacaggccacaggccagtatccgtctatggcccagggatccagagtccctgctctagaacatgctttcaagttatccttttaaaggacaagttataatcttctctttcataatttttttgcctgaggcacaattttctcccaaactcctcctctgaggtgcagctaactagagcaaaatataccccacctctaatgactatatgctttccttgttattttggtgttgcaaacatttctagttcttattgccagagacaccatgaactgtgagtgtacagacagtacaattttgagcagaccataactcttctcaattttccagtatgttaatggcttccttacattttgtgattaaagaaaccaagagattccacggttttgatggttcgcttcttgttttgtctctatccaaggtctgactctctaaacattgtgtagtgcaggctttgtcgatcttaacactgtttttttgttttaaacttttactttaagttcaggggtacaagtgcaggtttgttatataggtaacttgtgtcatgggggtttgttgtacagattatttcatcacccaggtattaacccaggttattagttatttttactgatcctctccctcctcccatcctccacccttcagtaagcctcagtgtgtgttgttctcctctatgtgtccacatgttctcatcgtttagctcccacttataggtaagagcatgcagtatttggttttctattactgtgctagtttgctaaggataatagtctccagctccatccatgtccctagaagggcatgcatgatcacattctttttaatgactgcatagtattccacattttctttatccagtctgttactgatgagcatttacggtgattctatgtctttgctattgaacctcagcattgttaacattttgggctggataatgtttttggtggaggttgggggagactgtcctgtgcattgcaggacatttagcggcattcttagccatttagtggcatccttagccagtagtcattcaggagcaggttgttcagtttccatgtagttgtgtgcttttgagtgagtttcttaatcctgagtcctaacttgattgcactgtggtctgagagatagtttgttatgatctccattcttttgcatttgctgagaagtgttttacttccaattatgtggtcaattttggaattagtgtgatgtggtgctgagaagaatgtacattctgttgacttggggtggagacttctgtagatgtctattaggtctgcttggtccagagctgagttcaagtcctgaatatccttgttaattttctgtctcattaatgtgtctaatattgacagtgggatgttaaagtctcctactattattgtgtgggagtctgagtctctttgtaggtctctaagaacttgctttatgagtctgggtgctcctgtattgggtgcatatatatttaggatagttagctcttcttgttgaattgattcctttaccattatgtaatgcccttctttgtctttttttatctttgttggtttaaagtctattttatcagagactaggaatgtaatccctgctttatcttttttccatttgcttggcagctcttcctccatccctttattttgagcctatgtgtgtttctgtacatgagatgtgtctcctgaacatagcccatcaatgggttttgactctatccagtttgccagtctgtgtcttttaattggggcatttagcccatttacatctaaggttaatactgttatgtgtgaatttgatcctgtcattatgatgctagctgatcattttacccattagttgatgcagtttcttcgtagtgtcaatggtctttacaatttggtatgcttttgcagtggctggtaccggtttttcctttccacatttagtgcttccttcaggagctcttgtaaggcaggcctggtggtgacaaaatctctcagcatttgcttatctgtacaggattttatttctcctttgcttatgaagcttagtttgaaattctgggttgaaaattcttttctttaagaatgttgaatgttggctcccactcttttctggattatagggtttctgcagagacatccactgttagtctgatgggcttccctttataggtaacccgacctttctctctggctgcccttaacatgttttcctttatttcaaccttggtgaatctgacaattatgtgtcttggggttgctcttcttgaggagtacctttgttgtgttctctctatttcctgaatttgaatgttggcctgtcttgctagtttggggaagttctcctggataatatcctgaagagtgttttccaacttggttccattttccccatcactttcaggtacaccaatcaaatgtaagtttggtcttttcacatagtcccatatttcttgatggctttgttcattccttttcattcttttttctctaatcttgtcttcatgctttatttgattaagttgatcttcaatctctgatatcctttcttctgattgatcaattcggctattgatacttgtgtatgcttcacaaagttctcatgctgtgttttcagctccatcaggtcatttatgttcttctctaaactggttattctagtagcaactcctctaaccttttttcaaggttcttagcttccttgcattgggttataacatgctcctttagctcagacaagcttgttattactcaccttctgaagcctacttctgttcaattcatcaaactcattctctgtccagttttgttcccttgctggcaaggagttgtgatcctttggaggagaagaggcattctggtttttggaattttcagcctttttatgctggtttttccttatcttcctggatttatctacctttgctctttgatgttggtgacctttggatggggtttcatgtagacgtcctttttgttgatgttgatgctattcctttctgtttgttagttttccttctaacagtcaggcccctctgctgcaggtctgctagagtttgctggacgtccactccagcccctgtttgcctggatatcaccagtggaggctgcagaacagcaaagactgctacttgttccttcctctggaagtttcgtcccagaggggaacctgccagatgccaggcggagctctcctgtatgaggtgtctgtcgacccctgctgggaggtgtctcccagtcaggaggcacaggggtcagggacccacttgaggaggcagtctgtaccttagaatagctcaagcgctgtgctgggagatccgctgctctcttcagagctggcaggcaggaacatttaagtctgctgaagctgcacccacagccgccccttcccccaggtgctgtcccagggagatgggagttttatctataactccctgactggggctactgcctttctttcagagatgccctgcccagagaggaggaatctagagaggctgtctggctacagcagctttgtcgaggctcggtggggatccacctaggtcaaccttctcagcggctttgtttgcactgtgaggggaaaactgctaactcaaacctcagtaatggtggacgcccctcccctcaccaagcccaagtgtcccaggtcaactttagactgctgtgttggcagcaagaatttcaagccaatggatcttagcttactaggctccatggggatgggatccgctaagctagaccaattggctccctggcttcagccccctttccaggagaatgaatggttctgtcttgctggcattccaggtgccactgtggtatgaaaaaaaactcctgcagctagctcagtgtctgtccaaatgaccacccagttttgtgcttgaaatccagggccctggtggtgtaggcacctgagggaatctcctggtctgcaggttgcgaagaccatgggaaaagcatagtgtctgggctgaatagcaccatccttcatggcacagtccttcacggcttcccttggctaggcgagggagttctccaaccccttgcacttcccaagtgaggcaacaccccaccctgctttggctcaccctccgtgggctgcacccactgtctaaccagtcccaatgagatgagccaggtacctcagttggaaatgcagaaatcacccatcttctgcattaatctcgctgggagctgcagaccggagctgttcctgtttggccatcttgccagacaccaccaaccaacaatgggtaactttttgagaattagactgagttccaatcccagctgttccattaagtaagcacatgacctcaaatgaatatttcacctctcagtgctttatactacaaagatctgtagccactggtctctcaccattacaggacagtatacagaattcaacaaagcagatgcaaattgatcgtgaaattaaattgcatgtcttgcaaaagatgtagggtttaggaagtcagaaatgatgagaaatactggaattgctggcaaagccactaacaaaagaccaggaaagttagatttgccagcaactaaagaagtgaaaatcagccatgatgatgacatgatagtcatttcaaagatcggtaaccttaacttcacaagattaatattcactcttgtgatgactgacaatgccctcaatttaactattacagttgttcctcattatcttcaggggatacgttcaaagagccccaggggatacctcaagctgcagatagtactaaaccctatatatgctgcactgtgttttttcttatacatacatactgtgataaagttcggtttataaatgagacccagtaagagattaacaacaatagctcataataaaataaagcaattataaaaatatactgtaataaaagttgtgtgaatgtcatctctctctctgtctcagaatatcttatttgactgtcctcacccttcttgtgatgatgtgagatgagaaaatgcctacatgataagatgacccgaggtgaatgatacaggattgtgtatagtgcttaacacttatgaattgtttatttctggaattttccatttaatattttaggacggtgggtaactgaaacctcagagagcaaaattgcagaaagtaaaactgtgataaggggggactattgaattatagctttatcgccaatggtaaacatttagtgaacaatgtcctattgtgccactagggtaggcagaattctaaggatgcccccactgagccctgtatatttccttctcctttcagtgtggatggaatctgtaaatatgagatgtctctcctgtgattatgtcacttatatggtaagaggaaggtaatctgggtagcccaatctatcccatgagccctttataaccagagaggttaatctggctggtagtagagggggaagtcagataaattggaaaagcaagaaaaattcactgctgtgttgctgaaggaagaaagagggaccatgtgacaagaagtggtggcctctagaaagggaaagaggcccttggctggcagcaggaaacaagaaatgagcctcagtcttgcaagcacaaagaactgaatgaattctgccaacacctgcatgacacagaaggtagagtctggccctgggcttccagacgagagccctgccttgctgacacctgtgagaccctgagcacagaacctggtcagacactctgggtaggacctgaaaccaacagagctgtgagctaacacatgaggatcgttttaagtagctaagtttgccataattcctaacagaaatagaagactaaatagagccatcctacaactccaactatgtttgaaaaagtgacaccaaaaaacttgacttattcttttttatttcatataatttcacagttttttgttaccattatgaccagggttttttgtttgtttgtttgtttgttttgttttgttttgagacagcgtcttgctctgtggccaggctgggtgtagtggcacgatctcagctcactgcaacctttgcctcctgggttcaagcaattcccctgcctcatcctcccgagtagctgagaatacaggctcatgtcaccacgcccagctaatttttgaattttcagaagagatggggtttcaccatgttagccaggatggtcttgatctcttgacctcgtgatctgcccgcctcagcctcctaaagtgctgggattacaggcgtgagccactgcgcccagccaataagaatgtttttataagctttaatgcttccacacaaattcccattaaaacttttctccactacctgtgataacagttgggtccctatttcaagtggattgactccaggtagcctttggagtttctcaggtcagcaaacgcaacagtagttgacagccaaggaaagagaagtgataggaaaagagacgggcagcctcactctgaggactggaaagaaaatccaattctttgcttcttttctccgcccttgtcacttgcacagcagcccatagctctggtgaaaggggaagataaggtggctctctccttaagatggtgcactcgaaactcctgactgcaccaagtcctaatcctgactcaaattgccattctttgagcaattaagacaattgctgttgctattctcttaattactcaaataagctaaaacctctctttaattcttaaacagcttccatttagattttagtcaactaggatactgaataatagtttttaagcgaaatttatggaagcgattaaacaatttcagcagttcagtctgaaaccaatttaggcctttaagcaggctcatcttcctcccccacaaaattagacaccaagtggccaaagttaacatttcttttattaacccaagttacagaacatactattggaataacatcaaaatgttgtcttcaaaaaactattctacaccattgccagaactgacttctggcagatgacaaattgttagtttggctgccctaagtgtattttagctccctggcaacaatttgctaggctcagtccatttcccaatattatctttaaaaacagagttctataatagtatccatttcccaccactaataagaaaaaataagatctagcaatagtcccaattccatttctttatgccttctgtgcagctaagcaagatcacataaagtcaaaagtgatagtgtagaaatgccagagtcacccataaagccagtgacaaaaatggacctggagaacaaagtgttcagcaactgaagaagtgaaaataaacaaggatgttaagtcgaaaaagacgtgaagacagatatctggaaggtgcttttaggagtaccatatccttcaaacacatacccaagggcacagaacactgtctgatgcagcactgcacgcagcgatcaacgccgtgctgcagtccatggtatttcagctgaaaggaacaagagtcccaattaaaacaggcttaaactggaaggacatgtattatctcacataggaaggctggggaaagggtaactccaggttgttgattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggcgtttggctggatttattgtttataacataatttattttgagttttaatgtggaatttaaaactgacattcattgtgataagttctctatttgtcttatctgtgccatattatttcatgatttttattttttaatcttaccaggtttgaatctgaaaaaagcctggtataaagggagatagagtgggaccagattatgcagggatttgctggccattttaagaatttaggatttgttttagttcaatggggaggcattgaattgttttgaacagggtactccttgattcattatacatcttaagatcaatccaaccattacaaaggaggttggaggaaagaatggaggcagtaagaccagttaggaggatgtcaattgtagtacacgtaatcagcgaaggtgacctggattgggtggtagcaatggtcagagagggaagtgaattactccagtttaagatctgacagctacagacttgcctatgaatcgggtgtatggcaggcagccaggaggagactcaaagatgatatttgttttggttgatggcattactctctgggtaacggagaggcctgaggaggaggagaattcatttgcagggcagacagcatcaacagttaatattttagacacgtaaattgaagataatctgggaaaactgccaagtgcatgtcatgtcagctattgggcatgtgagttagctactgctcagagcagaagtctagactagagataaatgtgggtgtcatcaaccaactgagctccaaaaaatgccaacagtagaggccaagtaaaggcagagcagccaccaaaggagaataagggacagacaatgcggtgggagggatattacgataatcgtttttctggtgtcaagagagactattttctcagaatttggacccaggagagatgacagaaattgtcattggatttattattacggaagttattgctatcttaaggagagcatttttcattggagtaataaaggcaaaaggcaggttgaagtggttacaaagtgaataggacgggaggcagtagaggcattatgtggtgacattaagcggaagtttggctgaacgagagaaatggaatttttttggcatcacttgaaaagaccgtatcagtccataaatgctcaatgaaggtgtagaatgaatcttaacaaatagttatcagtgttgatacaaaaatgaatgcatgtctgagatatatattactgtctgaacagaagtattaatattgaattcaatgtatttctataattgaaggaacctagaaacagcagtatgttgcaaagaatggaacaacttagagttatttgccgttcagttgctgagctctgtccaagagcaccctgattgctgggctctgtaccatgatcttttcaactgccttcatgaccgtctcaatccatcttgcaccacagtcttattacagatcttcatgtgagcatcattcatcatataatgctctaggatccagaagggaagaatggtgttgtttgagtactactccttcacagtagaattggacaaaccatttaccatgtctaatctcaatgacatattctaaaaataaaaaagttaacattattagactaggctttcttttattttcctttttatttatactttcctatataaataatgcatattatacagggtcattttaatgcatgatttatataatgatagtttatagtagaacttttttcctgtctaaaattttagattatatgacttcaaataatatgtttcattttccacaaagaagaggtattataccaattatatttcttatatcatcttgattgtgaatatttaaatgaatgcaaacataaagaaaatgcaattaaattgaagatcaacaaccatttcctgagaatcattttatgaaatcatttaggaaaattcattttattatacgcaaataggttctgaggagcatttaactttgaggctgaatagtgatgatataatcaagagcatataatttggacatttatcatttcaatgtagagaaactgctgctcttatttaaagataatacatatcagtttatagattttatatctccctgtaagtacattaccataatcatatgtcaatataatatcactaattatagttacattagaaggtaagtaattggcatgcatttaaaaactaattactgagttttattgccactgaaactctttgaataaattcagctattgggggaaaagaattgacgctgctgtgaaagttgattatatgaaatgggtcattttgtcatacccaagtaaatcgaggggctggggaaaaagcactcagggcatgtagcacctttttcaagaactgaattttcctcaagcctagctgctgaaatggcctgctgtcaccctaagaccagtgttacctagtaaatgctgaaacaacctgctgtgacaccaagagttctacctgctgccctcactcaccaatcagagcttgccagctcccaaaagcttctctagtgccaatgagccttctttcaaaacaatacataacatttctttcttttttttgagatagagtcttactttgttgtccaggctagagtgcaatggtacgatcttggctcactgcaacctctgcctcccaggttcaaatgattctcatgcctcagcctccagaatagctgggattacaggcgtgcgccaccacacctggctaatttttgtatttttagtagagacgggatttgatcatgttggccaggctggtctcgaaatcctggcctcaagtgatctgcctgccttggcctcccaaagtgctgggattaccggcgtgagccactgcgcccaccgacgtttctctttctaataaaactcccaactttctctttgttctttggagatatgccccaaattgcaattctgtgattgccccaaaaaccatttaatttagagattcatctctgtatttattttgacccaacactgtgctcaaataaaaattgcctatggaagtggaatagattgcagtctccagttttgttttacaagggtatgtgttatagaaagttaaatgtgttgacttttttctcagtcataatatcatcttgtttatataaaaatagagaaaataattacagaaaactttatgcccacattccttttgtttttatatcttagttatggaaagaaatcattgttttttgatgattcataaagctcactctagtttcgtgataacaaagcattacttgggtttcaaacaatgttacataaaccacagtaaatatacttatataaaattaagcatagctctgcttgtcttcttgggaattgacttgaggtgtattaaaatttacattttctattttgcaaatcagaagaagcaaggaggaaagaaaaggataaaatgaatacatatcattatacaaattagtatgttaaattattttcctctctatgccaagcaggaaatgttgtcaacacatcagcaaaccagacattgtactctaaaatttgactggcaacatttattgtggaaactccagtggttggtatagcctaactttacgtaatgatctccattatcgtttaggtttgcttaagtggtattttaagaaaatgtgacttgttacagcatacacgaagatctgtttcttatctgagtataatttacataaattataattttcatgaaacattaaccttcacttttgtgtgttcctttatttcagttgattatagtttttatgtaaatcatcctactaaatctgtttgtaattttaaaatttcactttgttctgatttaagtctgttttgcttttgtgccacaagctattatttcttggataagggcttttttccagcgtgggtttttatcatatcttcatatttaaataaaattactaaggaagtagtaattataataacaaagctaatatagccagtaatactgtggagaaaatgtgaaggtactgtgaactgtagggctggctgggcgcggtggctcacgcctataatcccagcactttaggaaggccaaggaagacagatcaccggaggtcaggtgtttgagaccagactggccaacatgttgaaaccctgtctctactaaaaatacaaaatattagccgggtgtggtggtgggcacctgtagtcccagctactcaggaggctgaggcaggagaattgcttgaactgggaggcggagattgcagtgagcggagatcttgccactgcccttcagcctgggtgacagagtgagattccgtcttaaaaaaaaaaaaaaaaaattagtaagggctgctcaaaagatcttttgcccaggatgaggatttctcaacacagaggctgggaaacctttacccaggcaatttttcttcagtgtccaatattgaaactagtacaagggttgatttaaaaataaaccttgtaattgtttcattatagaagctcctcaacttgcaatggcttgccttctacaaagccatggcaagtcggggaccctctgtatttcctaaagaggaaagtgcacagtgtgaggatgaatcctgagattcctgtggaaccacaagagagagaaaaactctttgcaagtggcagccacagcctcttaagccaagggtaggacctgagccagaggtgggaccctaggcagggcagggcctaagataggcatgagcaacctggggaaatcatgatgcacatatataagcaatgtggtgctgcttatatctgtgaatatgcccataaaattcaagaggatatagatttaaatataatgtgaaagatacgtttgtattccatgtagaattcgttgcttccagtgaattggattatttgtttattcctggacactcagcacattttcctgctcctggactgctgctctttttgaaattcttgctctcaatctccatatgttcataaaagtttatttattttaaggttcagacccacttcattttcctatgtgaaaataggaaatagtccctgatgccttaaagtaattcttccccattgatgaccctccaaataattttgttgcactttgctactggcacattactttctatcacatattgttatttatgtatgaaaacccctatagcatatagattaaacgtgtgggctctgaattcaaattacagccttgccacttctcggctgtggaactctaggcacgttaattaacctttctcttcctcagcttcctcatgggtaaataggaaaatactacctgcgttgcaggggtctgagtattaaacaagttaggatacatcaaagagcatgtcactttcacctgtgtttttctgcaccccagctgacacagggccttgcatataattaggttctcagactcatgaaacaactgggaacatactgatttctaggaattagaaggttcattttaaatatttaaagcttttaatttttctgtaaatatcctgactaccttagaaacaaataatacaagatacaatttttatacataaaatctagagaattagttaaattactattacttaaaatatatgggtgtatgcaattttcagaaggactttttttcttttttgatttgaagactaatattgctttctagttttaaaataagcctgctaatttgtaattgctttgaaaaacatattttgtttataggaacataatgaaattgtgatagcctcagaaaagtagggaaagagttgggcctatttttctacctgtaactcaaacatctgcaaaaattctgcaagaaagaacaaaatccatatgttctttaatatctaggctaaatgtttattttgtttggtgtcacttattttacttctgctcctgatacatctttgttttttgtttagggcctgaaggggctctttttgaacattcagtggagacaccccttgtcagagccgacccgtttcaagaccttaggtaagaatttttgttcaaatattaacaacctctcctgtagaagacaagagggtatgtgctggaataatgttagcagtgactacttcctgactgtttcttatttcatcagttgcctttattttcaagactttccgcttataactagatagtatttattaaaatccaaaggaggtcaaaaagtcctactgactccacacttggtgcctgttcacagcctcctccttcctcctccttcttcctctccaatctgcctctcacactggtatcaaaatgactttgctaaatgcaagctggttaaaatgcttcatcgctcccacatcacatcagccataggaaaatcctaagtgctccactgggcacccacagcccttcatagtctgggctgtgactggcgggacctcctcccctaccctgtcacccagacatgagtgactgccatatcctcgcccacccatcccacaccatcccctctgtgcttttgcactgactgttgcatctccctggggtgcccccctccccgaggagacctcatgaatgtctgctcatccctcaagtgttaattgagatgctacaggtttatgattcatatattttacaaacctattattttctcctgaaaagtgtcagcatacgtttcctgaagttttttacaattcttaacacaaagcatgtgcatatatatattacattatccatctctacactatctgcaaacaaggcaaaacctttgcactttttagtggaagacaaaggtgccttatgtggccgtgaaatgtgcaaaaggcactcttgaaaatgtcagtttactttaaatttttaaaagatatatgcactattagtagtgaaaataacattataaaaaccaagtgcacaataaatccatatttgcaaaatagttggaaacatttagtgtatctcttttttaatttgtagtaacatgcacataacataaaattcaccatcttaaccatttttagtgtacagttcagtagtcttaagtacattcatattacttcgtggtcattaccaccatccatctccagaactctttttatctcgcaaaactgaaaccctgtatccatttaacaagtcctcattctcttctcccggtcaccccggcactcaccattctactttctgtctctgtggatttgactaatctgggtgcctctcatatgagcgaaataatacagttttttccttttgtgcctagtttatccgacttagcatactttcctcaccctttggtatatctgtacataataccctgaatatataaaaatcacccagttccatacataaatttattattttttacagaatctttgtgtctatgtgtattttaccttaccactaggctactgaatgtcatttacacctataactattcattccaataatatatttgtattttataacaaaaccaaataatattttaaatggtcttaaagttcatgctatcacttaaaatcacatttagaatttaaacttgaagtgaatgcaggacaattaatatattttaataaattatgtataatagggaatacaaggtacagtaggaatcccagctttacacagacaagccggctgaccatggccaaactaacctttccagactattttttctcatattaaacattactgatagtaatccttacctcagagtattctaggaaagatttaataagatattatgttaaaagcattttgtaaactgaaaagtcaaacacagacaatcttttattttttttttttttgagatggaattttgctcttgtttgccgagaccagctcggtcagggagaccctaacccagcagtgttagaggaattaaagacacatacacagaaatatagaggtgtgaagtgggaaatcaggggtctcacagccttcagagctgacagccccgaacagagatttacccacatatttattaacagcaagcgagtcattagcatggtttctatagatattagattaacaaaaagtattccttacgggaaacaaagggataggctgaaataaagggatggttgggctagttatctgcagcaggagcatgtccttaaggcacagattgctcatgctattgtttgtggtttaagaacgcctttaagcggttttctgccctgggtgggccaggttttccttgacctcattctggtaaacccacaaccttccagcgtgggcgttatggccatcatgaacatgtcacagtgttgcagagattttgcttatggccagttttggggccagtttaaggccagattttggggggcctgttcccaacattgttgcctaggctggagtgcaatggcacactctcggcttactgcaacctctgcctcccggattcaagcgattctcctgcctcagcctcctgagtagctgggattacaggtgcccacgaccacacctggctaatttttgtatttttagtagagacggggtttcatcatgttggtcaggctggtcttgaactcctgagctcaggtgatctgctcaccttggcctcccaaagtgctgggattacaggcatgagccaccgcggccagccaacaatcactttttaaattgttattatacagccggccatggtggctcacacctgtaatcccagcactttgggaggccgaggcaggtggatcacctgaggtcaggagtttgagaccaccctggccaatgtgatgaaaccccatctctactaaaaatacaaaaattagccaggcgtggtggcacatgcctgtaatcccagctactcagaaggctgaggcatgagaattgcttgaacctgggaggcagagtttgcagtgagccaagaccatgccactgcacttcagcctgggcgacagagccagactccgtctttttatcaagggaaaaaaaaattgttattatactacatagatattctccctaaataataaaggattaggaaaagcagcattttttatatatttaatgtccaattaaatattcatcaaaagcaaataggagttcaatttatcttacccacaaagtgaacatttgtaacataaaaatagattgtgactataattaaattataacaaggtttaattttgaaaatggataaaaagattaacattaaagaatttttatagagaagaaaaacattttattttcctaggttagaaaaatcattcaaatctgtggaaataatcccattaaagccaatttaaaattataaaataatatagattgtagaaatgccaaaacacttttaaagtaaatgtcaatttaaaaaatatatagatctcaattaaataattcatctcatgttatcccattaaatcttctcactgtatatacggcaggctcttactgaaaaagaaacggcacaagagtattcttttgctttctaaaaggcggtactgaggaaggattgagcaacttgagtgttaaaaccaaggcaattgaaaaaaataacaaaactgcaaggaaatgctcgaggagtgtggtgaggatgggaggtgggaactaacattcactgaatgcttttgactgccaggaactgtgctcagtgctgtcacagaatttgtttcatttaattatgaagtgattggcaattttatccccattttataaaggcagaaactcagatctagatagttccatgttgtaagtcacaaaactaaaaaggtagccactcataatcgaatccagctttgactccagagcccatgtacatccagtttgctgtctccaccacccagcggatccttgagagattgattctttgatttacactgagatgcctctgactgattatatgatggtcatatcttcttcttctgcaacttcttgccatcaactatgttccactttttatttctggttccagcagcattactattcctggcctgattacagtaaaaagattctggaatatcttagttggcatatatatatatatatatatatatatatatatatatatatatatatatattttttttttttttttagtcggagtctcactctgtccccaggctggggtgcagtggcgcgatctcggctcactgcaagctccacctcccaggttcacaccattctcctgcctcagcctcctgagtagctgagatgacaggtgcctgccaccatgcctggctaattttttgtatttttagcagagatggggtttcactgtgttagccaggatggtcttgacctcctgacctcgtgatctgcccgcctcggcctcccaaagtgctgggattacaggcgttagccaccgtgcccggccttagatttacatttcttatggcaaaatcatttgcaaggaaagtatgaacgctgacaaactaccttaaagcaaccttgcattcacacatgatgtaattcattcttttttaaaaagtcagcaaaagtgtattaaagtgtttatgtgccagatataaaaggcatggtcgttgacctcaatgagtttacagtctattgagaaaagaaacttgcaaacaagttagaaaagtatatttaactgctatgataaaagtacaacttctattggaggcataggcaaataaatataaaatcttcccagggtaatctgggatgataccccagaaaagggaggagttgaattctgtgtaacaccataaggatgtgatgtcaattaagtaagttattatttccacgtctgttcatctacttatctaaggaagatacacatatactactgtgtggatggaaacatttgcacctgttgcaagcacttgcaaatacgaaagtttacctagtaagtgtttataaatactaagctcagttagaaaccaagaaagggtaattcccaggtcccaacaataaagaggcagctcatggtcagagtagaggaagagttaagctaagctactcatagagaaatcaggatacatagagactagctgctgagacattaatgctgatgtgggagtgagattccaagtgattgttcagtgtgcatgaaacaccctggctgagaaacctccgaaatcctgacctcccatgaatcaggtatttcacacaatatgcccatcagcccaacgatgtcacaagaaagattgctattttaggccatgggttgaaaaattacccacaagaaatcatgacctgcaagccgttgcctggccgaggtagaagcaaacgcatactacttcacggtataggaactccgaggtggcaaattaacagtaaaaactgcaccaaagtctgtgaaactcatagaaccatttaaaaacagagagaaacgacattgaagaagttatcccatcacacatgacataaagacacttaaggaaaacaatacctgctaatgactagtttactaaaaaaaaaaaaaaaaaaaaaaagggccgggcgcggtggctcacgcctgtaatcccagcactttgggaggccgaggcgggcagatcatgaggtcaggagatcaagaccatcctggctaacacggtgaaaccccatctctacgaaaaatacaaaagaattagccgggtgtggtggcaggcacctgtagttccagctactcaggaggctgaggcaggagaatggcgtgaacccaggaggcagagcttgcagtgagccgagaccacgccactgcactccagcctgggcgacagagcgagactccatctcaaaaaaaaggaattgaactaccatggagaagaattagaattagcagctgctacaaataatctcctggaactgttatgtcatagagcaaagcaaagagatttttagaacaagtataaataaaatgctcaaatgaggaaaaaaatgaatagaaatgagggaaaaaatgaatagaaatgtaagacaaagacaagatattttgaaaaatggcagatttgggaaataacaaaatagaaattatagaaatgagacatgaagtaattaaaataaaatcactggcccccagaactttgtttctcataccattctccaaggaaccgggacttcttagagaagtggctgatcccagggctgggccagggaatggtgaagatggggcttggagcagcctaaagttcagggaaatgctaaccaaaagaaagtaggcatcgcgatattaatagcagacagaatcaaaattaggaaagaaatagcattaataagaatcaatggggtccggcgcggtggctcacgcctgtaatcccagcactttggaaggccgaggcgggtggattacctgaggtcgggagtttgagaccagcctggccaacatggagaaaccctgtctctactaaaaatagaaaaattagccaggcatacatagtggtgcacacttgtaatcccagctacttgggaggctgaggtagaagaattcgcttgaacccgggaggcagaggttgcagtgagctgaaatcacaccactgcactccagcctgggcaacagagcaagactccatctcaaaaaaaaaaagaaaagaaaaaaaatcaatgggaacactacttgatgataaaaggaaatatttaccaagtcagtttagcaatgatgaccttttatggtttaaataacataaatcattttgaaataaaattattttcattactttttaaaacgtacggatggaatctaagaagcatggatatttgatgcccaccatcaaagaactgaaaaacatacaaacaagctcttcttatggagtcagaaaagttttctttttgtccttgacctaatacttacagttcacttacccaaaattttttcccaatatacactacttagtgattgacagtatttcattgatcactctatcctatttctccacaagaaatatatttatataattatatatataattacttctagtgactatagaatttttaaaatttcttttggatagagtcataatttaaggagaaaacaattgatcaaaacagtatagctgtagtcaccctacagtgctatagcacactagaacttattcttcctatgtaagttgtaattttgtatctattagccagcccctccctatcctctcctcctcccattattgtatattttcaaataactaaaggagagaatttcagatgttcccaacataaagaaatcataaatgcttgaagtgataaatatgccaattactctgatttgattattacatattgtgtatatgtatcaaaatatcactctgtactccataaatatgttcatttattacatatcaattaaaaataatttttaaaagaaaaaatcaatatattaagatttttgatagtaacaaaaagtaaaattgtataaaactacatcttttagtgaatggttggaactttttaaaaactatttgatagatctgctaataaatatagcttattaatagaaggagtcaagatcaggcatcaatatctttcctgttttttaagtagatgtcccaaggagcctgttcacataagtaagtaggtatgaatcaaaaagttttattttttaaaaagtcactctacgttctgaactcttccctaaatatacaccattaaaagttatttgtaatgactatcggcgacaattcattaggtctttcttcaatttttgttgaaagtaaagaattagaaactgtgtaacttgccaaatgattacctcgtaatcactgtagtcattcaatttgtcaattctgtcaccaattttttaattttcccttgcacattacccctggaagtatttctaccccagtgtaatacatcataatcgattcagaatcaatgagcatgtctttctttataaagtgggagaaggagattgttaaaaaggatctgggaaggggaacccctgcaagctcccagcctggcagttcagggcaacagtcctcttctgcccctgatgaagtaactgggactggatgcaccatctctggtaaccaggagaacacttgacaaatatatgaaacaaccactttcagacactggatagcacgaagtgcaaaacaagacagaaactaatgaggtgagccctacacttgcccgagctctctgcccacaggcatgttcagaatcagggcacagggaaggggaatccagtcagtgcacgggaacctctgggagtggaggagaaagagatccgagagtggggagttgaggctaatggagtctgtggggcacaggatcagagaagagggcatatgccaggaaagagctccggaaatcacatacaagttcccaggtatgcacgtatcagaggtttttcaactgctcccctatatatgggcacctgatttatttacaatgtgcttgtgcaggtaaattttcatattgttggagatatagctccatgataaattcctggaagaggaatccatgggtgaaaaagataaatgcacatattgtttactcagataatgccaaattcccctttcggtgactttcccctccattgaggtataccaatttgcacactagcattgttacaataaattctattttcctttccccatggctcccaacacaatgtgttttaaatattttaaattttgccaatctgatagattagaaattacatctcattatagtttacatttctcttaatatgagtgaggtggagcaacttttcatatgtttaaaggccatttttgtattcctttctgtgaattgtttgtctttttctactttttaaaaatacttttcctctcaatttttaagacttctttaaatattgggaatattagcccttcatccctgatatatgttttaaataatttttcccagcttcagttggtttttgacttattgtactttatgctgtgcaaactttttaatgcttacatactcatgtttattaatcttttttattgtatctggattttaagtttgaatttaacatgtttcttgcatggctttatcttttacaattagacctctgatccacttagagttgattattgtgtgaggtatgaggtataaggtgtgaggtctaattctaattttatcttttccagttggccaaccagatgtgccagcaactagattatttattacaaactctactttttcccgtgtgatttgaaatacaacctttaccaccaaatgtctctatacacttggggctgttcctgcaattgtaattctattgcaccggtctctccattcatgagccagtaaggagtctgttaactaaataggctttttttttttggcggcggggaggggagcggatggagtcttgctctgttgcccaggctggagtgcagtggcaggatcccagctcactgcagcctctgcctcctgggttcaagcgattctcctgcctcagcctcctgagtagctggtattacaggagcctgccatcatgcatggctaatttttgtattttgtttgtttgtttgtttgtttgtttttggtagagaccgggttttgccatgttggccaggctggtctcgatctcctggcctcagatgatccactcgccttggcctgccaaagtgctgggattacagagaagatattttaatgtctggtaggactagttgtgcacacatgcgtgcacgtgctcacaggcttgcacgtgctcacaggcgtgcacgtgctcacacacacacacacacaagactttgtacatcattgaacattagtctgcctattcttggttatgtatttttgcacatgaacttgagtattaacttgtcgacttccagaaaacttattttgtattaggattatattaagtttttaaattaccttagggaaaactgacaacttactgtgttgagtcatctacccaagaacagggggtgtctttccatttgttcaaagctacttctatacctctcaggagcattgaaaagttttcttcatatgtgttttccacatttatttgttgctattaaaaggaggtttattacatcatcattattccctgttactgttttagatatgaaggctattgattcctgtgtgttaattttatatctcactaccttactaaaccttttatggtttggatccatttgatgattgattcactgggattttccaagtatactatcagatcatttgcaaataggtatagttttacaccttattttccaagtataatatctctaatcaatttctcttggctaattggatttcccaatgtcctcaatgcaatgtgagaaagaaatggagatagtaagcatcactgcctttttccagtcaaagtggaaatgcctctggtatttctccattaaccaaaatgatgtgaatgtgtgttttataaagaaagcacatatcaatttctattttgtgttgaatgggtattgaatttagtaagacagtctttagtaattacagagatagtcatgtatgtctcttagatatattaatatggggtattacattaatggattttctaatactgaaccaatcttgcattctgagaataaatcctactttggccatgaaatatcatacacataactcatattagtctgcatttctttttgttcttgctctgctgcctgcccaggctaaagtgcaagaacacgatctcagcttactgcagcctccagctgcagggttcaagcgattctcccacctcagcctccaagtagctaggactacaggaatgcactacaattattattattattattattgtgagacagggtcttgctgtgttgcccagtctggtcttgaactcccggcctcaagtgatcctcccacctcacctcccaaagtgctgggattactggtgtcagccactgtgcctggctatgctatgattataaagtttaagtaaccctgttactcttggttcaataattaggaagtttttcctcattttcaatgttctggaataatttgtggagtattgggatgttctggtctctaaaggtttgatggaattttctctggaaccatatgggcctgatgaaatttttaaagacagtgttttaatattaatagtgtatttcttcttttatggaaaattgtgtttaagctttctaactttaatgggagttgattttggccaactgtatttccctaggaaattattcacttaatctaagtttttaactgtatttgtgtagtggtctgaaagtagtctcataggaatttttaaattcctgttgttttcatggttttatacagctcattgataaaaatcaatgtctataaatacaagtgatcactgaagtgatctaacactgttcgcataatcacatccttagttccaagtatgtatattttatttgtcacaagttaatatcttaagtcttcttaacttgaacaatgaaaacaatttattccttctggtaactgacaacttatggtgtggcttattttccttaattctagcaattccaagaaaaaggaaaaaaatacaaaatgtcagaaaaaaaagtacatatcatcaattcaacaactggaaacagtttcaggattgaaagtttcatccagtaacagaagagcacagtcagtgctcatacaagaattcactgatgacatcttgggctcctgagctataaagtgctgttaaatccagaatgtgaaatacattatgtgaaaagtaatactccaaatgtaaatgtataagttgcccttttcaagaaggacttacaaatatattagatttaattttcttttagctaaacagaactttttaagatttagtattttttcttaacaaacagaagcttctaattccttttaagattaacaagtaagatgcaaaatactaaacaaagttactgaaacagaggtattaaggacaaactgaacttttatagttcactgacttctgcagtaattaaaagtctgagactcccctgaagactgaattgggtatgtcatagatgtttaatcatagccatcttatctgagtgacattagttactctatagtgcaacataatctttcacaaatttctgttcattgcagtgtcattccattcccttgtagacctcagatattagtagtctttttttctgtgaagtacagtcttgatgagcttagaagtgtattttatatttttcgtgagttaaaaaaagttatcttttttcaagacagaagtacactttacagaaataatgaaatcccaggagtgatttggattactgtgggatggtgccagcactggctgtgggcagtacttagaactatgccctgttatgcatcttttaggagataggttctacagaactgtatgggtttttttcaaggttctaatgaaaggtgattcaattcaaagaaaatattagaagtcagtacagatgcatgggagaagaaatatagggcaataatattaatatcaatgtatcaaattatatctgtatttaaaagcatggattccataaattcaagtgaaatactttaatttcaaggctcatcattgtcataaatcataaagaatatcataaatacataactattaaaatgcaggcatttattgtgtaaatacaactacatatagacagtagtatctttgcatagttcattattaaaccaaaacacaagtttttatgtacaaaaacattccgtagagaagtgagaaaataaaaataaaaacccacatatgggtctctataaatgtcaacattacacctatgtgtaatgttacattatgttgtggtcaagtctaacaagaagtggattgctgaagatcgtgaatgcttcactggttaatcatgaatttatagacactgatctttctctggagagtatttggccagtatgaaagttaatttatccttgtagtattctatgaaaataaactttcaggaacttgggtgttttagaaaccactgcttgggcactaaggagggaatgagttctttcaaaaacatttttgtttttgtattcagttctttaatcagacaagaagttatttttcatgtggatgtgaagtaggcaaataattttcttttgctttctgagtgggaatacccagttgtctcaaaagtcagtccattccttctttatccgtaatgctatttttgtcatatataaagctatttttaatgggtgccctattctcgtctgttgttctggcttttttcttcttaaaccagtatctccctaatagctgtacaatgcatctggtacctgctagggcaagtgtccccaccatgtcttcttcagagttgtattggctgtttttagacatttatttttcatgtaatttttttttttgagacagagtctcactctgtcatccaggctggagtgcaatggcatgatctcagctcactgcagcctccacctcctgggtttaagtgattctcccaccttagcgccctgagtagctggaattgcaggtgcatgccaccatgtccagctaatttttgtatttttgtagagacgcggtttcatcatgttggccaggctggtttcaaactcctgacctcaagtgattcactcacgttggcctcccagagtgctgggattgcaggtgtgaactaccatgcctggactgtttttcatgtaaattttaaaatcaatttttcaggttttttgaaaaactctcctggtttttttttattggaattacactgaattcatgcctttataatcgtgaagtctcttgtccataaatatggtatatctctctattcacacagccttttatatgtcctttaatattttatgatattctccatttaggtttggcccataattattagaattcattaccagggtgtttatagtttttgtttctattgagaatgggttcttttttctgttaaattttcaaagtgattattattgattttttcatgatagtttttaagccagcaactttactgatcattgttattagtttacatatatatgtatataaaaatacatacatatgccgagagagagagagagagaaagaggaagatggggtcttgttatattgtccaggctggccttgaactcctgggctcaaatgatccttctgcctcaaatgatccttctgcctcagcctcccaagtagctggaactacagatgcacaccaccatacccagcttagttttaatattttgattgtagaactcaactgatttttccattaagatgatgatagtgccgaaaaaagagtcatcctttttattattatacttcttacttctcagatccctgtattgttactttggctgggacaaatgttggctagaaagagtaacgatggacatctgtgtttacttcctgactttgagaaatgcttctaaattttttaaatgaaattatgtctgctataggtttttggtaaatattaatacctattatcaaattaagaaagttccattttggtctaagtacccacctctcctttttctttcaaacagtgtgtgtaagagcaatcaaaggtttggtgtaaactcacatatgaaatgaaagagccagtacattttggggaagttggattatttacacttccacttcaatgtatttaatgaagtttctcttttcaagttttgtacatcttcaggtccattttggttgtttccttgctagaaatttttccttgttactcattatgagcatataattattcataattattcataaatgtttatgctaaaagcatgttatcttttgctttaatgcaaggtttgtatgtaagcggctactaggtcaatcttgcaaattacattgttaacatcttctatatacttagtatttttgccttgtttttctctttttttttttttttttttttttttttagacggagtcttgctctgttgcccaggctggagtgcagtgacacgatctcggctcactgcaagctccgcctcctgggttcacgccattctcctgcctcagcctcccaagtagctgggactacaggcgcccgccaccacacccgggtaattttttgtatttttagtagagacggggtttcaccctattagccagggtggtctcgatctcctgacctcatgatctgcccgcctcggcctcccaaagtgctgggattacaggcgtgagccaccgcgccgggcctgaattcttccttttaatcataagtaatgttacccttttgcccttattttgtctggtattacaattgctatacctggtcctactttcttttgcactgatttacattttccaagtgttttattttcaatatgtttgcagcattatgtttcagttgtttctctatgtttcaaattttttggtttgagattttcttttaatgggttaatttagcccatttatatttattatggtaactggtttatttgccacatttctatcattttgttttatttaccatgctttttcttttcattttttctcctttttctttttttgttggattaataaacttttcctcctctccacccatatttcccccaatagttctatttttattctttcaatgattgtcttttgtttatatgcacagacacaaattaatacttgtcaaccaagtctacatcaataccaccttcttcccaaataatatttttaaaaacttagtcacttccatccaaacttccctttcattgtggttttatttcagcattgcttttattcatctccctgctttattttttcaggccatatctatttagctttaccagcacattttgtaatgtccactgcttcttcttggaaacattcttttcttcttatttaatttccataagtacattttttggtgaagatctatagattgtacatttgttccctgtgtctgaaatgtccagtttcctttatagtcaagtgctggttaggctgagccagatttctatctaggctgacaataattttacacgagtattttaaaatatattactcattagtgcacttttgattctttagagatcatgtgattttcattctgaattcttttaagattttattgttaatgttggccatctgcagtttcaccacggtgtctggtatgtgttagtttatacttgagtatcagtgaacttcttcagttcttcagtttcagaaactcatgttctttttcaattttggaaaattattagccatagttcttcatatgtatgtcttcctcattctctagagggtagaggtttttcacttgtagtctgtggaccccatcaagagaccttttcactggggtggtagcgagctccctccttccccttgataaagtcacttttcttcagccttcacctataaggtgtctgactactcctacaggacaactggcttggtgctcggcacgttggcctggggtagagatgagggcaaagtgaggctgacatgtgctacttatactgaggtgttcgatgaggaatcagcctctgatcccaaacacctcatgtgcgtattcaggataaaattactaaagatgagtacaaaaacccaacagttcctaaatgatgcaaggtcactttcaacatattttcagttatctttctatctaatttctcaaattagaaaatagatttttttcattgaaattattgttctttctcctctgacctccaaaccccccaccgtgaccctttctggacagatcacttaggtcagctgacaactcctttcaacttttctcctgcccagttctctaatttgctgtaaatgtgcatgttttcgttgcttttttgcaaccttatagaagaaggtgagcctcatcgtttccaaggttgcatctgccacctatgtccttggtgccatcccctcccataatcaccttctgtgtctctgcggactctagcttcttctttggctccaagtaatccaggtgcctgcaaatgaaacaatgacaatttattgcatctagattcattcagatgtcatattcatagaatcctttctaagaacctaccaaagggaaatttctataagctaaaattcctcttttaaatacaaagctgtggaaattcaacacagtctctatgccaatttataaaaacccacaagatgctcaatgccagcttcaaaaagcctttcacattcttttccagaggagtaaatccggttgattttggtgttttgaaaactagaaagggactaaattttaagaataattgtacttgaagccatgaagtaagattttaaaaacatattgttaaatatggaagtgttcaccagttttcattttcaatgacattttaataactgtacttctataagatacctcagaaaggcaagtaccacatgttctcacttatagatggaaactaagtgatgtgtacacatggacgtagtgtgtggaatgatagccgtagcaggttgggaggatcagggggtgagggatgagaaatcacttaatgggtacagtgcatgccattcgggcaatggttaactgaaagcccagactttgcctctatgtaatatattcatgtaacaaaacgacacttgtaccccctaaatctatacatatttttaaactgtactgataaatatggagattttcttttatattaaattgtttttccaaatgtgacatttgaaaaaaaatggtgtctccaaaaacatgtattaggtaatactaggaaatttttaaagaaatataaaaatcatgttcagtttagtcttagtgctgagtacatgtattagatttcaagtttttgaaaattggaaatttttgtatggtatgtaaggtgagttacccattcttcagccattgataatcctctgaactgtttcctgaaaataaaagattaggttttcttatcatacttatattcatgcttcctggtctctcatcctatttgtaaaatttgggcttaataagagcctgaaaaagctttaaattgatgcactgttcatatttttcagtaagttttcttcttcttctttttttttttttgagatggagtctcactctgtcatccaggctggagtgcagtggcaggatctcagctcactgcagcctctgcctcctgggttcaagcaattctcctgcctcagcctcccaggtagctgggattacaggcatccaccaccatgcccagctcatttttgtattttaagtggagacagggtttcaccatattggccaggctggtctcaaactcctgacctcaattgatccacctgcctcagcctcccaaagtgttgggattacagacgtgagccactgagcctggccttctctttttttaaaaatgacattaatatgacatgagcaataactattaaggtcatacatgtttgactgttcatagtctataaattcaattaaaaatgaatatggggtaaactttggaaaattactgacttctatttatttttatttaaaaaggagcacaacttaaaactcgcctgctttgtagcagctcagtaccataggaaaaatactactcctgccttagcaatcaagtcaccttaattgtattttttataacaccaattatgatggttagtactgagtctcaacttgattggattgaaggattcaaagtattgatcctggttgtgtctgtgagggtgttggcaaaggagattaacatttgagtcagtgggctggggaaggcagacccacccttaaccccagtgggcacaatctaatcagctgccagcgaatataaagcaggcagaaaaatgtgaaaaggtgagactggcctagcctcccagcctacatctttctctatgctggacgcttcctgcccttgaacatcagactctaagttcttcagttttgagacttggactggctctccttgctcctcagcttgaagacagcctattgtgggaccttgtgatcatgtaagttaatgcttaataaactcccctttatatatatctatatctatatatctatatctgtatctatatagctatatatatagagttttgaacagtatatatatatatagagagagagagagagagttttgaactttgagagatctcacagttgattggtgtattagtcagggttccctagagggacagaactaataagatatggacttggaatatcttacattgatggacatctgtgtttacttcctgactttgagaaatgcttctaaattttttaaatgaaatgatgtctgctataggttatatatatatatatatatatatataatcttattctgtccctaataagatatgtatataagatatatataaaggtatatatatataagatatatatcttattagttctgtccctctagggaaccctgactaatacagatgttagtaccaggagtggttctaaaggaacagaatattaagggtggagttcttgatcacttttcgctcccacaagatatcacactggtccattacattgatgacattatgctgattggatccagtgagcaagaagtggcaaacacactggacttattggtgagatatttgtgtgccagaggatgggaaatacatccaactaaaattcagggaccttctacctcagtaaaatttttaggggtcctgtggtgtggggcctgtcaagatactccttctaaggtgaaggataagttgctgcatttggccccacctgcaaccaagaaaacggcacaatgcctagtgggcctatttggattttggaggcaacacattcctcatttgggtgtgttacttcggcccatttatcgagtgacccaaaaggctgccagtttttagtgaggtccagaacacgagaatgctctgccacaggtccaggctgctgtgaaagctgctctgccgcttgggccatatgactcagcagatccaatggtgcttgaggtgtcagtggcagatagggacgctgtttacagcctttggcaggcccttacaggtgaatcacagtggaggcctctaggattttggagcaaggccctgccatcttctgaagataactactgtccttttgagagacaactcttggcctgttactgggctttggtggaaactggaagtttgactgtgggtcatcaagtcaccatgtgacctgaactgcctatcgtaaactgggtgggtgccttttgacccatctagccataaagtgggtcgtgcacaacagcattccatcatcaaatggatgtggtatatatgcgatcgtgctcgagcaggtcctgaaggcacatgtaagttacatgaggaaatggctcaaatgcccatggtctccccttctgccaccctgccttctcttccccagcctgcaccaatggcctcatggggagttccctatgatcagttgagagaggaagagaagactagggcctggttcacagatggttctgtatgatatgcaggcaccacccaaaagtggacagctgcagcactacagcccctttctaggacatccctgaaggacagcagtgaaggggaatcttcccagtgggcagaactttgagtagtgcacctgattgtgcacttcgcatggaaggagaaatggccagatatgcaattatatactgattcatgggctgtagccaatggtttggctggatggtcagggacttggaagaagcatgattggaaaattggtgacaaagaaatttggggaagagatatgtggatggacctctctgagtggtcaaaaaatgtgaagatatttgtatcccatgtgagtgctcaccaactggtgacctcagcagagaaggattttaataatcaagtggataggatgacccgttctgaggacactactcagtctctttccccagtcacccctgtcattgtccaatagtcccatgaacaaagtggccatggtggcagggatggaggttacgcattggctcagcaacatggacttccgctcaccaaggctattctggctacagccactgctgagtacccagtttgccagtagcagagaccaacactgagcccttgatatggcaccatccttggggtgataagccagctacctggtggcagttggattatattggacctcttccatcatgggaagggcagaggtttgtcctcactggaatagacagtctggatatgggtttgcctatcctgcatgcaatgtttctgccaagactactatctgtagactcatggaatgccttatccaccatcatggtattccacacagcattgcctctgatcaaggcactccctttatggctaaagaagtgcagcagtgggctcatgctcatggaattcactggtcttaccatgttccccatcatcctgaagcagctagattgatagaacggtggaatgttcttttaaagtcacaattacagtgccaactaggtgacaatactttgcagggctggggcagagttctccagaaggccgtgtatgctctgaatcagcgtccaatatgtggtactgtttctcccatagccaggactcatgggtccaggaatcaaggggtggaagtggaagtggcaccactcgccatcaccccagtgatccactagcaaaatttttgcttcctgttcctgcgacattacgttctgctggcctagagatcttagttccagagggaggactgctgccaccaggagacacaacaatgattccattaaattgaaagttaagattgccacctggacactttgggctcctcctatgtttaagtcaacaggctaagaagggagttccaatgttggctggggtgattgacccagactatcaagatgaaatcatttggccgggcgcggtggctcatgcctgtaatcccagcactttgggaggccaaggtgggcagatcatgaggtcaggagattgagaccatcctggctaacacagtgaaagctgtctctaccaagattagccgggcatggtggtaggcacctatagtcctagctacttgggaggctgaggcaggagaatggcgtgaacccaggaggcagagcttgtagtgagccgagaccacaccactgcactgcagcctgggcaacagagtgagactccgtctcaaaaaaaaaagatgaaatcagtctactacaccacagaggtaaggaagaatatgcatggaatacaggagatccattagggcatctcttagtattaccatgccctgtgattaaggtcaatgggaaactacaacagcccaatccaggcagggctacaaacggcccagacctctcaggaatgaaggtttggctcactccaccaggaaaaaagccatgacctgctgaggtgcttgctgaaggcaaagggaatacagaatgggtagttgaagaaggtagtcatcaataccagctacgaacacgtgaccagcttcagaaacggggactgtaattatgagtattttctccttttttttgctgaaaacatacttgtgcatgtatacacttgtactaagaaaatatctttattttcttttcctttatcattttacataagatttattgacttcatagcagcatttaagtattgttaacttatgtaatagtatttgggttggggattggtgcgtttccagttgtaggaaggatagttgtattatgttgggtgtaattatgaccttattatctttatttgaagattatgtgtgatctcaggagatgtgtatgggttcaaggggtggacttgtgatggttaatactgagtgtcaactcgattggattaaaagatacaaagtattggtcctgggtgtgtctgtgagggtgttgccaaaggagattatcattggagttagtgggctggggaaggcagacccacccttaattgggtgggcaccatctaatcagtggccagcaaatataatgcaggcagaaaaatgtgaaaaggctcccagcctacatctttttgtcatgctggatgcttcctgccctcgaacattggactccaagttcttcagttttgagactcggactggctctctttgctccttaagctttcagacagcctattgtgggaccttgtgatcatgtaagttaatacttaataaactccccttcctactagttatgtcctactataactactagttatgtcctactagttatatcctactagttatgtccctctagggaaccctgactaatacaccaatcaactgtgagatctctcaaagtcaacttccaagtcttttgtatacatctttaattgaactaatgagaagagagtgaatcaaattctgaaagcaaagttagtgccttatgtccagtgtcttatgtcctaagaagaaaactgccatgatgggacctaaatatttaatatagaaatatacatatttatatataatatatatttaatattacacacacacataagcatttggatatatttctgtgacactgttcaaaactcttttacttttcattgaagtcataatatttatgtatttacctattcagaaaagagggtaaactaaaatataacaaagacagaaaacaagttattttgtatctgagtactgttcaatgtgttaatggaaatgtatacttcagagcaatcttatctcagccttttggtaaaatgtgtctcaatctgggttgaactgaaatttctcatctccaagtctagaaataatgcaaagggtaagaagtttgctcttcttagcagcgtcccattataacatggttaaaaactagtaaatgatcaggttgaagtcattttgttgtcgtttaatgactgatcttggaaacacccactttcacaaggatcttcaaggtcacagatagtttgcctgaaattgaccaggcttcaaaggtgcttctgtgttcttccttccttccactcctccacgcaagaaaaatgtagacaattatccaaggtcaaaatagcaaactggggccaggcgtggtggctcacgcctgtaatcccagcactttgggaggccaaggcgggtggatcccgaggtcaggagttcgagaccagcctggccaagatggtgaaatcccgtctctactaaaaatacaaaaattagctggacacggtggcgggtgcctgtaaacctaggtacttgggaggctgaggcaggagaatcgcctgaagccaggaggttgtggttgcagtgagccaagaccacaccactgtattctctagcctgggtgacagagcaagactccgtctcaaaaaaaaaaaaaagacaaaaagcaaactgggcaggcagccagaccatgcacatggagctgtaccaaagtgttccccagcctaacttgaccaataaattccataaatgtctctaagcgttttctcatactcaaggtaagacttcaaaatgtggggcaggtcaaacttcacatgctcagaaaatgaaactttgtcttctataacaaatagtcatagattaaaaaaaacttgccaattcaagggagcaatttcatcagatgtaaaaagtctgttaaataaatgttcagtcaatttaagtgcagattcattatcagggtacttctctcttaagccacttccctttctctctgctccctgcccctctcctcccatgaaaccctagcctacaatgggtaggatttccgaattaggtatctttttctgtttgttctgcttcctactgccctttaagcgtttccttgaaatcagcatttcaaactttggggctgagcagctgaaaagtgtttcaaatgatcacattgtgccatctggtggaaatacagccttttccaggcagaggcaagtaagagaattcctctggctcttatatttttggttctctttctatatttggcttaaccacaaggaaagtctgataaattttacaaaaccaaaagccagctgaggccaacctccctcctttcggttctatcagtttagtattttttccaaaagaaatctttccatttgccctgtaatgtttttaaataataataaagaaaagaccaaacttatattctgtcttatgaacatgtggaaaatgcatgtgttgtccttaaatctatctttttttcttaaataaattggtgttttaactaaaaaacaagcctgccacagctggttgagaggccaagccaggaggacctcttgagccgggagttcgattttgcagtgtgccacgatcacaactgtgaagagccactgcactctagcctgggcaacataacgaaaataattttgtatagtaattcataaatggcattttcttctgaaatagtatgccagagtacttaactatgccatcggaaactgctgcatgggattaggactgcctaatgtttttatcggcttttagaggatactaatctcataggctttcattgatacaaagtttatatcttacttcacattatttctagatttatcaatgaataatgcacaatatgttaccatttgagaatgacttgaagacttacatatcttactagttatatttcccatgctaagttgagggattgctggagtggctatttttaatactttttttttttttttttgtgcttcttttcctcatctcagattagaatcccccactcggagtctaagcatggatgccccaaggggtgtgcatattcaagctcacgctgggaaaattgaggcgctttctcaaatggatattctttttcatagtagtgatggaatggtgagttcattcacagatcagcctcctactgtatgtcctgatgatattcctgagtaccatgtctgtaaagctatcagtattaaatttctagtagtttgtaggaaaacattgtgaaggtcatagagtagcaaatgtacaaggaaagcaaaagacaatttagcattgaaagaagggccaagaaagtctaaaattattctgtattagatccagacagctttctttaactggcatttatgctatcaagtgatttagtgacttgttattttcaagtcggaaaaaaaaaacactacagacgttcacagtttacagagaatgtccattttgccatttcctagggatggctgtcactaggagtcacccactaacaaccactgtcacctttcactgcccagagtgctgcgtttaagctgcatttccagtttaaatgaaaatgaaagatgaaaaataagagtgtttttttcaaagtcaactacaataaagataaaatctgggacttcaagtctagaaatacagttgtccccctttattgacaggggatttgttccaagacccctactggaagcctaaaaccacagagagtacagaaccctgtatacactatctgttttcctgtgcatacacacctctgctaaagtttaacttataaataaggctcagtgagagattaagaacaataactcacaataaaatgaagtgattatgacaatatgctagcatcaatgctcttgtgctttggagccattattaattaaaattaacggtgacttgaacacaagtaccacaataacttaacagtggatctcaccgtggagatggctcctcagtgactcacgggctgggagcgtagacagctggagatgctggacacagggatgattcatgtcctgggctggacggctcaagattccatcacgctagtcagaaaggggtgccatttaaaatgtataaattatttctggaattttccatttaatattatccagaccaaagttgacagcagataactaaaatcaaaactaaaaccaaagaaagtgaaacagcaggcagcaggggaggagctgctaaaacctcactgacacaagccaaagtcacaatgaggcttacagcacacagtgctcaatactgatattggaaccctgtttgttagaaaaaaaaaaaggaaaaagctcaatttcggtcaaccagaaaatcagacatgttagggatgttcctaaatggtctagaagaaaaccaaggatttggtttataagctcattccaattgtatgatgccatatttatagatttgtgcaaacaactgatctcatcttcttggcctaaccccagatattttcatatgtatgaatgtgctcaaaataagccactgctgcaagaattgtcttgtacatagctctgtcttaccaagagtgagtgcagtgagtgacatgggttgtgttcactcatgccaccattgcctgacagaccctgtggaatccaatagggatggcaccacgtccaaaaggctgaagaagagacccagagccatggaacaggacatagggtttattgaggacttaacagacagggcggtccagtagcagcgagctggactggaaaactgctcccatttttaaaaagcatgcaggttatacagcattttcacttagcaacaacttccatttaacccaaaacaaagggcctcgatcccccatatggcctgtgttgcaagggatgggccaggcgctccgatgtccttcacagatgtggactgaatctcagggtttgccactcccagactccttagctcagaaggctgaacacacattcttcttggatcatagagtcattctcagggattgcctgagttattgcagtcaggtgcatctccatacaccgggtgaatgtgctgggataaacatccatggacgctgttagtacaacaagaaggcacatgggtttccaagctcctccccagcccaggccctatcatcgcacctgcggcgatgcacagaccgccccccacccatccacctccccccccccccccccccgccaacaggtgtaacgtggtgccgcgggcagaggattcacctggaagtcaggaagcctgagtcctagtgctagatcaaattccctcattacctgtttgaattcaggactcttatccggccctctctaggcctgtctcagcaaatagggaatataatatttgcttaattatgtcatagggttttgagacactactgtaggaatatgggtgccaacattttgaaactacattactgtgatattaataggaacgtgtagtaaaggtgtaggtggatatggtgccatcatcaagccagctgcgagaacagcaccagagtgtgtgggcaggacccatcagatgacagcctgctagtggaacacaggtcttcaggggaagccactgcaggtcataacctatgaagttgtgatgtcaggagcagagaaatgcagaaataaaaatcaagaatgaggcgttagataataacctaaagattctacttgaaaaacatattaacagctatttgacttctttgaccgtgactgcaccagaccatgcacggcacagagctgcctgcaatgctgtggggtcgtgtgatcaagcctcacctggcaggtgcacaccggcgaatgcgtgcagcagacagcaggttgttaatagattggaaggcaaggataagagccacataacataaaggaaggagctctccttggcaaggacagaattatgcctacccacattcagtttaattccttgtaacaagtgagtgccctggagtgggcaacgtttggctgctggatgtgacgatttttatttccttatcaaaaagatttccaagcctcaatctacggctctttgtttgcacttcagtttaactaaattatcatatgaccagaatatccagtagttttcatttcattttaattggcttagtctgcgtgtctactgcttttcagcatctaataggaggctgtgcagtttcaaataatatataaaaattagggaaatggttgccagctaataggatgaatttaattgcctctcataggaaaacaaaatcaggaataaaatcaggataaacttcatcattcatgggtaaaaattattaagatgaatctattctaatggattgtactttatcctaatggggaggagaggatttacataaagtcaaagtgagtcacaagataaatgtgaatcgggagaattctaatatgtttgacaaataattctgaaaggcgttttgagaagcatagcatcacaaaactgaaaagcaacccagtttattgaaacaaaaacaaactgtaaaggtgaaacatgttttcacaatggggccacatttctcagctgcactcaaacaatgacaaaccggaaaagcgcctccctccaatgtggaaggaattgtgaagtcccagcctgcatgtaaaatagaactgggctttaaaagaatcggataattacgaaatgagttacataaagtcaggtgcctattttgttttctatgaggagaagaaactaattggaaatcttgtgagaatggggatttgctgctgaccagggtggcccttccttaactcttcgtctctcatcttctcccaaccagcttgtgcttgatgctgaaactgtgtgcttacccaagctggtgcaggggacgtggggtccctctggcagctcacagagcctctacgaaatctgtgtgtgtccagatgggaagctgtacctgtctgtggccggtgtgagcaccacgtgccaggagcacaaccacatctgcctctgagctgcctgcgtcctctcggtgagctgtgcagtgccggccccagatcctcacacccagggagcagctgcacatcgtgaaagactgaggcagcgtggatgggaagtaaacgcttccagaggaactcagaaaaaattatgtgccagtgaaagtgtttggacaaaaactacatgatctcaaaatgcacgtggatgtgagacacaaaagttgacaaaatggaaaagcaatgtgtttttccactggattaattttcaccggaacaattgcgaattctctctgcctcgcctccccctatcttgtccgtgtgggcacacactgagtgttgagttgccgtgtggagttaatgtatgacgctccactgtggatatctaatgccctgttgagagtagccttgctcagtactaaaatgccccaaagttctatacagcatttcctttatagcattcaaacctcacatcctcccttcagtttaatgcaagtaagtcaggtttcacaagaaaattttcaagttttgaagggaatttgaggttgatctggttttcaagatgtagttaaaggaataaatcactcaaaattaaactttctgtatatagtcaataagcaataaaaacctcatttttcagagtt

SEQ ID NO: 36912 - DNA, 68775 bp, Homo sapiens
tgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacagcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgaggtaagtaaccaaagggcatgctgtctgcgctgcctcagtgaggtgccgagggaatgcctttggccaggggttgggatatgggaacgaggatgcagagaatatatactgaactctgctttattttggcctcacgtgaatcagatgcccttgtcacacagctgggatgtgtgaacaatgaggggtgggtcctaactcttcaaatgaagaggaccaaacgtgctacactacgatgggtctgatgtaaagtctttatggcccccttgacttttcaagggcccttgtcccagccattgtttcccagatagaatgtagaaactattgttaaaactgttggctgaaatgaaatccagggactacttgtggatttcattcagtgtgcccactttgctccctcaaatctccccatgatcctggagagaccagagttacttgaccttgcgtctctctgggggtcagacggagaatatcactaaatgactttcctctctcttgttttgcgtcagtcagcattacagaatgtagttgtgtgcagatcttctgagcagcatattcatttatgtgattttttttctcagaaagttcttggtgtgactttagggcagagctgaagtcagttcttattttatccgcattacatggcctgcctgtttgtaacctggcactggggcccattttctaatcctttgcgagtgccccagaaactattcctgcagctcctcctggacagcttaagatggcttacactttaagagggcctgagggtgccaagaatgctagtgggcaccaagatgcctcatcagtctccacgcctagcccaggcgcaaacctgtgaaagggatatttgagaattacagtttattaaccagcacaatcagagaactcaggttgatgaaatagtttaataggattatcatataaaacccatgtggatttgaattttttcaaattgaaaaattgactgtaataaaatccagcaaaactatcccaaatacatcaaaagtatatctccaaccttgggtgctgaatgtggaatttcagttctctctgtgggttgcaagaaaagagaaagcagggatagttattaagactttattttatagaaatgagcaaatcacaggctggaaaagaacgagacatagaacttagctgctgcttagcacatgaaaccaacacttacattatatctccatctcaaactgccatactcagttatcaagagacattgttatgaaaacttaattgaaggcataaggattctcccctatatgctcatcgctgtccagttagcctagaactccaaaagaatgcctttgggtggccagtacaggcaaggacattcatttctgattctaattttttttaaaaaagaaatatctttctatcatccttctatctatctatctatctatctatctatctatctatctatctatctatctatcatctctagctcccccaagtatatctgtccccaaagactatgcaaaatcatgaacagaaacttcccctgggcttaccatccctccagacacctttgatccaagagtgcccttttcacagtgggtgccggcccagcagagaccgataaggaaaagttcaccacaggagttaatttgatgcccctcaggctgctaaagctggagtgaggcatcattaggagaaaaagaacacagaccttgaagtcaggatatctggatttaagttctggctttgtctctactaggcacaggacacagggcaaattacgtaatttctcagagcttcattttcttatctataaatatggaaaaatagtaactatcatgcagcttaagaaatgattaaataataataatgttgattaaatgcttactaagtgcagggactgttctaagcacttggtatgtgttagcttgtttaatccttacaataattctattaagtaggtacagttaccaattccattttatagatgtggaaactgaagcagagaggctaagttgtccaaggtcacacagctactacagatgaaggcagttgtacgtaacacctacacggtactactcctgaaatcagtgcgaaaacgcccaaggggcttctgggtagcctgtttaagatggtttcaagagtcttccttaaacagagttgctcagcctctggacccgggtctgatgatgccagctgtacaccagcatggccgagaagtacatggcctggaggcgctgctcatgcaaaagtgcaaactgaggaggaggcctgggctccattagtgaaggttgaggaaggggcgggcctttgttgagatacttgtcaggcgcagcatcaagggaaaaaatggctccgggaagtccatgagtggaaagagcgaacatgcctttaaactttcttcatggtcaaaacatctattttgtcctcttaatcctctagaccccacacttgcactaagaaaaatagtctgtcagcttccagggctgtggctgttagggggtagggggaaaagaggaggcagttcccagtgtccatccaacaggcagtgtggtctcagccacggacaaatagctggaggggaggcagctcccttccccctcgcagcttaaggcggcttctgacactttttatcataaccgactatgacccagtatatacagacacacacagacacacacacacaccagaaacaaaaatttcatatgaactatacttattattattacttggggaattaaatttttttttctatttttatcctgttctcttctatttcattttaaaaattgatctcaacctattaagttgatttccctctccagtgaggagttgccatccccaggctgaaacacctgaggaatttctaggaattagaaactcatagctcctcacactagggccaccccattcattctaagaaactccaagggcactgtggccagtcatgtatattttgtctgcatctctaagggatgtcaatgaaaaaagccagaaacagctccatccacagagtgaggaggtcactgcctgatgaggggcacttgaaataccattcaattagtcatgcatctgccacctaatttttgttggggccctgggatagatgctgtggatacggggaaaatgagaccctcaagtggctcacagctgaacatggaagaaaacatgcaaactaagagctacagtgcagggaggttgctgtaacaacacagcaacttagaagtttatcagggagagtagaggaaagaggaagggccagagttggtttgtgaaatgagtaggaatttactggcaaaacagcaaatattctgatggctctcaagtatttttccacctgctagctttttcctaaaatttggccaagagggcctcatttctttagggtaagatttttgtccctacttagtcaaggtcctctgggagaggtagatctttgagatgttgccaattacttacatcccctgagtctgaattctgtcgtgagaacagggcttgacaaggggaagaggagaaggtggagaagataaggtctatacagcttagcaagaaaaaggcaagtaatatgacaccaggaggcagcaaactcaaactttgctttccaatctggccagagtccagctctggagggcccaagggtcattgtataatccatagttctatgcagatgttctacacatgattgttgaatgaatgaatgaaatgttagagctcaaaagaactgtgggagtcatctaggttgctctgaacccctcatttcatagctgtaaccctgacttaaacagctggcagttctgattccttgggtattcttcatcaacaaagcagcatatatgatttagaaatttcagagtatgtggaaaagaactaaaaggcaataaaagtaatcacaccaaaataaacatggataatgttctggtagatttctttccagtatttttttctatacataaatatacatttttcaattgggaattataccatttatacagttttgtttccagctttttttcacatccatatattgtatttctatattattaaacagtaatgttaataccagcatagtattccactgtatcatcatacatatttttaaaataattaccctatatttggatcttgacacaatttttagagttttaaaaatcttcgcttttcattgttgttttaatgaacatttctttgatttctggctaaagttttctataaaattcttttgccatttatgtattttttctttcataaattatttttctatgccttttctcatttttctattggggtgtcaacacaaattataaagggagttgcaattttgcatgctgtctcttacagcttccaccaagatagtaaatttagtcacaccacagtggccaacttccattagcattacaggactcagagacagaggacatgggcaggtaattcagtttctccttgctgctttgtttcctgcttcctctttttccttgaaactgctgtgcaagccactgctcctatcatgtcctataaatattgccagagaaagtccttcatttctcaacctgagttgagaaatgtcaccatttccctcaggttgaagtgcttgagagatggcatgctctaacacgggcttccagatcagatagacctggtttccttgtttgcaagatggagatgacagtgctgttgtgaggattgaatgaggctgcccagcaagagcatagctctggcacacagaagatacttaacaaatgctagcttcttttagcccacactcactatttcatcaggattctaaacacaatacagctaaccccatcagttgataaactgaggaaatcaggccttgggagctgggtactggaaatgcagccatcttgcttattcacagccagtttgatttgctcctcctcttattgcttattcactcctcctctctggggctagagaggaggagtgagttgccagcggtcacaggtcgctctcgatgtactcctgtttggcattccctctgctctcaaggctttgctgagcctgtgtcggctatgtccaatcacctcatccatgccatttattaaattaggccttgccccattttcagtcatggttcagtctcacctactttgagaggtgcttccagtttccttctaatcctttctaccttactctttccccccatggagacatgggttggatttttccctctagattagaagcctcatgaaaacaacctgaattaaaatcaaacttcgtaataggggaagcaaaaagcaaagcaaaacaaaacaaaagcaaactgagccaagttcacattgggcaaggatcaagaaactgcttgcgactcaaaaacacaactaaataaatgcactggtcacatgacaacatgacaggtggagccccagctggccaggcatgagcaacatggcctccacattgtgagttcctgagccctctatacatggcattacctttctgcctagcacccagcctgggatgaggaatcatcgactccttcctcttccccttctaccttgacacagatcctgtccctaactccaagacctttatcttttcctctacaccacttcactgctaggagtccagcattccagcctgaaaaagaaggcaagaaaaggacaaaagctttttccgggtgagcttcacacttacatagaaacaattttatggccacttaaatcgtctatagaaggaaaagaggaaggagacatgcaaggacctcagagctcagttttaggacctctgggcacttttcattttatattcacatgttttgtagttaaaattgatgctgttagccatgtatatgtgttttgggtggcagggtggagagtggggaatagcaactaaatagactaacctgtaaccaacatgcatttattggattaaggaaagctatgggggattttttcaggcagctagagagtgtttcagaacatgaaaacaagtattgtaaatccctgaatagaaatattcattcatttattaaattttcattgctattaacagacactcaataatctttgcatgagtaaatgaatgtatcattgaatgtatggataaggaacaagcaatactttccagattctgaacagtaaagcttggttcattcatttagggtgaaataggtcccttgctcagtcagggtatctggagtcttggcacaaaaatggccatatcttcttggaagttgaaccaggtctacctgccagtcctgtagtttttcaacaggctgcaactagagttcaaagtctaaggctgctgcccggtgtacacttggtgtagttcttctgcttttcctgcttaagaaggtctcattttagctcaccaatagaggctgttgggatgctctgctaccatccacacagtgcctgtccaggggatctctcgtaagctttcttcggtattaaatggcaggaccactacctaaaaatgcaaaccaattttcctgtgctgaaacataggttactttccaataatatttagaggatgactcatgcagattatctattaagccctgtagcggagagggatgctggtttcatcatctatgacaggatcaagaatcataatcctgggtaatgtaggcctctgagttttgcagctgtttagtggatctcttgatgcttctgctttcagtctgccagagcccctaacagactgagcttccttcttccttcgggcctcggtctcctaaactatctgtatatcaataaaaagtaaactttagcggagagtgactgtagcctcttcaggctttgcaatgtgcccagcatcatcattgacaagactcatgtgcactttatgaactcttcttcttcttcttcttcttcttcttcttctccttcttctccttcttcttcttcttcttcttctccttcttcttcttcttcttcttctttcttcttcttcttcttcttcttcttcttcttcttcttttttttttgactgagtcttattctgttgcccaggctggagtgcagtggggcaatctcagctcactgcaacctcctccttccgggttcaagcaattcttctgcctcagcctcctgagttgttgggattacaggtgcccaccatcatgcctggctaatttttgtatttttagtagagacagggtttcaccatgttggccaggctggtataccaccatttttctatgtccaacctcagatgaggtagcagtgcttgggaaaactgagagccgagcacctgaacttctcttctatttacccactatcctgagtaagtcacacagattcacctctttacactgacctacaaaatctatgtgtaaaatcatctataaaatcaaccattagctcctacctccatgaattaggagaattaaatgaaaacaggtgaataagaatttcttataaaattataagaaggtataaaagagtcaggttttattatttttgttacatcagttactactgaagaaattcatctatgtattaatagaatgactaattgagtgcttgaagtatagtgggtgcttatcaatgtgaattttcttcactagtcacttgaacttttacacgtgttcttagtcgattgtagtagttctcaactttggccacatattagaaccacataaggagttttaaaaaataccgattcctgggtcttatccccacaggtgctggtttaattggtcactgggtaaaggctgatgtccagatgctacagtttttaaaagctttctgagtgctgttaagatgcagccaagtttgaaggccacttgaaacctgacgcttaaaatgtggaccccaaggctgagagcagctcagctacttgggaggctgagactagaggattgctttaggccaggagtttgaggctgcagtgtgttatgattgcacctgtgagtagatactgcactccagcttgagcaacatagtgagacctcatctgaataaaaaggcggaccccagaccagtagcaaatggcatcacttggaccctgttaaaaacaaagaatctcaggccatatctcagaatcaaacttagcatttaaatgagatccctgtgtcgtttgtaggcacattaaagtttgcaaagcactgtgacagtctattgggttgggaaagttttccagatgaccagaatcatgttgttacctgtttgacctttggatcattcattcttcagaatggtgttggaactgtcagtatagctctaatttggagagtcgctgggatgttaagtttgttctaggggtgcagggattcatatctgatttgggactcagccaggcctcccggggttctcccactgacccatcactcacacaatcagtgactaatcctttggacctccttagaaggaaatgatctgggacttgagaagtattaccctatttgagatctttctagttgaattgcctggcttttaaagaccaactcagaaggtggccttctaactatcctcaggtcagggttcagagttgaccttcagaaagagaagacatgcgtctatttggttgctgtggcacattagccctttccccaaaagagatggcaaatctaagaaccctgaaggtagatggaagtgggatattaagatgttatgatgtttaatggaaaccatgggaaagcttctcagagaaaactggtgagtattttgtaatataaaactaagtctagtgaacacctgaatagaaatattaattctttcatttattcatgaaatattcatcttacttacttactgtctaagtctgcttagtgttgctataacagaatacctgaggctgggtcatctataaaaagaggtttacttggctcatgattctagtggctggaaagttcaaaattggcagctgcatctggtgaaggcctcgtgctgcttcaactcatggcagaaagcagaaagcaatagaggagtgggcaaggaaatcatgtgatgagagagaaagaaagacagagaagccaaggaagtcagacccttttaaacaacctgttccctcagaaactaatttgttctcattaaaactcacttacccttgaatgagggcattcatctattcatctgtttataaggggcccacccacataacccaaacacctctgactagaccctactgctgaacactaccatattgggaataaaatttcaacatgagttttgatggggacaaaccacacccaaatcatagcacttacaaagatgcagatggaatggccccagtgtctagggaaatgtccctcttttattgatgataagaactcacttcctttaggtctatgcttaaatgtcactttatcaaagaagttatctccctgacaacctatgtaaatcacactttccatgcactcattttaccttctctaccctcctctatgctttttctacatagtacttggctgacatattgcatattgtctgacaccccttcttgcagtacatttgtgttgctataaaagaatacctaagactaggtaatttataaagaataaaaggtttatttggctcacaattctgatgtctgaaaaagttgaagattgggtatctgtatctggctagggccacaggctgcttccactcatggcagaaggtgaaaaggagctgatgtgtgcagagatcacacagcaccagaggaagcgagagagagagaaaaggtgcaaggctctttttaacaaccaactctcagaggaactctagcaggaactaatagagtgagaactcactcagtcactgccccacccacggaggacattaatctattcataagggattcacctccatgaccccaagacctcccattaggccccacctccaacattggggatcaaattttaatgtaagatttggagggaaaaacgtccaaactacagcacctgctatagaatgtgacattcacaaaggcagggactttgttctactcattgctataccccagcacctaaaccagtgcctgactcagtaggtattcaacagcatttgtcaaatgaatgttgaatgaagagaagaggaaggaggagaagggagaagcacatattatgaacttaccataaaccatgccaatatggggctttacatatgttattttatttaattcttacaatattacagacagagaaattagccagagagttaagtaaaaattgcctaaactcacaaagctataaaacattagattgtgaagcagagtttgaacccaaacctatttgtttcaaatgacatgtcccttccagtatgccaaggagcagctgaaagggattgcttcatgtttgtaagcagtgccaacttatgaagggacagatgtctttagtttgtactctggattttcactcacacttgagctgcattaaattgtgcaactagactatgtgttgaacctaaatgactaatgcgagccaatgggctgttgcttggcacttggaatttaataaatgtttgctggatggttggatggagaggggaagaagggaaaggtcaagaattagaaataaattgcttatactgaaaatatacttctccttgatctctttttaaaattgagttaaattttttaaagtattgagtacaattgtaaagaggttgaatctgccagattcaggaacctgttcgttacccttgcttaatcccaccaaaatatgggtaaaattgattttttttaagccatgggattcttagcccaaaatatatatgcacgtgggcagaagcctccaagctttataaggctgacccttgttctaaacctatttagcactggcaaatatcccagtggtggttgcatttccaaaccccaagagaggaaggcaaaatgaagttgctggagttgagtgaatctgcagatggagctgcgtggaaacgctggggagggaatagcaacacacacaggattcaggtattttttttccaactgttcactgaccaaaaatggcaatctccaaattcacacctgctccactctgaaaaattagatgaggtcagacttattttggtttggcttggagaacaaagcctctcatagagcccatactttctcaggaggtgctcacttttaaatcgcagttctctgtgaatcccaagtgctgttgaattctgtgtggagggttgctgggcacatatcggtaatacaggggatccttggagtgagacggtaaaagaacagaaatgctagttgtaaaagcatggattgagttgattacagttaaatttttcctttcacctatggaattataaggaaataaaggtttcacgaactggaaaatacatggttgattcagaagtttttagaccattggaaccttttctcactactcctatctccaaagcccccggtattgcgcaagcccaaataggacacctattcataacattcctgaggtagacctcctcccaaaggtataagtttttttttatttatttatttagagacagagtctcgctctgtcacccaggctccccggctggagtgcggtggcacaatcttggctcactgcaacctctgcctcccgggttcaagcgattcttctgcctcagcctcctgagtagctgagactacaggcgtgtgccaccctgcccagctaatttttgtatttttagtagatacggggtttcgtcatgttggctgggctggtcttgaactcctgacctcaggtgatccgcctgcctcagcctcccaaagtgctgggattacaggcacacgccaccatgcccagcccccaaagttataaattttaaaacggggacgtgagataccatgaaagtcaccactgcagaaatattataagggctattatgatataaggcagtaaaattaaaagtaagaaataaaatctgattccaaatcacaagatttttctttactcagcagccctactctgcggcagtttgagctttacaggttggtgcagagtatttttgcataattgtcagcttagctttagtgctcattcaaaatgacttgttcctcctagaaagtcagccccctgaagaactgagcctgttcaaagaagcctctaaggcttccctttttataaactggatgtggtaggccagaattatccagataagctgtttctgtttggacagccatgcaggaaaggggccagtaaggcatcttgcaatgtgatgggctaggcaagccagagctgcttctgtgtgcccggagtgccagttccaggagctcccacctgctgcccaggtgccccaagccagacaggcctctcctcaccatctgccatgagctgggtgtccaggagagccaacaggtactccctcacatgctcacctgcttctacctatacaacacacacaattactctggcctcggatatctaactgttagcccgaccacacacctctgatttatgaagggagtgaagcatcctccagacacagaagaagtgaatgcaacaatgcaacacataaacgactattggcagtagcacctagctgtgtgagatgcacaggctttggagttagagccagctgggattgagtccttgcactagctgtgtgactgcaggcgggtcacttagctcctcaaggctgagtgcttcctttataaaatctaagccacagtacgctcctcatagaggttttaagaagacaaaacaggtaacatgtgtgaagtgatgggcacacgcttggtgctgagtgaagggctgctcctgaaatcattgtgtatgtgaaagcacattgaaaactcccactctccactcaagttagttatccatggcatttgctgtcattagcagatgctatcaaaataaacactagtcagacatttcagaaagttcagccaagcaggaacaggttccttttctgcttattgcactgtggaagcaataagtcaaggatctcttcgttcagtcattattttacattcatgaggcctctccatgagaggaagcacctcaccccctttttaaaatgaggtgtaccaacctccactgaaggttagtttaaaaagggatgatctctctggctccagaaagcactgagtatcatgtgaaactttttcccaaggagagtttgagggagggactaccagaggaggtcagggcctgggcttccagactgcattttcacaggctctggggcacagaattctgttgagaaaaattggtaaagggcatggccttgccccatgtcagtcaaattcactctttaaaaattccattgcaataatatttttagataaaacaaaacaaacctggccttcagggacagcttccctcattctgtcagtttggacatggcaaaatgctacgcaataaaagattgtgattttgtgttagagactggaagagccacagctctcaatgtgtgggcccgagactggcagcctcagcagcacctgggaccctggcagaaatgcaaattcttgggtcccatcccagacctgctgaatcagaaactctggggtgggcccagcaatctctttttactggctgcccctccagggaatgctgatgtgcacccaggttctaaaaccactgacttagtgtagtggggtttgccctgtagttaattggtagggaactttcactacgtacttgtatacatgatactcctgtgagattggatctctaaggaaattgaagatcagttaagttgtgacttgcccagagtctcacagctgataagttgcaaagccaggatttgggcccaggtccctcagaggcccaggtataggaacaaaaggtaacagatgaaagttcgggctctggagccagagtgtcagggttgagatcctagctgggtcacttaagctctgtgtgtccccaggcaagttggttaaccactctgtgcctctatttcctcatctgcaagcctctacctcatgagggttttgtagagattcaataagataattcttgtaaggcagttggagcaatagctggcatatagtaaacacccagtaagtgcttttttaaaaattgttgttgttatatagcctctcagaattgtggggtggaaaaaatacatagcatcttcccttgggtcttttccttggcattgaccaacgtgatagtccaaaatgccaataaaaacaatcaacagcctctctctccccgaaggctctttcagaggccacctattccagccctaaagaggcccccgatactcgcttgaaccccataaaatagccgtcccttcattgagccagcctccttcgtgaacacatcacatgccaactgcccagctatacatagctcaggcctactttgagggcggcagaaagtgacaggagattaccggagagaaacgtcggctctctggtttcagggaaggacacacagttgttgaattgcttgacatgttgccagatggcatgagggacagtgggtacaaacagccgtttggctcttggcttacatgaaaagagcagggttacagccagggtgtttttaatgactggcctgagggacattcacttggagcagagatctgtgacattttccccgaggctcaactttttttttttcagattcttggccctgcagaaagtaatccccacccacctcccttcaacaagtaaccacctcctttttctttatgaccctccacctccccaccttccctctgactgtgtagtaaattagtctttctcctctacaaagacagttcttgggaaatggtacaaatataactttcttcctgtctttccctgggttagagctggtaagtcctatgaagagactggattgggtggggtctttatggaggtattggatgtgctgccctgggagccccagcggcagtcacgcagcacagggcgcccctctcgcctctgtgtgacaccttgaataagcgagacacacctgctctaacatgtctttgccacccacccagcagtttaactcccagtgcttggcttctgtctcagctcttctctaaaaggtcacccgtgacttaccagtcctgagatgagaggcctcatgggggtcctacccctccttgactccctgcaacatttgatatgaccacccgctcctttgtgactctggagtcactacaccaggatcctttctctccccgcacttctcccatagctccgctctgcctccagggtaggcttctttctcttccttctgagacagccagcccttgaccctgtggctttctttcatactcgtctcccaaagatgtcacctgtcctcaagccttgacctctcacgcaggacctctcccccgagccctagatcagcacctccgggtctgggctggactgccgtgactgtgaactctctgggtctgaatccatgctgagaagcttccccagttctgtcatgccctcctgccatcactgtgtgtcctccactttgtttcctcatgggagaccctcaaactattttgcctcctccctcttctttgatctctctcccttttctctccaaaaccaaggaagacttaccaggtctgactgattctcaacttgtagcaccacctgcacgtgtcactttttctcccactgacactgtcttggtctgagatcagagacatctctcacacagactaggacatcagcctcccaactggtggcctttcctttccactctcctttctgtctgctctacgcactcagatccactcttgccaaacacaacttagtcatattactcttctactcagacgatccccaaatcagagcttccagtcctagtagttaagtccttcacactttttttctaatgtgattttaacacaggacttctttcagcaccccaaataagcccactgttcaagcaggtcagcctgttctcctgcacacccctgcacattcccacctgcaaaccttttcttataccatttcttcctcctgggatgcccttgcagccccctccgcctatccacacactcctcctccaagttctagctggcctccccttttctaaacagcctccctcttcattcattcatttactgaagaaactaccgcttttatttgtttttattttttatttttgagatctaatctgttcaggtattacgctaggtgctggagatagcatgggagaaaaacagacgtggacatagagcttacaggctacaacatggacaattgctagacaaagaatcatataaattaatgtgcacttgcaactgtgaaatggttgcaaaggaaaagcatggagtgtgatgatcaagggtaaaaagggaaaaattgagattgggagtcagggaatgccttttgaggaactgacatttaaatgcagacttcaaggaaagtagaaaccagcaaacagtcggggaaaaggaattctatttggagtgaggggtgtgtgtagaagcagagcatgtgttggtggctttgtgtgaattagaacaaggcgtccctgcaagaagctgaagcttcaactggcctagggcttgagagcacagctgaaggaggtgatcctgtgcaaacacctgagccaggaataagcttgatgttttgcggagctgaagacaattgtattaagtaagaaatagagtgaccccagatgaggctggaaagacaggtgggacaaagagtgcaggacattcttggccatgttagggatttaggttcatcctgagtgcatggaaatttaatccacagtattcatcacagcccactgggctctgcaggatttgacctcccagcccacaaactctctaagtctccacagcccttatttttttgtcctactcctgtagcacctagagctattttttttttttttaagatggaggctcactctgttgcccagtctggagtgcagtggcgcaatctcggctcactgcaagctccacctccagggctcacgccattctcctacctcagtctcccgagtagctgggactacaggctcctgccaccaagcccggctaattcttttgtattttttttagcagagatggtgtttcaccgtgttagccaggatgatctctatctcctgacctcgtgttccgcctgcctcgcctcccaaagtgctgggattacaggcgtgagccaccgcgcccggccctagagctatttttttttaatgaatttcctacctccttaaatcacaaggcccttggagctgacacgtgtcttacacatttttgttaacacagtaggttctcaattaataattgttctctttccattataacactttacactatggcatttttgaattggcacaagatccagaaccctagccagctgtcataatattaagaagaaaatctaatgtttactaagcacttactgcatgccaagaactgtgccaagcactttacatgcattatttcagttaatcatcaaaacagtcccattgaatagatattggtattgtccactttttacactggagtcacagcacaggcttgtggacaagtcaataatacgggtctctgattccaagccctgtgcacttaacaactgggacatagtatccatgagtcatttattcattcgaagatgagatctacttggatccaccctgtcattaggtgcgatacatacctacaggatacaatcttttaacaagagtaaagctatattataaatatccacttctttcctattgaattatgcatattatttaaatagaatttttaggctgggcgcggtggctcatggctgtaatcccaacattttgggaggccaaagtgggaggattattgagcccaggagctcaagactagtcctggcaacaaagcaagaccctatctcgacaaaacttagacaattagccaagtgtgttggtgcaggcctgtagtcccagctactcaggggactgaggtgggaggattgcttgaacctgggaggtcaaggcttcagtgagccgtgattgtgccactgcactgcagcctgggcaaaggagtgagaccaagtcccaaaacaaaacagaacaaaaccttaaggaccttaaaataacttttaaaaaacacttttttgtacttaaaagaatcagcaatggttaaagcaaatcctaatgtttctagaaagaatgagcactgaccaatgcccagaggctgcatataaccaaccgataagagacaaccccattcactaggatggactatctgagaggtaactgaccaaacaaacaaaaccagcagagaaacagttgtacgtcaacaggagaaaattgcaatcctatatgaaaagtctgtactagttttctgggaatttaggagatatattgactctacctttttttctcacgtatgtaactctttgtcactgtatttgatgacaagtgcttctaactccttggctcacaaggcccttgaacttgtgaagtacttggaccaatccacccattcatccacaagtatgctgagtgtctccaagaaactgcaagatacaaaagaagcacaaaacagggtccttcttcttatggaggaaagagtcacaatgtagagactatacacaactctaatgattacacaataagtgccagagtactgtgcccttgtgaggggctttttgagttccagagaggagaatggggtgaaagatgaacatggagctgcgctctgcagccaacggtggccaggactggtagcgacctgagaatgcagtgagactaggttgcaggagagaagggaacatgtgagctgcagatttagggccaaagtaaaggtggaggcaaggccaagccaaatgtgagaggtagacagactcctgcctgccccactggcccagcagaggctcctggctgccatgtcaggaatcacctacctggcacccttggctcccatgaaggagacttgctaggactggcggcagtgaccacagaactcaagtgggcaagttttgggtcttatcagcgtgggaggcaagagtgatgggaattctggagggattttgcctaagggtgccaaagaggaggtgggaaagtctcagttaggcatgggatcctggcccatgtgttattgcctgctctgtttctccatctatggcacaggacagtgattggctgtatttagttaaccagggaatcgggaaaaaagaatcgagttcatttgagatagcacctcccactcataaatcttcaaaaatcacatataaatatccataagataaccagaaggccatgctttacatgcctacgagaggcacacatttggatctacctaaaaccaaataaaacatggtagtgcgtacctaggagagatcagagttaagttctctgtttaattctcagagttaacttcttattttatgtcattggttattcttactattattaatacatctctcctatgccaaaggtagagagaggggcttaaagagcccagcagttagaagagcactgtgtcatatcactttggatgtgctgacaaccatttatagcagtgtttttcagagtctgtcttgagatctgctgtattagaataatggggtgtggtagtgtggtttataaaaacgtagattcctgagccccacccaggtctattttctactgtattgtgctgaggcccaggaagccccactttagtccctgggtgattcttatgcacactgaagtttaagaaccactgtcagaggctcacgtactaggagtaaggaaacttactataccgcaaagccattaggtaccatcattactgactctgagtgatatacaagggaacatttaacttaagattttgacagcactaaatagaacacaggggcttatgttggaaaccagaaaagtcattaaaaaatggctttgtctaacagattaaatgcaatagagtgaagccaagtgacttgcagaaaggttggtctgtttaggcactgcagaaaatctcaacatgagtcatacataaacactgatgatgcctttcatcttaagtgttgcctagttacaggcaaaataaaagaaataagagaaagctgaatgaggggtgggggtgggggtaggcttatttgttacctgccattccactcccacccctcagtccccaaccaccagaggtattcctcggagctgctcttggtgcttctgctcacaatccttgctcttcgaagaagggaaacagttagaagccagagagaaagaaagaggctgggaacagatgaaaaggtctgggagggaagaataaatatgcaaagaaaaaccttaagatattcagaagaggaactctgaaggagaagacacagattctaggaacaatgaaaggaagacataaaaatgaagaagatatcaaagaaacaaacatagaaaagaaagtagagggatttatagtatgagttgtagagccaaacagatccagggtcaaaccatcaagaagacaataaatcctaaatgtgtctggaccaaacaatagaactgaaaagtacaaaaagcaaaaactgatagaactgaaaggaaaaatgaataaacctctaagaatgggaaagaaacaaaaaatttaagaaaacaagacattcttaccactcttattcaaaatagtgctagaagttctcaccagtgcagtaagtaaagataaagaaataaaatggcatgcagaaaaaggaagaaattattagcaggtgacaaaattgtctacctagaaaaatcccaaggaatctacaaaacaaaaacctcttagaactaataagtgagtttagcattaacattaacaaattaattgtatatctatatacttgcaataaacacatggacatgaaaattaaaaatacaatacaatttacagtagctgaaataatttaactgattagatataaatctaacaaaatgtgtgccagacttgtaggctgaaaactatacaatgctgatgaaagaaaccaaagaagatcaaataaatggagacataccatattcatgaattggaagacaacatagtaaatatgtcactctccccaagtttatacacagatttaatgcaattgctatcaaaattctagtaatatttttttttgtgtataaacaagattattctgaagtttatacaaaaatgctaaaggactaggatagttaaagcaatttagaaaaataaagaataaagtgaaaagagatagtctacctgctttcagatatacttgatcctagctactgcaatcaagactatgtggtgttggcagaggaacagacatatagagcaatggaacagaatcgagaaaccacaaatagacccacatgaatatgccaactgatttttgacaaagttacaaaagcaattgaatggatgaaagacagccttttcaccaaaaaatatcggaacagtcggacatctattggcaaaaaaagaaaaaggaacctcaacctatcttaaattttatcaaagtgaatcacgaacttaaatataaaatgaaaaactataaaatttttagaaaaaataagagaattcaggatctgaggctagacaaagagttcttggacttaatatcaaaagtacaatccatgaatgaaaaaagtgatcaactggacttcatcaaaattgacaatttttgttctgtgaaagatcctattaagaagatgaaatgattaggatattgaatgttctcaacacaaaaaagtgataaatatttgaaatgacaggtatgctaattaccctgatctgatcactatacattatatgaatcaaaacatcactgtgtaccctatggatatgtacaattattatttgtcaaatcaaaaaagaagatgaaataacacacatacagagtaaaaaaaaatgcttgtaaaccatatatctgaaaaaggactggtatttaaaaaaactctcaaaattcaacagccaaaaagcaatccagttgaaaaatgagcaaaagatgtgaacaggcatttcatagtagagaacatacacatggcaaatcaggacatttaaaaatgctcaacattgttagccattaggaaaatgcaaattaaaaccacaatgagatagcactacatacccgtcaaaatgactaaaatgaaaaatggttatgctacgaagtcctgacaaagacgtggaaaaactggattattcataccttgctcatgggaaggtaagacaatacagctacactgaaaaatattttggcagcttctttaaaaactaaacatgtaactgccatacaacccagcaattgtactattagacatttatctcagagaaattaagactaatatttaactcaaaaacctatacactaaactttatagcagctgtattcatactagccaatcactgggaacaacccacatatcctttaatgagtgaatgattaaacaaactatgatacattcataccatacattctactcagcaataaaaaaaaaaacagcgtatcgatacatgcaacaacctagacaaatctctacataattacactgagtgaaaaaagtcagtctgaaaaggttacatactatataattccatttacataacattcttgaaatgacaaaattataggaatggacaacaaattagtggttgcccagggtaaaagaggggatagggacacgaaccagtgggtgtgaccatgaaggacaacagagcgatccttgtggtggtggaaatgttctgtatcttaactgtatcaatgttaatatccaatttgtaacattgtacctccgttttgcaagatgttactgttgagggaaactgggtaaaatgtacaagatatctctctgtattatttctcacaactgcatgttaatctacaattatcttttttctaagtttaactaaaaaaagtagtattaatatttcatgatctgtctggtagcatctccattctgtttctgtttcaagtccctgttcaaacagatggcaagaattaggtctcagtcctgaagtaagcaagtattgcctacttgctcatatctgcattgcaggaagcttaacataatgccaatcttgtgcttgatgtcatcatctatgctggtgtctacccagagaagttttcagctatctgtccatctaggacactgctgcatcctcttggcctttggagccgaacccctgacccccgatactctactagtctcagtgtgcttcaggaaaccttgagaagacatctcaggtctattcacccaatgggcattcctacttcacaagcccaggagtgggggaattgagcgcaatgtttggatattgaggacataggcctcctttattcttaggtcctcttgtgttcccactctgccccaggtacatttggcagctagagaagggctcagggccccttgtcaggcacccatgcttccttcctgattcttctttctcccgatccaggttttatctactccaagggcagaaactggtatgtgacagtggatatattcttccaaattttctgtcttaggtctgctcctcagattttccctccttgattctcagcattctcctgaatcatccttcccctgaggggacaagaatacatttcctttgctgctgctcaacttggtcacatagtaacagcaagtatagaggaaacccttccattgatacatgaggatagtaatcctgtaatattttctaccatctttctgcccttagcacactcatctttccatttgtttcttcagcttgtggcccaggtccttgaacataaagctataggctttgtgatggtggatgccaagaaagaagccaagcttgccaagaaactgggtaagtgtgatttttgagatactgtatgtgggaaagaaacgaatgtgtcttgcaaaaggaaaagtacagttgcaattattcttgcataagcggactatcttttaaaatatataaaatgatcctgcataccttcatctttggttggagaagagtttcataaaagtaaatataggcctgaattgaatggtttcacattaatcatgtaagagattgttgtatcagtacgatgaagagggtttcttcctggagaaattgatgctaaagagtcaagcttttattttcagcttctaaagcaagctaaaagtccagcttctcttatctcaccactgtggtgatctctctgagagagttaaaaattctcttctttcatcatgtattatttcgttgccttgcggctgaagcagccaacaaaagacagcattaatagtaataattccagggtaacagtgctttttaaatttaaggttaaaccccagttgggcattatcaccaaggatgagaggggaggacataggtgaggtatggttaagtgaccgcacatggaagttgtactctctagtgtcgatatgtcatgcttaagtgcagtgcactttaggattcacaaccctgtaatcccaaagagagagaatggaggtagttcctctggttttctttttcttttctttttttcttttttttttttttttgagacaggttctcactgtcacccaggctggagtgccgtgatgtgatttcagctcactgcaacctctgcctcctggattcaagcgattcttgtgcctcagcctcttgagtagctgagattacagtcacacgccaccacgctcagttcattttttttttttgtatttttatgagagacagggtttcaccatgttggccaggctggtgttgaactcttgatcttgaatgatctgcctgcctcagcctcccaaaatggtgggattacaggcgtgagccatagctcccggcccgctcctctgattttcaaacactgacacacatgtactgcccatttggctttttctgcatgaccagtgaagaatggctattaaaaaaaatagcgggttataaaacaggatctttgaagaaaggttaattggatttggagtagtaagtacagaaaaaaaaaaaaaaagattagtggtggctcagtgaatactttcaggtacataaaagtccgttatcctggaaaattacagacaactgttttctattttattttcaagaagaccagtctttttttaaaaaaaagatttaaattataggaaactatttaggactatacaatgataatgagttattaagaatgtctgggcactttgggaggccaagggcagaggattgcttgagcccaggagtttgagaccagcttgggcaacatagaaaaacctcatctctacaaaaaatttaaaaattagctgggcatggtggcatgtgcctgtagtgccagctacttgggaggctgggatgagagaatggcttgagccagggagatcaagattgccgtgacttctgcctgcatgattgtgccactgcactacagcctgggcaacaaagtgagattctgtctcaaaataaatgaatgaatgaataaataaataaataaataaataaataaataaataaacaaaaataaagaatgcttgggatgtctctttccctggagacacattgagggatatttttctcccttgagtatgggagcaaaatatgttaaactctttccctagagtcaaaaacagtttaatggctgggcacagtgtaatcccagcactttgggaggccaaggcaggcggatcacaaggtcaggagatcgagaccatcctggctaacacggtgaaaccccgtctctactaaaaatacaaacaaattagccgggcatggtggcgggtgcctgtagtcccactactcgggaggctgaggcaggagaatggcgtgaacctgggaggcagagcttgcagtgagccgagatcgcaccactgcactccagcctgggagacagagcgagactccatctcaaaacaaacaaacaaacaaacaaacaaacaaacaaacagtttaatgagttctgtctcctcccccagcagtctcttgattcttcttctgccttcccattggtttaatgagaagttgcatttgggagaatttccagcaaatttagttagagaaaaatactagtgtcccagtgatctaaaaattttgggtggacaagctgggcaagtatacataaaaatagactagcaaagaatatgatggcgcttgatacactgaaacaagctcagtttggaggagttggggtaggttccttccggttatttgatccctgggggtttataggagagtggaggtattttgtgaacctgctccttcatcttcatttcttttccatttgccttattttggcctctatcaagttgtgcctcaacaattgcagtagtcttcttactgcggttttgctcaagacaaaatccaacagcaggacactggccaatgttccctagggcaccttttgagattggccatcattgatatcaagaaaatctggcagggccagacacggtgtctcatgcttgtaatatacatatatagtataatttttcatatataaaaaatatataatttttcatatatacttatatatgaaaaattagccagcatcatagcacatgcctgtagtctcagctattcaggaggctgaggcaggagccatgatcatggccctgcactccagcctgggtgacaaaggaaaaccttgtctcaaaaaacaaacaaacaaaaagaatacctggcacattgctccttttgatttacaaatggtgcctctaccatttcccgcccatgtgccagaggctgcttatacctcatgcatgccttgggacacagcaggctgcagtccagctttcctgtccctggacgttctgcagaagagttcatttggagaaaactttctccagctaacagacttttacaacaatctaaggaattaaggatgccaggcaattggactaaatgccagctttgtttatttaacattcctaaggaggaaaatgcatttttccaacaagcatttgttaaggtacacaacatcagaccaagggtgctaaagggcagcaaaataagaagacgctgagcctgtccttgcagcatctaccagccaactggataaagaagatgtgtgggattcagctggaacaggaaagcaagctgtccatcctggccacatacattaatgggttgctgatgtacacagcctctgtacaaggctctgggataccaagaagacaatgatcctaccctcagagaactcactttgatagtgaagacctgtaaattgagctgaacaaagatcaataatggcatgagttcagtgagattgaagtgacctttcttaagaaaaatgaatcctaagctgagacctgaagaagctaagcaagatggaggtcattccaggctgggagaacaagaaaaactaagtctagagaataatgctcagtgacttttcctttactcaccttttcatataaacatgtggacaggaagcaaagggagtcccacaggggacaagagagcagttctcaaaggagtacaagtctacctaagggagaatgaaagggatagatttggaaacagattttggagggactttaaagcaaggttaaggagtcaggtgggcagtggccattacaattctttgataaagagaatgacatgggatcagctgtatttttggaaaactaaagcagtggtggagtggagaatagacttttcttttaagtcaaaatccagctggaattgttctggactatttccaattaaatgttcacttcaggagctcttcaaaagtgttatttcaaggcaactgcttctttggttaatgctagttccactaatcctgaccccactgtcacccagaaaccctcagccagacctcagccaatacaatcactcttcctacgtcaggatgaccttctctgtgggcctctttgtttcttacaggttttgatgaagaaggaagcctgtatattcttaagggtgatcgcacaatagagtttgatggcgagtttgcagctgatgtcttggtggagttcctcttggatgtaagtatttatacacagtgaccctgcatggagctgcctctcctcaaatatagggagagatagaaccccaaagaaaggacaagctggagaacctggcctcatctgtgacaggtttttcaggattcacaaaaaactaaggagcacctatattattgcactgtctactctactgggaaagtgatctttaagccaccctagaaactgttgggggccatgtagtagtaatatgctaattctgttaccagttatacatagacgtctattgaaatctccttggttttgctccactgctactgaagaggagctggggaatgtggggagtgagggggctaaccagccacctgaagagagaggagggatgggagtaccaatcagccaggtcaccctgagttagccaccctcagagcaacatagagaagtgacagagctaaacagccccccagtatcacactttttcagccatggacatagcacagcctcatatccatatgcttagacaaacataggaacaaacattataaaaatatttcatccatagataaactcacacttgcagtaaccgctgtgaagttcaatgctttgaacacatattcttgcacagataaagaacctagtgttgagcatccatgccgatgattctttatctaccagccagtacccagtggtctatcattctttctctacagtgtcaaaaaccagagggaaggtcagaagtgagttggaagctacatttaccaaaaaaagtgccatctcatgacgcactgtgcttggccatctcattgactcacacccacatgccctaaaaaagttgagaggggtgacagaacaactctgggacagcatggtgctgccccagctttatcagctagggggaggcttttggaaataagactaactgcttcaaacaataaacaatgtgattgacttacctaagtagaaggctctagttagaggagactttagacttgatcgaatccagacactgcctccatttttctctgtaaatcacagataactgtgttttcagtatgttgcttgtgtcctcaagctgactattctcaagttagctataagatggccagcagtaggaacaaatacattgcatttcctcattcatatttcatgacagaaaaacaaatttggcttcccattgcccttttaagagtaaagaacttttcccaaagccttcagcaaatctgtccttattgggccagttacttgcccattcctgaatcaataactggcaggggaagttatgaaatccacctaaatgtccatcagcagatgactggattaaaaaaaatgtggtacatggcggagcgtggtggctcatgcctgtaatcccagcactttgggaggccaaggtgggctgatcacaaggtcaggagatcgagaccatcctggctaatacggtgaaaccccatctctactaaaaatacaaaaataaaaaaacttagctgggcatggtggtgggcgtagtcccagctactcgggaggctaaggcaggagaatggcgtgaacctgggaggcggagcttgcagtgagcctagatcgtgccactgcactccagcctgggcaacacagcatgactccatctcaaaaagaaagaaaagaaaatgtgctatacatacacaagggaatactattcagctttttttttttttaaaaaaagaaaactatcatttgcaactatacagatggaattggagaacattatgttaagtgaaataagctaggcacagaaagactaatacaacatgttctcacttattatatgtggaatctagaacacgagaactcagagaagcagagagtagttgccaaaagcaggatggggtgggggtggtgggaatggagagataatgatcaaagggtgcaaagcctcaattagacaggagaaataagattttgttctttgagatatattgtacagcatggtgaatatagtgaataatatgtattacatatttcaaaatcactaaaagagtaaatttcaaatgttctcaccacaaaaaatgatgaatatttgaggtgatggataggttaattagcttgatttaattatttcacatatttatagatcatagcaacactttacatccaataaatacatacaactataatttgtcaatctacaattaaaaataaatgttttctaaaactggcaaaaggaataggttgcccccaccaatcatttaactctttaagttaagttctattcctcagaaggtactgctggtatgctcactgggggattgtggggagaatggaatagatatttgaggcaccaaccacaaagtccgctacaacttccctccaatgcactctgtttccccagtgaagaaggaaatctcttgtttgaacatgtgtgtatgtgcgtgtggcatttcagctaattgaagacccagtggagatcatcagcagcaaactggaagtccaagccttcgaacgcattgaagactacatcaaactcattggctttttcaagagtgaggactcagaatgtaagttgtctgccaaccccagccgatcagtctaaaagctagattccaaacaaggtatgtcaggttaccccaaaagaggatgggtcttcagcacctcttttgctgggtagaatagaagttagaattcttcctgagcctaacacagtggagtacatgtgcaaaaattgtacaaaacagtcaggaaagctgcaagaatattaaggaggggccaggttctccagctttaaagcaggctgagtgttctacaaaaaagagaaaagctcttctccacttttcctgcctacccacctcccagtcggattctcccctacaatgggacaagcaatgggctgtctccctggcattggtagctcctatggtcaccagctggagagctttgcagtcaattggaaagcatgagtggaaaattggggtagggatgggcttagcagtggctacagaatgtgaaaaatcgctggccaagcccacagctgaccaccaaggctacctgtcatagtgcagccacacccttggacatattccctttgaaagctttgtgaccaggttttgggtggacacagaacctatgataacatcactacagcccatatagggatgagcgggtggtgggggtgagtcaggaagagcaggcagaagggaccaggaggagtaagcacttgagtactgtacatatttaaaactgctttggcagcatggcccccgtgaggtaggcttttttctggtatctcagccttggagagaggaacagcattagagcgggtgagcataactctggtagcattcatacacgtaggaagtacaaatgtgggctgcttatgactatttctgagaaccccaaaatattctgaaattgtttgcaaacccatttctttaaccagtcttcccactagcatccttagtcacctcatcaacaacccattcattttctgtctcccatgccccaacttaaccctcttttcatttgcttcattaaaacctccatttacagtgcttaaaatgaatgtgctagagggaggtggctaaccagggagatttgccccagttcttctttaggcaattttattttagtttgtacatttccgtatcagtgctgactactctggggtgcttctccttccccttccttttcagttcgtctgtctcaatttgtttccatctttatgttcctctatcctcttcatccatgtagctcaggatggcagataagagggaagcaaaacaaggttaggataaagagcacacctttcagtacccttggcgtcttcccccgcctagacgaatcatcatgataatagtatttaattaacacatttcatatgctagggcctatgctaggagcttatatggatgccttaatttcattctcacaacaagcctgtgaggtgattatcattattacctgcatgttaatgatgatgaaaggatggaacagaaaggtgcaattaacttgcccattatcacatggctagtatggtgtacaaaagtaatatgaaatatattacatattgcattgtaaaaaacctccaatttttaaaaaaaattttgaatgagaatcttatgcttgcctcaagaatatagcttttttttgagacctagttttgctctgttgcctaggctggagtgcagtggcatgatcttggctcactgcaacctctgcctcctgggttcaagtgattctcctgcctcagcctcctgagtagctgggattacaggtgcccgccaccacgcctggctaattttagtgtttttagtagagacggggtttcaccatgttggtcaggctggtcttgaactcctgacctcaagtgatccacccgcctcagcctcccaaagtgcttggattacaggcatgagccactgtgcccaacccaggatatagctttttgatattaggttttatgcttaaaatagcaacatgaaattccttatcaagattttaaatgatgatctcttcaaattcttgatggtcaccttggacaagagacttcacttgtatatgtggatagtgacaaatgggaggacaatatccattgctttttctatttttttttttttttttcgggatggagtttcactcgtgttgcccaggctggagtgcaatggtgcaatctcggctcactgcaacctctgcctcccgggttcaagcaactctcctgcctcagcctcctgagtagctgggattacaggcgcctgccaccatgcctggctaattttttgtatttttagtaaggatggagtttcaccatgttggccaggctggtctggaactcctgacctcagatgatccacccgcctcggcctcccaaaatgctgggattacaggcgtgagccactacgtccggcctgctctttctttgactgatgagctttctttttttgccattggacataattcagataattccatctctaaagtgtccttcaagggcacttagttcaatctgacagctatcacttttcttttcattgacaaatgtaatgttcatattccttataataatttgaatgaatttgaaaggattacagatcttaattaaattttgtatatcatcaatatttcaaaataataatgaagcttttccttaggaatacacagatattgctctactgatcttaataatcattcttaaaatttaataaaattgctagtgaatcattttaacctctttttaaggttgaatttttgtttttaaatgtataaactttgttagtacattatatatttcacgtagcccttgcaattttcaattaagtacattcaagtaggtgtttagcaagatctagccttttttgaagccaataatgatccctcaaaatattttcaaagtaagcataattcatagcatagttttaaatctagtttttagctaataaactctgtaaaattcttgcgcagttaacccactttaggatgaaagagcagggagaggtctcctgaacccatttcttcaccaaaagctataaagagaaggagttatacaggtttgaatgttattggagtcactttttaaaaataacaacctttttgtggaatgcagattcacaggcaaacctttatatgatgaactttttctctgaataaatattatttgaatctcaagattttcagaaagagcttgatgtaaagcctttacactttcttgtcattgtagctgtactatcagtacatgaacttggacattcaaaatctgacttcagagtttaactgtgtatagaattcatacactataaagtttatacatttaattgtgtacacttattttgtgcagtgctttcagaatctattttgacatgtttatttacttctttgaatgtttcatccccaacaaattggtttggttcttctttgtaagacagatgatattattccaagcatttctggtcagggtttctaactggtgccatcaaccacacccagttactaacgtctgtgatactaatatccagtacgcacaaccctgagagagggggaagaaaggagagaaaatgctaagataagtttttagtaagctggaggctgggaactcaatgttcaggagcctattccagaagccaaaagagtcatcaaagaaagtgggaaaggggtctgactggaagggaccaggaacaggctggtcaggaggcagggaaagcctagagatgacctgagctccaacagagcagaagacaagaggaggcttcttggaaaacaactgctgtttggctgaggctaaaggtcaagccacattttgaatcacccatctggaggtcaccttgctccattcttcatcttaaagtgatgtagaccagctctccaagagaggaagggaagctcctgacacaggcctaagccattctttccaacagggtgggagttcatggaggggaagagaaattcatcagggacatggggattggaaaagagggggatagaggattctgatagagcccactgctgctttagacacagatggcttaggtgttgctttagccattctacttccttactttcactccattcattcttcaaatgctctcagccaacttctcccctccacccaattctcgaccccagctatgatgttacaggatatcttttctgactacctgcttacttttatgaggacaagttagtgtgagtgtgtatcagtatgtgcaagtattctcatgactttccaacccctctctcacctgtgcttgcggcactcacctctgttgtaacaactatcatgctgcattttgattctttaaggatcaatagctctctctaggctgagagcttttgaagatcagtatctttgtcttattcattttggtatcctctggattaacattgttctaaaaaaattttgatagaatcttagtaaattctgcatggtcccagaattctaacaaaggcttatacttcacacggttaagggaaatggaattccatgaaatggaaagaagctaatcttgttaagaataaatcacaggctcattgactctcaggcttatagcatttattcataaccaccaccaccaccaccacaattaccatcaccctcacaactaaggtttgaggacaaatctctttcccaagtaactccccaggtgtaccaaggtacagcactcccacactcacctgatctcatactgcctcggccagtatggactcaagtttgagaccatagtcaatcaagagcttgattaagtttaagaaatcctcttgaggcatcagaataaaaaagaaaactttaaaatgaaaaaaagggaaagaaaactagaattcagcaacaggagtacttccatgaagaagtttaaaatacttctgtgatgtcaattgtgattgaggttactttacactgtgagacgaatttccttcttacttagggctcatttattctggcaaactgcactctctctagagggcatgattataagtagcagtgagttagaatgaaaggtctttttattttggtttggagttttacgcgtctttttctctctcttttcctcccggttccctctgtttcgtgctttctacctgcagttcataaaagtgtggtgaatgggtcttctcttgggcgtttgaatgccagtcaattccaactccttggggggaactatgggcttaaataatattaaataacatctatgtaaacaatacctactaaattattatccaatcaggattaattggctttctactctctacaccatttaaaaagaagattcttctgtgttcatcttgaaaatgtctctcccttcatctttatttttccccttagactacaaggcttttgaagaagcagctgaacacttccagccttacatcaaattctttgccacctttgacaaaggggtaagtacctatgaaaccccaatttgaacagttttgtaggcatgaagaattaaagtttgaactctcaccactctttcttttcttttagcaacattaaccatcctcccttgcctctttctctagaagggttaagaattatatcactaaatcactattggatttaagatgagtacaaagatgactaagtcagaggatgtaaggatatttatgaaaacatccaaggaaaagtgatgacccaccattatcttcttatacactgagatgggaaacgtgtgggcccagagtgtgccagcccactgagccactgcttcctttttccttagggggtatcctctcccttcctggggttgcatacttccccttctactgcgtcaggatgggaagtagaatgggaactcctctgtgattagttcaagcaagtgttctgcgaaaaacaagaggaagtcagtgagctgaagcagggaagggacgtggtgggatgagattgcattcagttcatgtatatgatgaaccacttctgtagacatggcccagtcttcaagcctatgatccagaagagtgctctataatccaagtaacataatctaaacttgaagaatgtttatcctaattagttgtattacagttgggagggatcttgagcaagaataatcaaaaaagctatcatgtattaagtgtctattatgggccaggtgctgtggctcacacctgtaatcccaacactttgggaggctgacgggggtggattgcatgagccttggagttggagaccagcctgggcaacatggtgagaccccatctctacaaaaaatacaaaaattagctgggtgtggtggcacacacttgtagtccgaactacttgggaggcttgaggtgggaggatcacttgagcccaggaggttgaagctgcagtgagctgtgatcataccattgtactccaacctgggcaatggagtgagatcctctctcaaaaaataaaaatataaaaaataataaattcaaaaaaatttttatgtgccagagtctgtgctaagaagtctctttgtgccagagtgtgtgctaagaagttaacatggattttctcacttcatcctttcaacactcccataagggaggaattagtatcctcattctacagaggatgaaactgaggtgctgaaagattaagtgattttttcatgatcatgtagttactgaattgagaagcttgctataatctcagaccagcctgacttcaaagtcaatgctctgtcctactttactccagagaaagaagcaatatatgcaaactgcctagctggtttttggcacacaggaagcattcagtaatagttagccagctatgagcaccattgttcataagaaagcaatcatctaggcccaggaagtgggaggattggataggatattagtagagaaagggaggaacagagaagccgaaactgaatccattactgacatatggttctgatggaccatttggttctaatggactaggtgtggctaaagaggctcctgggtaagaatccagctgaaaggaatagagaggcaggccaattaatttgtccagcaacaaagccttagtttttagaggggtggttcaacgttgagctcagggtagtatttgtttgtagaagtgcctcctagtgcaactgtatagcttcatgcctgtggtccatgaaaaaggtgaggtcaggctatgattaaaaattcagagagatgctttattcaaattctgtaggacactgagtcataagtgccagtgttcatgtagccttgttggatttcagaatatttaaagagacaaaggtacacagaggggagagcactgagaggactctgatgccatttggtgcttaagaacttgcatccatcagttggggtggagggggtgtccaaggggagatggtggagtccagaaggcatgactgcacctggtagagcctcagtggtttccagcagggagtgctaggacagaagaggagaaaagtaataaatgtgaagtggctgaaaggacctgtttgtacaacacatcctagggaatctcagagggacctggaggtgctttgttgaggtctgaaaccaggagaggcaagggacaagaaagcactaatgcggtcacaaaaatgcaaaaaacaactggcactagtaaaagtggatataacaagaagatctggccattgatgagatgatgagagaaggcctcaaaataacttaagatagcaagtcttggcgttaagacagcaaaaattatgaagctactgaaaacattaggaaatccaggaagaagaatctattgaggaacaagagatggggttatgagttctattttctaaaagttggggaaacattcaactggaaatgtccttaattaattaattaattaattcagtcattcactcaacaagtatttattgagtgccctttatgtgccaggcactcttcttagtgccagggacacaacattgagcaaagcagattcctgccctttagaatttaaagtttattgtgggaaagagaagatggaaagacagaaagttcaaaagtaaacaaaccaataaatacatcatatgagttgcaagactgtaaagagggtgagatgtcatggctgctgatgtaaatttgtcagtcagtagttcccaaccactatccatattagtatcctccaacaagcttttaaaaccattggtctctgggccccagccctggaaattttaattttttagggttgtggcagtgtctgggaatctgcattttcaaaagccacccaaggaattttaaagggtgtggaggtttaggaccagtactgatctattaatactaatcctaaatcaagccacacgaaggcccaacctctctgaagaagcagttagaacaagaaagtgtcagagggccaaggatggttccactctgctgcacctcacagcctgaaaaatatcagttcttaaaatcccatgtccccgcccactgacctgttcctctctctgtctgagtgaacaatgagacgaaaaatcactttcttttttaaatcacactggagccaaagggtgctgtgactaaacaaagttagtggagaagatagatgttgggaagacctaaatttagtaatggcaaaaaccattacttttggcaaaaactgcgattacttttgcaccaacctaatacttgagttggtttcattggcaacaactaaaatgacttgctaactggaggaaaaatgatttgtatcaaaattcatatacatgcacatgtcagaaaattggcattgtactttgtagttttcttatctttgttgaaatctattccaactagttaacagataaaagcatgaaagaattcatttttatggacccatttggttcttaataatataattcattcttatataatgctaatacccatgaaccagatctcctcctggaataatgccttgggttcagtaggccccactaaatacttactgaataaatgaatgaataaaagcttcaaccaatcaaatcccttcagtccttaccatccaagataggaataataagaatgaaagagggggtcgggcgcagtggctcacgcctgtaatcccagcactttgggaggccgaggggggaggtggatcacctgaggtcagtagttcaagaccagcctggccaacatggcgaaaccccatctctactaaaaatacaaaaattagctgggtgtggtggcctgtgcccataatcccagctactcgggaggctgaggcaggagaatcgctcgaacctgggaagcggagattgcagtgagccgagactgtgccattgaaccccagcctgggcaacaagagcaaaactctgtctcaccaaaaaaaaaaaaaaaaaaaaaaaaaaaagaatgaaagagagggattctctgagatacaagatgagagcactccatgatggtggtaggtagacagtgaagagatccctgggaaatttttacttagcatttccaagacttaaattaaggacacgacaatccaatttttacattcttagacagcactgtggacccagacattggcattcagagacgagactatcaccaccaccaggcgggtttgacttctggctctgctccctccagatatatgatcctgacaaatttcttacccaaattgtgcctcaggttcatcatttgtaaaataactatgataatcattcttaccacatacaatcaaagtgagaattaaacaaagaatcaacctaaaacacctggcagcagtgcctggcacgtgataagcactccatatgtttgttattattactgttttcattctgatcacttctcctttcatggaaacagtcttctggttcctagaatacatagtaagtgaactcagaaaaccagaattcaatgtcattttcttgcccactctggctccctgcctcatcacctcatcatctacatcacccccctacccctgagaagagggaaaaacagttagaaaaaactccacatctccctctcttaaaattaacctgacaataaaatctcccttgactgactatagctgtcaacatggcctgttttcttgatctctgagtaggatgctggaatttctctcccttaagtactatatgaaatgcctttcagaatatagtgacctggaattcatagcaattgatgacaaaaaccatatggatatcaatgtttcctcagaatggatctccttgtgtaagagcttatgcaatacccagctcctccccttccccagttagttgcagccgccctgggtcacggcaccacgggttaccaccacagtgcatcagctcttaggcaattcctcttcagcttaaagggaaccactgttcatccctgcgctttcttgaaccacagctctgaactagaaaagagtggcatttggttttctatagagcgttgcacattccaggcctctgaaatcatttcacaaacagaggtcctgagttcagcagctgtgcaggcaaacagcaaccattctgccttgacaacacactgaacatgtggctgctttaatccagagagaaaatgtcttcctggctatcggctggctctccgagctctttatctgttgtaagatgagcaaatcatcctggcttactggggtctgtccaagtttcagtactgaaagtcctgcatcccagggagcccttccacccagaacaaagcaagatggtcagtcacctcataactgctgacaaactgggcagctcccaaagcctgacaaaccatgaagcaagttgggtactgagagatttaactgtagggccagcacttcaacctaaaaagcaattagggctatgagcagatcaaagacaggctaatgggttgggttctgattctgagtacctatatgccttaaggatctccatcaattgcctgttttatcaacattggttccattaaatccatacaacacaggatagtaaatatgctccattggcatttgcttcccatccagccctggcaaatgcagtagagtgatggtgattgtagaattaaatttcccacttcgcatctcaactgctccctgcccctgcccgaccctcatttgctagataagtctttttccttcctatctttccttctttgatcacaaaagaagattagtctagccaggccttgggtgataagttcctgtcacttcaacattgaagttaaaactgtacatctgtttttatgtctttgccggaaaacatacacacttatcttagatggacaacacactgctattctagactagtattcaaataaactttgtcttatttctaatggttacaggttgcaaagaaattatctttgaagatgaatgaggttgacttctatgagccatttatggatgagcccattgccatccccaacaaaccttacacagaagaggagctggtggagtttgtgaaggaacaccaaaggtgcctgagatggcatgtgggggctgggggcctggggtctggggaatggagaggagcctctctgtgctaacatttcagacctgccaagagcaacaacctagttagtaccccagcagtacagaactcagtagtatggctttgttgatcagtaatgactagcagggatgttattacttctgaatctaagtctgcacctgcaagcagagtttgataaatccctcagtcagcaaatcccctcaaagccagggcaagatataaataaaattctatactaggaatgagagcaatttagtgaaagttcccatataccaataaccatgcccagtgctttagggaaactattttatctaatctccaaccttagggagtaattattattatcccaattttacagatcaaggaattggactcaatagttaagtaacttagccaaggatgaacactctatgcatagaacttctgggagagaaatgcttgataccacttagtgtagctccagcatggatcagcaaactttttctgtaaagaacaaaatggtaaatatttcaggttctgtgggccagatggcgtctgtagcaactacttaactgcggctgtggcatgaaagcagccatggatcatgtataaacaaatgggtgtggctgtgtaccagtaaaagtttatttaggaaaacaggaggccctggctggatttgtcccaccagctgtagttttttgacccctgctcttgagggagggaagatatgggaatatggaacatggtagtggactcactggcttgtccctccaccctacctggcatgtacacgagtgtgttcattggacctgcagtactgtgatccccctcacctggacagtcctagttccttcaggaaggcagtacttggaggagcaaatattaatatgtccagcactatttgccaatattcagaaagaaatgaaactatgagcaaaatatagatcctgtctgctcccctaaatatccctaaaggactttcaatgtatacaccagatgataaaacaaaggcagttttaacctacaaaatccgagatttcctgttttccccctcaggtttctcattccaggcctgctgtgggctctctggagtggtggctatctgtgaggaaggaaatggcatcttgccctgggaatgagctgaccctgtgccctctgacccattgtttgtaaaagactttataattcttggatcagtgggtctatgaaaaggctgagtgccttggcccagctcgctgtctgacacagcagagtagagcaggtctgtttccttagaagataagtgggtttttagggctctccctgccttgcaaaggaagcatcatctcattttacatttcataatgctgtggctgctgtgtctgccacagtgatccctactcaaggaagctctttctttttttttttttttttttttttccagacccactctacgtcgcctgcgcccagaagaaatgtttgaaacatgggtaagaaagaggcaaactctctttgccttgtagagatgagtatagtcccaaagaggagtgcttcttagattaagtccccaaactcaaaccaagtttatttggctgaggtggatgtctagatgagtatttgaaacatggacagattgggtacgacggctcagaactgtaatcccagcactctgggaggccggggccagggatcacttgagttcaggtgtctgagagcagcctgggcaacatagcaaaaccctgtctctacaaaaaaatgcaaaaagtaaccgagcatggtcgcatgtgcctggagttccagctacttgggaggctgaggcaggaggattacttgagcctgggaggtcaagtctgcaatgagctgtgatcctggcactgcgctccagcctgggcaacagagtgagacactgtttcaaaaaaatgaaacaaaacaaaacaaaaacatggacaacttcatgctcaattaaaacacagttctccatggatcaatccaagcctctttggtactactcactaggcaaaattgctcttagttaatttcctgcagtgactatagcttctgttcattgatcatcagagccacacagtaacacagtggaaggaactcaggctataaagtaatagagactagggttcaagtccagaatctgccacctagtagctttgtgtactatgtcaagtcctgtggcctttctgagctgtctaaatttcctcatctaaaattgggactttttataaggatgaatatgaagagttcactatatggtagctgttttttaaaaatatcaactgaaggcactggcaagcagctgagccaacttgtcttctaggtttgtgtcatggataatatgtcaggcagctcaaacagtgttagatagagggccttggagataaacccccaacccacaccttatgtacagaagttcataaataacaaaggctgtggagcatttttcaaagcatttcatgcatctttttatttggatcttccaatagctctagaaagtgatgtagaacaagtattattaattagtcgggcatagtggggcacgcctgtagtcccagctccttgggaagttgaggtgggaggattgtttgagcacagcagcttgagacttcagtgagacatgataatgccactgcactccagcctgggcaacacagcaagactctgtctccccaaacaaacaaacaaaaaccaaatactattttagccccgtttgacatagtcagaaactgacgctcatacagattaatcactaaaagacacataactaaaaaccattagttcttggaacttaaatataagccatctggagccaaacctggtgttctctgcagaatgcctccccagagtgactatgtccccacaaggggccatttggtgtgagggctgggaaggaggagaaaggaattaacacggaagtatttatctgtttaattctttgaagtgatggatgaacagaaccagggagcaacttgacactgttttactggtctgtaacttacttggatgtttgaaggtagagcaaacatttcacaagataccaaagggtaaataatccagtccagaggagcggactatttaataacaactcagcacaatagaaacaaactttcctaacatttaaacctttcaaagatattaaaagggtcttatcgctaggcatagtgactcatgcctgtaatctcagcactttgggaggccaaggtgggcagatcacttgacgtcaggagttcgagaccagcctggccaacatggtgaaaccccattcctaccaaaaaatacaaaaattagccgagtatggtggcaggcgcctgtagtcccacctactctggaggctgatataagagaatcactttcatctgggaggcagaagttgcagttagctgtgattgcaccactgcactccagcctgggcaacagagtgagaccctgtctcaaaaaaaaaagagtcttattaatgtattttaaaatagtaatagcaaaaagatataatagtgctttaaaatagtattttttaaattgtttttgctttttaccctaaaataatttcagatgtaccaaaatagtgcaaagaacttcaatatctcttcacctagatctcccaaatgttaacattttaccatcccttctagctacatagatacatagatagatgatagatagatagatagatagatagatagataaatagatagatatagagagatatagatagatgatagatagatagatagatatagagagatagaattttcaaaatcaggaaattaacactgatataatacgtctactaccattattcaaattggccagttgtcccatcaatgtcctttactgcaaaagaaaaacgtctctttttcctggcccagaatccaatccaggattccacacttacatttgcctatgtttctctttctttttcttttattattattattttttttgagacggattctccctctgtcacccaggctggagtacagtggcaccatcttggctcactgcagcctctgcctcccaggttcatgtgattctcctccctcagcctcccaagtagctgggattacaggtgcataccaccacacctggctagtttttgtgtttttagtagagacagggtttcaccatgttggccaggctggtcttgacctgctgacctcaggtgatcctccctcctcggcctcccaaagtgctgggattacaggcatgaactaccacgcccggcctgcttatgcttccttagtcacctttaatttggaacagggtcttggtcttcgtctttcatggcacaaaatatcactttaaattgagagtcattattgatgttctcttctgctgtggctttatcttcagtttttttctttttattgtctttattcctaagaggcaagtctcaattatctaggttctaggaagggagggaatataccactatggaccccttctcccaggtctttccttcctgtcatagcagtatcactcaagaccatggtgttctgtagatggggagcctgtgtcctcacatatcccacactgctacagaaatactccctgttgacacattagaggcagatgttcagaaaggaagttcagtgtctggtttcattggaactcattctctcctttcttttcatttaatgaataagataaaatacagccttttgctataatataaaataatggtgatggctcatattttccacattattgcatattgaattgttcttaacttggggaagagagcagcgtattgaatttaaccaggcagagaaaagggcaactgaaatggtttattccttccctccccgttctggaacagcctcatgtcttacccaggaaccctaaccagacctagtcagcccctcattcaagtctccaactagggggaaggcaggacaggcctctccagtgtcatctttgtttccttgaaagggagaaacagaaatcagtccatccaaaggacctctgaggagccactttccataccccctcctctacctgggccccctagcaggtcactgctctaaagagtgccatccctgtgggccacgtggccacagcaacttaaaccacagatgtggttgtggaaagtgaccagttaatgaacttcaaagtctttttggccaggcaaggtggctcatgtctatagtcccagcactttgggaggctgaggtgggcagatcgtttgagtcaaggaattcgagagcagcctgggcaacatagcgaaactccatctctgcaaaaaatacaaaaattagctgggtgtggtggtgtgtgccaatagtcccagctgcttgagaggctgaggcaggagcatcctttgagcctgggaggcagaggctgcagtgagctgagatgtgccactgcactccaacctgggcaacagagtgaaaccctgtttcgaaagaaaaagaaaggtctttatcttcaacatccacttccccagacatctacttcccgagacattgagaaatatttaaataagatgggaaagccagctaggactaaaacaactattgatctttctctcactctaattgtgcaggtttttaagatgcaggccatagaaaacacatcacatatgattactaaagaaactggtgcctggtaatatttgctgtgtgtacattggaaagctatttatttattttaaatactcaaagaatgtcaagctgaggcagggcaaaaggagacccagtgctgatctgtcattccccctggagacctcaccctccatctagccaagtggcccgctggagtcctggggaactgcccacagggaaggagagtcagcaatttcttctaaaagaagcctccctatattgcaacaacaaaatactttcaagatggggtcagagacccccagacaagcatctaggtcactccattgcaccttaaataggaagcctgcttattttaaccgcatttttctttgcatctcttcattcaacatgagaacaaacattcaacagagactggaaggaaactgagtaaaatattaagtggtaatatatgttgttggtaggtaattgataagcatagtttcttcttggtatacctaatattttctaattttcttcagtgagtaaggtttttattgccatactccttttttgagtctataggcgttaaaaagaacctctgtgctaaacaatgaggttataaaagctaacattgctgtcctgtccttaagagctcagattaagtagacgaaacagtctcaagacatataacgccagcccagcatgctcactgctgcgacaggggggcgtacaaagtgctggggtatccaaaggaagggattcactgacgttattcccaaatctccggttctttgggaaatcttgcactcagttactttatatacaggtctctttccagcctctttcaacttaagagccattgatccaagtttacaacattttctgcaaaccctgcaggggaataaattcatggagcctgttctgctggtggtggtgagaaagaaagagtacaggttctgtggtctgaatgtttgtgtacccatgcaaattcatacattggaatcatagcccccaaggtaatggtgtgaggagatggggccgttgggaagtgattaggtcttgagggctgaactctcatgttgggattaatgccctaaaagatgccccagagagctagctggtcccttccaccgtgaggacacagcaggaaggcactgcttctgagccagaaagcaggcctcgcgagacaccaaatctgccggcgccttgacttcccagcctccataacagtgagaaataaatttctgttgtttataagctacccaggttttgatatgttgttatagcagcccgaataaaccaagacagtgggctttggggccagacagaactggcttgaatcccccttctgtcactactagttctgtggccttaggtaagacactttgattcttcaagcattcaataagaataagactttcttatgagattttgagataatgtacttacaaagtaagtacagaaaaagtggcaaatagcagatattgttgccactttaataactgttgttatcttaaggcataatcccttcttttagtgagctttccatctagttgaggagggaagattcatgcaattaaaaacagaatttccaagacaacctaaagaccaaatgagagatctgggtagcaaaggctgtgggattcagagaagccccgggggttctcagccctgaagtcagcacagctattcctcccctgtgcaagctgggttctcactgagtaaccccaacttgccagcttgcccatgggttctggctctgtgagtttattacttgaaaatgcctggcacctagcgctggcctgcttccttgtggatgtggaatacaggtctgcatgctgaatctttgtgacgcacacagtgacaggctctttcccttggtgacagtgctccctccagggaccatcttgggtctggggagtgacagccgtattatgagcagccttctagaaaacaaatatggattcttaattctaaagccaattccaaatgcgttctagcagggcacacagaaatgaagcctgcttcacagaattaacagcgctcactcccatctgatggcaggagacagagacacaggctagcctaatgagaactgatcgggatattctgtctggcgataatagcaaatgtaaaacagtgaaacctcagactccccttctggttgctgtcgatttgtgtaataagccggcacacacaggcacacacatgcgtatctgtaaaattaaattctccagagaatctgaccaaggcagtgcccactgtcttgtttttaataataatattttccatttaatctttcttagaatttgtggaggctttgtccattccaaactcaaaggaaaaaaattagcatttagataggattgcgccagcattaaaatcaattgaaatggaaacagagatcatgggaaggttgagacgcctggaggtttttccataggatgattctgatatgatgttcagggtgcccaaagcatacctctccccatgtctcatcatcactatgcactcggccttgtccccaggtgcctctttctcacacatattcctccccaagtctcctgagaatcacatttgtgatagcagagccccttccaagctctagctcctctttctccaggaataatcattgcaaaggagacacaaggcatagggtccttgctgcccagggtgtagagacatgaaatgcgccttgtttgccccatagacttaaaatactctctctaggttcttcttcctgcccctgcccccacagccatacaccacttttctcaatcgcacaccctcaaccttccttacgctcaaattccagacaattcctgcagcctcagaaatgcactggaggcctatactgactgggcaaggacttcaaggaagtcacctagaggccacttctagcagtgtcccctacacactacatgggttctgtaggcagggtcctaacagggaagcacaacccttgtctgtgattcttgtgtgaacaacaccagcccacatcctaattgacctcaatgattcctgtctgccatccatttggatatagtttcaggatctgtccacagcattcagaagcctccataatctggtgtatcactgactctatctgccagtggtaaattcttgaaacagagactgacagctgcttttactgagctgcctccagagccattgttgctctcagatctcctgataaaccagactcatgttctttctcattttgccttttactgctgcactcctggaaccaccagaccacaggagtgaggctcatttagtgctaatgtcttgcgtgtggttggtattttcctgtcttgcaaactcatttatctgagtccctgatccaaaccctatgcattcctggcagttgctcctcagcattccttccttaatgtgagccccgctgtactcctctgtgcttctgtgttcatccccgcttccacacctctccctacctctcctattcccattccagcttctgagtccctgtccctggctcagtcctttgcatccctccagctggaagtgtaacttttgttacttttctcatacaggaagatgatttgaatgggatccacattgtggcctttgcagagaagagtgatccaggtaggaaaccttcaacctgctcttttacagctctagcaagaactgatttctcacctttgccagccctcacctttctcttctctcacatcccatccacaatgcaactgcaagatattgggcaccccctggtggtcgcccattaagtatgagttcgttttcaattgtgcacacggctaagagaagaaaaggtgtgaacaaatcagaatgttatagactaccaggttcctacagcgctgcacagcaatggaccaacacactgagtcagtgggatttgcagcagagaaagagtttaataatcgcaaggctgccaaatgggtaagaggagggattctcaggccacaaatccaattcttcaaggggttctgggcaagggtttttaagaggatcatggaaggtgagggcctggaaaattggggtcattgattgatctgggtaaggggatgaaatcgtgaggatgtggaaactgcattcttccataagtcagctccttgctcagccttttagaccagctgatgtcagtagttttattggtatgcagaacctaaaagagaaactcaaatggaaatcttattgtattagtccattctcacattgctatgaagaaataccagagacagggtaatttataaagaaaagagcttctattggctcaaagttcttcaggttgtacaggaaacagggcagtatctgcttctggggaggcttcagggagcttttactcatggcagaaggcaaagcgggagcagacatctcacatggcaggagcaggaccaaggtggtggggaggtgccacacacttttatataaccagatcttgtgagaactcataccaagtggggaatggtgttaaatcataagaaaccacccccacgatccaatcatctcccaccaggccccacctccagcattggggattacatttcaacaggagatttgggtaggggacacagatccaaaccatatcacttttaatctcaccatgtcttaaattttgtctatagaacagagaagggacaacaagtcttgtgacaagggctacattatcctggggtagtacacagtgaagagaagtgggccagagggcaagccagcttcacgattgctgccgatggtgtgggaagcctagcgggattttatttttttctccagttgattttataaagtgtttttggagatgctttcaagaacctcaaacattctgctttgctgcccaaacatagaaaggtacactgggcactgggggagatattaaaacataccagctttacagggtgtgtgtgtgcttgtgtgtgtgtgcacgtgtgaacttctgttcacattaaaagtttatttacctattttgccatctagcctatatcaaccacaattctacctgaaaataggataaatgtatactttaatccataaaatattgtctgtgcttaggaaatgaagtaggaaacattcccctaaataatgagacctggggaaaatgagcagcttattttgaaagtgcaagatgaccctgtaaatggatgggtaactttgtttttggaacttggacaacttttctctggtttcactcttttcaacaccagtggagagtgaagtgcaggaaaattgattttgcaggtagcaattccctatggcagtgctctgtgagacagagagtccccaagagaaagtggaagcacagattctgaagtgcattttggaaaccctgggacaacccagaatgtaaccagagaagtcaagggaatgtagactttcatggtatttgctggggacctcagtctcttgtatactcatagggagagatctagagatggttccactagacagatcaggaaacagcggtttggagaagttaaacaaactgcccaagagaacacagttagtggcagatcatgaagggtgaacagatcgcctttttcatcaatatatagctgattcttgcacaatgtcttgactcgtggtaggcgcccaataaatatttgtctggcagatgattagagagttagatgaccaaccaagacagagccccaaaatcttcactggcagaccagcttttccttcccttttttggcaatacactaatagcctccatagtttcttacagagtgaaacccacattttttatcatataatttataaaatcaagatataatccatataccataatagtaacccttttaaagtgaagattccagtggtttttaggacattcacaaagttgtgcaaacataatcagtatctaattctagaacattttgataaatagccattagcagtcactcccatttctctctcacccacctctgcaagcaggaattacctactatctctaaaatttgcctattctggacatttcatataaatggaatcatttaatatgtagccttttgtgtgtggcatctttcacttagcatgatgttttcaaggtgtcccaatgacattgcacatatcattccttttaagggccgaataatattccattgtatcaaaaccaaatttatgttctgaattatctgagcactctcttgtctttttcacttttcaacatgatctagcccttgtctccacctctcaagaaaaagctagtgtggtttcagtgggttttccacaggttccggccaccactcttccctggaggagcaaatagcaaaggaagccaattgcctaaggtttacaagctataatcaaacagaatcggatccctggtgttatgtgaacagagatgcagttgccataggcagcagcctgctggccagactccagagggctccttccccacctcacctgccaccttccaggattgtggggaagcctgtctggctctttggaacaatagaacaaagaggcctccctgaagttgtaagaacctgtttgaccgagattgctgctgtaatgaatcaagctccagaaactacttccacctcctccctgcacaaatatccctgggcctgaagctgtgcctttccccaaaagagcccaagctggggcttgtactgggaagctgtaagcatgcactgaggtgagggcagggggatagggaggagctctagaagcatcttctgtgagcaagggccttgccactcagggttgggaaagggaaagacttgtctgtgaaagtccctgactctgaatttgtggttaatcagtgatttacctgcagagcactgatgtgtaacctggggcaatgggcctgactgcaggactaggaatgtcattcctgcaaaacagtccctctgcattcctttgctcttgctaacaagttagacatggcctttcaccccaaccaaacacctaaccccaccaccccaaggaagaagatcatacctccaggaaaataatacagttcttcttaaagaactaacagtattgaggaactgtgctaggagctttatgtagatgaccttatttagcacctaaagccactctgtaatacgtgcatgatgattattattctagtgtcagatgaggaacgtgagttttagaggttaaataagttgcccaaatcactcactatacctaagccaagattcaaattcaagcaggctatcttgacctctaaatacatcatgactatgaggaagatgatgatgattgtcacttactgtgtacttatatgtacacaagaaccccatgaggaaggcattatttttattacaactgaggaagctgaggctgagagagcttacctcactgggaagcatgaagttggaatgacgctgaggatgtctggcttcccagcccacacccttaaccacaaggccctgccatagagttatatgaagtcgtcaggttagcaactctgagtggcatatacgtctgtagcagggccttatgctaagtgatcattcgatcctccttcctgcctctctattgcccttcaccatctcctccacctccaacatttgaaagacaagaaagcggagacccagggcaatgcagtggcatgttcgggatcacagggttataggaatagtgggaaatcgagcttagatttcccaagggcccctcctgtgcacagtccaccctatcacaccaactccaaacaatgccccagccagtgcaggctctgagcatgtgcagtgctgccgcatgtactggggaaggggacacgagcaggcagagcaggcggaggtgagaagagcacaaaaccacctggaagcttgagagcctagttagggaagaaaagtcaggcttcctcccactgtctgtccaggtttgggatctaagattacacagcagcaacaaccacatgtcccagtgatccagctgccccaaccactttcttcccccagcagttctgacatgatcctcatggccaagagcttgagttcacccagggtaggaagctgagggaaggcagcaaccctgtactcccacctccacctgccaggaggcagagtctgctctcctggccctcgagcctaatcgccagatctctcctgctgtactcatcccatgcccttaggcaggcctggctgggaaggacatttcctagccctgtgctcttgcccattgcctggtggtgctgccagtcttcctccagctcctgcgctcaaagtgcccgccagagccgctcgtctgacaggtttgaaaatgaatgactgtcttcctcaccacccctagatgtgtctgtgtcaggctgacatcttctttataacatgtgatgaaaggtttgcaaagcagcgtttctacatgagtgcatgctagatggatatcctcaaagggcactgggaatattagcgctaacaagctggaaatgcaaggaaaggctgctgtctgcacacgtggaacagaattagtgacaggccctggaaggaacgtctccaagctctgttccatccaagcttccactgcttcaggttcttgtaaaaatctttttgagaccaattgtctcaagtaggaccactaactgcctccttgagcttttgattttaagtttggtttaccaaatttaacatttggttctttctttctttctttttttttttttttgaggcagtctccctctattgctcaggctggagtgcagtggcaccatctctgctcactgcaacctccacctcccgggttcaagcgattctcctgcctcagcctcccgagtagctgggattagaggcatgggccaccacacctggctaagttttgtattttcaatagcctcccaaagtgctgggattatgggtgtgagccactgtgcctggcctggttcttactatgtgttgaatgttattccaagcacttaacaagtatcaacatatttaacctttgcaacaacccgacgtgttaggtgctgtttttatcatcttccccggtgtacagatgataaagtacagggacgaagaagttaaataatgtccccagctcacatggctaatcagtgatagaactgggattcaaacccagcagtccagccccgagtctgggctctgtaaccatcagcttaagcttctcttcatcacaacaccatatcatttgactttttcaccaattctgggatcttagcgccaggagaagacaggcagagaaagagggtgtggtaaggagtggtagcgtattcacatgtctcaagtgccgtctcatagctgtggggcccagacaatgtcccctgtcctacgcggatgtctgactctcacgggtgacttcttggcaattccatcttgtgagaggagagctcccagccttgtctgtccctctgaggtttcccaaaggatccagttcagatgctgggctgctttttgagaattccatatttactgagtgagctctggtctagagaccaacaaggtctttctgagagaggacctgtcctattcacccttgtgtctcagcctcaggctctgggcttaagatgttgtgggaactcaaattatacctgcctgctgaaaacaaacaaacaaacaaacaaaacccttacgcctgtaatcccagcactttgggattacaggcgggtgaatcacaaggtcaggagttcgagaccagtctggccaacatagtgaaaccccgtctctactaaaaatacaaaaattagctgggcatggtagcatgcacctgtagtcccagctactcaggaggctgatgcaggagaatcacttgaacccgggaggcagaggttgcagtgagccgagaccacaccattgcactccagcctcggtgacagagtgagactccatctcaaaaacaaaaacaaagcaaaacaaacaaacaaaaacccttcccatcaacgaaggatcaaagtagtgaaaaaaaaaaaaatcttaaaatgagtaagagtttgatgggggtggaggagagaaaggaagaagacagacaaagtctttatgaggaccttctgcatgtgtctccctacacactttgcccaacccacatgctgatagcatctcgttatatcaacatgcctgagaagtcatgtggcagctgttctctccactttcagaggaggagatgaaaggggagcggttaagcaacctgtgcaaggtctttaaactccagacccagtgccctctttagacacaacctctaagctgtgtggttccagccccggccgtttatctgtccacctgccacacaagcaagggcaggaccccactttaagagcttggccctcccaagctcaggcctctcctcacaggagcagagaccctgaggcccagaacttcccatggcatggagtcaggaagggtccctttccgtgcctttgtggagtgagcacagccagctcccccaggagtggggccatgaggacagatagcagggcagggcaggctgcatgctgtggacctgttcactcctggaccactgcttggtctgagacacatgagcctctgccgaatgtggccttggctcctgacttggctgtgcctggcctgggaccggtcccctagggcttggtgaaggctcattcccaccagtccctgccagggaaacagaagaggataatcaccagtttctcctcccacaaagatgtgattcccagaggccagtcgcttgccgtgggaaacctcctggttcaacgtgcatcccttggctgtgggtcatggtctctcaggactccaagcctgagtggcaggagaggagttgcagttctcacagctccaggtctctttatttacatccatctctgagacgccagtcccactcagagccatccctgagttagccaacccatcatactacagctgctgggaggcgagggcttggcagcgtggtttgaaggaggggaagggacccctccatgggaaggtagaggccagcccgccagccctgggactgaccccatggacagtttcctcagtgtcccagcccctgcttccctgatgttgaagctttcacactgggcttaaaaatctcaagcactcgaggaaggaagatggcagcaacattggtaggagtgcagagacctcagagggtaggagacagtggaagtggctccagacgtgcagacttaagacctgagttcaactcccagctctaccatttgctcccgtgtgatgctgggcaagtcatttgctctccttgggtcttaattccatcctctttaaaatggagatgataaaatcttcctaacctccatcaagactagttgtaaaaatcaaatgtaaaagtactcagtacccagtaagtgttcaatagacactcagaaaataaaggttggagcagcgtgattatagactttctgcatatggagaacaatgttctgtgtcctggctgggcatggtggctttcgcctataatcccagtactctgggaggctgaggtgggaggatcgcttgagcccaggagttcaagatgagcctggacaacacagagagacttcatctttacaaatagtaataaaaaaattaactgcatggtggtgtgtgcctctggtcccagctacttaggaggctgaaataggagaatcacttgagcctgggaagtcaagactgcagtgagccgtgattgcaccactgcatttcagcctggggaacagagcaagactccatctcaaaacaaaacaaaaaagaacaatgtccagtgtccataaaggaagaaattggggagtaaacgtcatgtgaaaaaaaggagatttcaattggatgcaaggataagattcttggctgttagaatgatcaactctgtagtcagccttttagcaaggtcaaacggtctcagtcctggaaatattcaacagagacaaatgttctgagtgagggctattcatctacctggagtttggaatgtctgggttgcgggggtctcttctgattttgagaactgatgcttttctgataactgcagagaatagtcctctacttgctttgtctagataactattagcctacacatctctgaatagtacttcccccttttctctatacagttttttgaagtataggctatattacttctgaaacatacatgaccatagtcttgaaagggctccaagccatgtctaccactgataaaggaaacatttactcattttaaactcagtcattcatccatgtaattttaacagtggactagtccttgcttaacattgaattactaaagtgaaatgcggcttcctacacctgccttcctggtcaaaaagggaggatccacagagaacgtttctcttttccaggggacttgccagttttacaaagaaacagaggctctctttggaaaaaaattgaacttgtaacttacaattttagcaactgaatacatgtgagaccaggttagctgccttaactcactttcacagattgacaatccattttaacaggtctgcactcaaggctggtgtctgaagaggggagagccttggaggcttttaagcctttgatcaggaatatccacacaagctaatgccttaaaagcaaaggaattaaacctttccctgacccagttatcaaggcacggttctcgtggtctcaccagctggcacagccatccctgaagcctttggtcacagaatcggcaacaggagctggaaggagctgccccacgctgtacacttttgtgatatagttttctgtcagcatgtaccacgtggatccaagactgcctctaccccactcccagtgcccagatcactgaacgtaataccgatgtggtaaatgagcagaggaatggccaggcttagggagttccagccagcttccttgcctttgaatatagaatgtcaggtaatttaagtaaaataatggctaaaccttactatatgccaggcactgtccaagtgcttcagagatactgattcatttaactcacaactacccgacgaagtagatgctatcattttcatcatctctgttttaaagatgaggagagaaacattaaataacttgctctaagtcacactctaagggtacatccacgaccttggccaaggtcatttggccccagagtctgtgtgtttaagggccattctgggctgactccctgaagaatgggctctgttctgtcattgaaagtatttggggtcagagacattgtccattacagaattcatcaccctgaacatcagaaacctgcccttggatctagaggaaactttttcagctttaatgtcaaccttatttattaatttattctgggaatggtttttgggatttctttgcttctccatagacacaaagaatattctctttacaaaaaccttttattttcttgaaaatgggcattaagccacacttttgacttcactcgtttacaaaaaaactacaacccatttgatttttcttgcacagttcagtttttcttttcatctcttaacctgctctagaatgtcaaataggaacgtagtaggtaagttcttgtataccacattccttttgatgaatctcaatgttaagagagtttttcccataagaaaacaacagtgctccgttgtgtattcagcttatagttctgggtcacagatcctgtccctccacaacacttgtgcctgcctagactctcctttcctttatgtgaatcagtctcttgcaccacaagtttactttctactttcatttgagtctgtgtttttgcatttcatcctctctgtgaatttcagttttgtcatgtcccttttacatttgactctctctcatcttccaaagtactggcagtgtcacctcattgattatcatttctttattttctgcagctaaaaacagtaactgaagttgttttggaggaattcctccttgtggtctttgtactatgatttctatctctacagataaccaaggtggcaccatatttccctctcctgtgacagacacatggccaaaggacgacccatagtgtccacacgtcagtcagtgatacactggaggggcaggaccttctcagttccacctacaggcagcaggagtaatgcccctaccccacctcacccccagccctgcaatgacagataaatgaagtctaatgcttagggccctgtcagtctccggtgtttgtcataatctcatttgcaatatggttatgagcacggattaaaagatcaccgaggtccactctgtatttctgcaagaagtggccaccggccataaagaccccttctaggcctgacacagtgactcacatctgtaatcctgcactttggaaagctgaggcaggatcacttgagcccaggagttcaaaaccaacctgggcaacaatgtgagacccctgtctgcacaaaataaaacaataaaatttaaaagactagctgggcatagtggcacacacctgtagttttagctacttgtgaggctgacacaggaggatcactggagcctgggaggtcgaggctgctgtgagctatgatcccaccacgcactccagcctgggcaacagacaaaaaaaaaaaaaggaactatttctccactagaggtcgctgtgcttcccaggtaataaggcctaagggggctcagcctgaatcttcagtgtgagctagcaacagtgactacaccaactcaaaaactcaaagtagagttgctaagaatagtatgcgttttgcctggaatgcattagagataaagaagtgtagaaaaaaacttttaccaagagtccaaaagagccaaacaaaagctagcattcctggagagaggagaggtttgctaaacagaggccatagggaggagctcaagtttgctgagactccagacaaaagaagaaaaactgtgcaaagaaagcacagttaattgaattcccaagtagctggtgagttacttgtattcaacgtataaatttcaagccacaaattcagctatgcaagaaatgtaactttattatttagaactgaacctaaatttcaattttgagtgtataccactgagtggtggaagctggggctgataattaaggtcctccaccccaaccccactatcccaagggatccagggtctctctggttcccaggcatatctgagtggggtgcacatctggtatgggtcatcgttacctgttcaagttcctcagaatgacaagacaactccatggggccttctgacaggcttttctgccctagtgctcctatactagggggttctctaagggattctgggatcttttcatttgcctgagtttaattctgaaacaaatcatgggtcttctatactctgggattccctgaaacaatggagattctgtacgtggacacacatgcacacatggcttgtgtttctgcacatgcacgcgtgcacacacacacgcacacacacatacacacacgcacgcacacacatacacacacgcacgcacacacacacaggcacagtttattattctcagggaccttccagaatctaaactattttttctgtttctagctgggggctggggagtggtgctgagggttgagagtatgctatctcttactaaacgttctcctaaaatttttgtttatggcaaaaattgtatgctcctagtccttcaaggtttaggcttttaaagctaacaagtttgtgttcttgaagcttataaagctcctctctgcttttcttaggaatcatcccacccctggggcaatgactgctgctgactgaacagagggagggcccagtatacaaggaaatagggagggagggagggagggaagccccatttactatctcagagctgtgaaaccaactgtaaatcagaagctcgtttggtttgaaggttttagcaattcctggttgtagaaaactaagggtccaggcttagacattcttggtccttagagcaaatgttattggggactctaggggacagcaaagcatctgtttcaagagatcgcacaggatcagtaaggacaggcaggaatttctctgttccgtgactgactttctgacccaaggctgggcagttttcacaaatgaagtttggcttccagtgaaaaaccagccagttctctgtgaacttttaatcctttgttcaaattttttattgtttcctttgtataatctgctctgtgcctggagctctcatctgactcattctatagaataatcctataattgagggtgagcaccaaatgtcctaagaagtcctcgtggaaaaatcacactctgctctccacattagaagctgtgtatgtgcaggggttactcaactctcttgaatcctgtttcagatggctacgaattcctggagatcctgaaacaggttgcccgggacaatactgacaaccccgatctgagcatcctgtggatcgacccggacgactttcctctggtgagtggctccagccagcgccccaccctcagttgctgtcacaacctcatgattgcgttcagcatctgaggaggtgaaataggcaggggcacttgaagaaacccagtggcggtcctcacccagtgtgggaggtcttggcccttggggcagtattgaacttggggcctggtgctgaccctgaaaggattcggcttactccctggagtccaggagttgaaaacccttgaccctcggggtcccacccaagtgagcagggtaaactccttcggcagcagctccagagctgcccctcatcactccattcccagtccccagaactacttttattttctgggtggggaccatcgttctgaggccacctgaattactaagtaataaaaatcagagatgaacatttttcagcgagttcagaactttgtggagagaaagcgagcgtgcctgtcatgttcatcgtgttctccccaggacctagcatagtgtctagcctacgatgaatgtgaaagaaacttcaagtccacacttttgctagtgtgcatgatcaatggcccgaaacttttgattatacttagtttttaaaaaagaataaacagcatttgtacactacatgtattgaaccctggtactggttctggtgctgataataagtactggtactgataataagcatagctgatatattctactgtatgcctggaactagagtaatactttacatgcctcatcacagcgaatcctctcaacaaccctgtgaagtaggtactattataatccctgtcacaaggtggagagaatgatagctggggaggttaaagctagtgagtgatagatgtgatattccaatctaggtctacatgatgctaaagcctggtctaccgactgctttaggtaaatgcttattgaagtaatcagtacaagtttagttatcattaggttatgaatgatgactttatcttccaggaattatcattagttgcataggtcatgactgatgatactgtgattaaatagagaaaattgagagggatctcaagggtcctgaaaatcagccctatgtagaggagggggtgaatcaaaggcagaggcttccatgacacttgagaccaatgtcatagcactgggtaattataacaaagtcatggccatataagactgcatacagtacagctttgttgatatagcttctgcctggttgtgtttctagtttatctgactattttgttatacaagcttgcagatggtttgcagttttcctggccagtttttttttgttttttttttttgagacagggtctcactgtgtcacccaggctggagtgcagtggcataatctcaatttactgcagccttaagctcccaggctcaagcaatcctcctgcctcagcctcctgagcagttgggactatagaaatgtgccaccacgcccagctaatttttaaaatttcttgtagagacaaggtcttactatgttgctcaggctggtttcaaactcctggactccagtcccaaagtgctgggactacaagcatgagccaccatgcccagactctcttctggccagttctatgtgtttgccttggtttttgcaaagaagaaatcttcagactattctgatttccagattcctgaatatccctagtccccactaggccatatatttgcgtgggagatttcctaccactggacatctccattaaaaaaaaaaatcctgtggccccttgctcctttatttttgccccagtcagagatttgtccacatggagtccaagcctggttgaatgaagaagccttcttcttacttggcaacttatgacccatcatggctttcccagctatctcatgtagcacaagataaggtatttttaaaactgggacattaaaaagaggtggagggaaatggctctataaactataaaacagccacaagtaatttggaaagcaacattagaccacctctataattttctctcttacagctgcagacacatgtttccataatttatgctgtgtcatcttttatttaatgcttatttgaagtgcttgaaggctggggccaagtcttcaatttgctaagtgctcacagctgttttgaagacctttaaccaatggtgacctagttactgtgatgggacggcgggtgggtccttaacagagaatgccctctgcctgctgtctaatcttatttttttgttgctgcagctcgttgcctactgggagaagactttcaagattgacctattcaggccacagattggggtggtgaatgtcacagatgtgagtatcccctgtgaaggcttgctcaggcacccttggcctgccctgtcttctgctacacagcttagattgtgagagcatctatagtagcccagccttttcagaagagggcaggggtcctgctcaaggaaacttgccagtgtgttccacgcctggtctccgagccagtcccaatctgtggttccatggctctcttccatgggcacattttcttgcctatggggccagcctttcctgaatcactgatttggaactttcccttcaagtaaactctcctgtatttacccccaaagtcaaacagcaaacaaaaaggtctctttacaaaagggaacccacaccaggagccatcactgcacaatgggtgatggggccgttgtggcctagaatcccaggcaggcaactactctacaggcaggagaccaggcctgcagaagggaaggaagaaaatcatatgcgagtaaggggcttctcctcagagttcaggcattgttgaaccgagggtgggacaggctagtgaggtacactggcagaatgcgaggaaatcttagatctcagtccatacatctcatacaactccaccatcataaaactcaagtggggacagatacaatcaggcaaacagtggacagaaagggatgatcacagaggattattagagccatacttaattaagatagaatctcttaagaatgggggccaagccaggcgtggtggctcatgcctgtaatcccagcactttgggaggctgagatgggtggatcacctgaggtcaggagttcaagaccagctggccaacatggtgaaaccccatctctactaaaaatacaaaaattagccaggcatggtcatgggtgcctgtaacaccagttacttgggaggctgaggcaagagaatcgcttgaacccaggaggcggaggttgcagtgagccaagaccatgccattgcactccagcctgggcaacaagagcaaaactccatctcaaaaaaaaaataaaaaagaatgggggccagttagcaatgtctttctcccctgttgataggtgttcaatcacctagggaactctacattcatttattttgtaagctactttaaaattaataataatacattacttttaaaacatgctcaagtgaaaacattttaaaacagaacagtagattagaaggtcaaagtaaaaagtatttcctactcccctgacccaacccctagtctcattcctggagggaaccactggtggttgttgcatgggtatattaccagaaatgtcatatatattccactgggcaatggaatacacatttccttttatgcaacacaaacagtatactacacataccgttttgccgtttggcatttccatttaacaatgtgcacgttcctaataagtgtaagagagtcggggggcactcagcatagctattcagcacggctatccctggtctggttcagccctcatgcatttacccactcattcattttgtccctcactgcaggctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagagggcttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttg

SEQ ID NO: 36913 - DNA, 24282 bp, Homo sapiens; identical to SEQ ID NO: 36544

SEQ ID NO: 36914 - DNA, 23306 bp, Homo sapiens
gcagaatccaggggacggttgctgagcgggcctgggacagcgggtcgcggcacctccggcctgcgcgtgtctaatccgtctgtcgggtcccgaaagagctaagccgagcctgcgccggacgggtgggctggactgagaggtgggtgtgcggacctcgggggggatcctggtgctgccccaacgtgtccgggggtggaacccggatgtctagacaggagttctggaacgtccagacctgggagcccccacccatacgagaggtctaagccatgggataaagttatgagactgttgggggaagacgcccccggattcctaagagactccacgccccacaggggcgctagtctgtggcggcagaaaccctggggaagctgccacagaatcctgaggcccctcacaatgtccggcgaccccagactgtgtgacagggagattggagaagagcagcggcagggatcttcttataatcccatgggtgtcctagattaggcattagggtcagctgccccatagaagaacagacatggggggaatcagaatgtccgcagaacctaaggctggtgaccactggacagtcttgaagaggtttaacccagacagagtaactaggtaagaggcaaggatcctaacaggcagagattgggaggttgacacctctgagcctaccaggatgggagggggaacaagcagtgacttgaacaggctgggacccacacaccccaactgtgtggagcggtaaccctcaccccccacccatgcaccgtatggggtgacttcccaagtgactgttctgaagagagggaagggatgattgaaagatgaatcaacaggaggtggggggcaggcctggggccacacattagtcagtcaccatacattaactaagcatccacagtgtgccagaccagggcccctcaaattccagacagacattagttggggctacaggaggaaggagagatctgcgctgggaggctgggccaggatttaggggtccattttgatgggcagcactggggcaagatggggctcttgcctctgtcactgagagtgttccaggcccttgagggcactttggaagggagcttcggaagccggagatgacgaagattttgattacatccttctctgccctctaagtctttggcttcctccttgctcagtgacaaatccttggccctctccaatcttctcagtttgcctgaaatccaggggttgggcaggtcagcttctgaaagcccttccaggtggggaattgaattctgtatgaattggcaggaggtgctgggtgcctggacacctggcttcaggaggtctggacagcagagctggctccaagaatcggaagacacagtgtaccttcctatacctgggggaatgacagtggtggtggcagcaagaactacgggttcagcccacagccagaagctgagcctgcggagtgggtgggggctgggtaggccctgtggatgggtgggtggggcaggaaactggagactggagtgcaccccctggtggtaagcacagcttgggtgggtcttgccaggccctggcttctcaatccaggtccctgccctccctgttttgaggtttagacaggatgagagtccatcccaggccacacagcagactggcggccaagctggcagggctggaaccagagaccccctaccctgggtttggtgagttttccagcaaaccaccctagggcagagggcagcttccagccaggagccacattataggatgggacagtaatggacgctcctaggttagagagggaaagtaaggcacagagcctaagtgcctgtggtttctggaagccccagcatgcctgattcatgtctgtcccctgcagaattctctgagctggtgacaggtgccacaggcactggggatctcaccagaaaggaaccgacggagctaggggccagcgagatggcggacgaggccttagctgggctggatgagggagcccttcggaagctggtaagtggccccatcacccactgtggggacaggaaagccaagccagagaggcagggtcaatccagggtacctctcagctgacaggaagaagtgatgggggaaaggtcaggaggagggggacatgggaacaggggtaggccagttccatgtggctgatgcagaggcccttgtggcatgtgcctgtccatgcctggtactgaagcctagtccctcccaaccctccacagccaccacctgtttaaacagtaactgctgtagactcgcccgtatgcagccacaggtgtggggaggctggatatgcctctccagagcaatagctcgggcaatgcccacccctggaagctggcccagtgataatggtagcagcaatgattaataatgccaaggcctggcagggggcaggctgggtactgggtataccatgtcacagaataatcacagcagctctgaaagcctgggcactgcgactcaagagagttaaaatcacctgctcaaggacacccatctaagaaggagctgtgccaaaatcccaaccccatagtgggccacgggggaccagagtcctgggaaagtcaaggctggacgaggccataagagagagacaggttttgtgggcccttatggattctgtggcttctcatctcatttttctactcttgagtctcagttcctctacctgtaaaatgaagggagggagggagatgtgtttgcacacaagctctaggtcctagagttggcatggggacagaatgaggcatggacccagatctcaggtggaggaaagatgagcccactccatcccctttcttgttcctcttcctgagagccctgtctacctccatgcacagaggccgtagggcaacccagtggggcagggctccttccccaaccccaaaggccaggcagcctgacctggaggaggggccagaggagctccatctcctcagtccctgacccttgtccatgggggtaaattaaagatttactttacctagaagacaagtgacccaccccactctcataccttcccccgcaggcagaggctggaaccaaccagcgtagcccagccactgggcagtgcccagctgctgccatgacctccccaaggcactctgcctgtatgttctcggaccagcgcattagactctctgggtgtctgcctctccactatcaccgcaggatgtgtgcagcctggaggggatgaggttaggtttccaaaggtgcccgccagtcagttcgaccttccctcaggaagtccaagtcccagtgggggtcgtagaggcagcacagtccaaaaagagggaatgccaggcctggttcccgcacatcctcatctcaaggtatccacaggcaggctcagggttcttcagccgccacctccctctcttaagcgaggctcgggcggcgctggaaaagagttttggagagaagctggagcagtggttgaatctctgggaaaggacagatgagaacctgccccggtctcgggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggtgggcgaggcgagggcggcgccctgcgagggagggcggtcgcagaacctgcgggccttcagcgccccctggcgaggcttccctccaccgccggcgggacccccatgggcaaccgggggagctgggactgaaagcctggagagccccctccgttgtgctgttggggagactgaggcccagtgagacctcagggcctgccaggcgttcccaacagcgagggcagagagtacacggagagccggctccccagggggaggaagcaccctctttcctcccgggagaatttcactgggcagtttcggaaaccgccccatccccttccccttccccctcggtagacaatggcgctttgtacttccttccctccctcccacagctccctccttacacagcggtggggcctgggcgggtggaactcgggacacacagaggagacactgtggtccaacctttgcctccaggcccaaagggaagggtcgtgccagagggtgaccagtggaatgaggttgtcagtctccagccttgcccacccactttgggggatcagagggaggctcccattttccagatggggacactgaagctccgggggttgtgctgtagaggtggccaagttcctacatcaggcttttgtcagagacaaggaccccatctccgagcccagagcactgagaatggggacctaggagacaaaaggctagcccttgcccctctgggcctctttaccctctgtacagaaggggctggaccctctgtcccctccagcccccagcctccaaatgtaccacagaaggctctaggcctgagacacagccagcaccgggggctggggagtgagcctcattccccccgcctctgctataaggcctccttaggcctcagagcatctctagtccaggctagaggggtctccaacacagtgccaggatccctgaggtccccaccatgacacacagaccccagtagcagagctatcttcagcctagggcaggccctggagtcagagagacctgggttcaaatcctggctcaggtcatttgaccatgagcaaatcacatgtcctccctggacttcaatctcctcatctgtcaaatgggaataacagtagtatctagggtttttgtgggcttaggacaagtagggggctcagcacagggtttgactcacaggctctccataaatgttactgatgcctcggggtatcctgcccttcccatttgcccccttgtctctctccctcctcctgactggctagaaccaagtatgggggtgatgcttattgcaactgcagctatgtacaggagaggccaagtcactgttcccaaccccacccactggcaaatgaaaaaaccaagacacagagagtttaagggatatgctcttgatcacccagccaggattggactagggctggaaccaactaagggctctggcctgagtttcagggggtcttctcataattcctcaggaatgtggagcctggagggctcttcccccaagactctccctgctctcttcagactaggacaagctggctcatggctgagttgggccagcccacactccctgctgaaaactatctccatcccatccccacccttgccacctggccttcccgctaagcagaaaggaatgacgggggggcgctaaaaagggagatgatagagggttctttggccctacccctgaatgatttggggggtggggacagaggaaatcaccccgcctttactggctcccgtctggttatcagacccacactggaggcttatctctgccactatcttccaggggaaccctgggccagtcctctctcccttgagccacggaggatctgtatgtagcaggtggctctacatggtggaggtgtgggggaggcaacaggattggctgactcactccagagaaggtgttctttcctgaacctggttagaccagtcacccccaatttcccgggaactgaggggttgagaaccggtagaagcagctgtcacccagggatgccctctataaggccctggggtggcccctagtgccagccaccttatatgtctgggggattggtcctcccactctgcaccctggcttcttccatggtggctaggtccaggccagtgcagtggggacaatagccctcagccaggcaggactcctgagcacctgtcctcagtttccccatctgtggatgaagcagtcaacccccagctgggctgtggtgtttggtgactagaccagggagcctcccttgctcagagggtggacttcatctgtcacctttccctctagggaccctgttagtgacccacagggtggcctccctcctcctcctacaatagctccctgacttttggggatctgggctctgagaggcaggaatcgagttgtagaaaggagtgcctggcttggcacctggcacaagtgggcagtttctggctgtccactcacagttgtgtgctctgtgaaccacaatgcaaagtggactacccaagatccctgaaacagtgggctgggtctacccccgggaccctgcgtgggcaggcaggcacgtgaagagcttgggacacagggagtggacacaggccacacattgtgccctaggcagagccgtgggcagctggtgccagccctccgcccctggcagccaaaatgacctgcctctcgcacccactgcagctggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcagtgagtagcggggggtggaacatgcgggtgagaaggtgagtgtgagccctggctcagctcatgtgtgcaggcaggcgtgagcacaagtgtatctgtggattgcatgtgctaatggcagtacgtccacacacgcttctggaaaaacagagatgtttgtgggcatggagcatgtactgattgtggcgtcgcggccgtgctgatgtagccagcacgtctgagtgtgtggtattagtgcccacgtccatgggcatatgtgtatcagtgtgcagttagagggtgtgcacagccacatgcccttctgccaaggttctgggtactctgttctggctcctacccttagcccacatcctccacgacctggccatggcagtggtggttacagtcatgatgtctctgcagctctcagcagcgggaagctgagcagcgggctgccctggcacggctggcagggcagctggagtccatgaacgatgtggaggaattgactgcactggtgaggcccaggctggggcaggggatgggggcagggcaggtgaagacctggactccacagcccaacacccgcgacctgtctcttacccacagttgcgaagcgctggtgagtatgaggagcgcaagctgatccgagctgccatccgccgtgtacgggctcaggagattgagggtatgtggcctgtcccggccccacccctgccctgctgtctgctgtccacagcacctccctgtcactcacctgccacttgctccttcccttccagctgccaccttggctgggaggttgtacagcgggcgtcccaacagtggctcaagagaggacagcaaggggctagcggcacacaggctggaacagtgtgaggtaaggagggtgggagagtggcccagtgtcctgtgcccatggataccggtagcacagagtgcctgagtgtctttgctaggctggtatttcactgtaaggggcccacccctgccatccagcctctatttagcagtcagagggatctcccagaaatgcaaatccggccctggcacctcccctgcttcaacccgtcccagggctgcccctcaccctccacacagcccacatctttaccttggcttatggggcctgcatgtcagaccccagctggctcacagttcactctattttccagagtgtgggtgagaggtcaggccatgcaggttccccaagtggccagcagaggccgctgggtccacggtcctggcaggaccccactcccactccagatgaaccaggctgaggccaggagtcaggaacctccactccagggatctattaaggctcccgtccccaataggtctcctgccatacccacccactgacatcaggacctggtcctctctgaacccctttggctaggtagtgccaagagattgggaagtggggatcagagactgcccttagcatgccagtgccagtgcttgcgcaggtgtgcctacaggaagccatgccccaccactctgctttgcatgccctgccctgggcacttgccagcctggccctcagtggtgggggtggcgttcaaagcctagggagccttggttgcatcctgtgggtcccttacaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccaggtggtcaacaaggtgagtctggatgaggggcagggatgccaggcaagtgagcaggtctgggagtcaggccttgctcaggccctgttcttctcccttgcagcttctgtctggccccaaagagacccctgctgcccagagccccaccagaggcccctctgacaccaagagagcaggtgagggtcccagcaggggtagtcacaggcatctttcttcccctccccctgcctccctttccctgcctagaaaatgggctcttgtgcctggcagctctagcttcctcaggtccatgcagtccctgatactgcaccccacccctgaagtgtccccgcccccagctaggccagcctccccctccacccccatggctagaggcctcccctgcagccttgaaaggcaacgggcctcaggcacattcttctccccaataagggagtccacccatctcccagctggagctgtgggcagcactggccaggagggctgtcccccctccccatctgcagaaaggatctgggcacccttcctccagcctaagcctcgcctggcccccaggagtgtccaagtcatcctagggtcagtgtggcaggagaaggaggtgcctgtaggagagatgcagccgagtggggatgccggagtgtgggagatccaggaggggatggagaggtggggtgggggttgagtacaggaaagggtgggaagctagggaggtgtagaggagaggattatgaaaggtggacacccactatcccctgtcttttctctttccccacatggccatcaccccctccccaacctgccagacgtggctggaccccgaccctgccaacgctccctgtcggtgctcagcccccgccaaccagcccagaaccgaggtactacctattctcaccctgcctaggatctgtgcagaccctgtcccacccagttgctgacagccctcctgttccttctagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccttgaaaacagagcaggggggcctgtggcacgttcagaggagcctggtgccccgctgcccgtggccgtcggcactgccgagccagggggcagtatgaagaccacattcaccatcgagatcaaggacggccgtggccaggcctccacaggccgggtgctgctgcccacaggcaaccagagggcaggtaggcgccccccactgcctccccaatggggatgagtgcctgcaaccgcacttctgcatgcaggacaggtgctgcggccaggactcagggtgtctccaaagggtgtgctgggagcgagggcattatcaaccttgtctggcactgccctcactccacctgatcctcctgacagccacctttctccccactcagaactgacactggggctgcgggcgcccccgaccctactcagcaccagtagtgggggcaagagcaccatcacccgtgtcaacagccctgggaccctggctcggctgggcagtgtcactcatgtcaccagcttcagccatgccccccccagtagccgaggaggctgcagcatcaaggtgagcccctcctcaccccaccagcctcaccatccgtcagcctcacatacactgcttcagggtgtagggctagcagggttcctctgctcctcccctactgcacacacagagaaaccgaggcccagagagggaaggtggctgctcacagaccacagccagtcggtggcagagctaaggccagaccctagcatatcagtccctaagtgtgtcggaagcttactctgtactggcgttaagcttcctggatgctgatctctgatccttagttcgaaattggttggttcattcctggtgaacagatggggaaactgaggctcagagagggtggtaagggcttgctcccctcttcctgtggcagccccagtgcccctgcgcccacccacactggacatcagccccgaggtatagagcagctcatctgctcatccaagatcagcctggcccattaggagattggagattagtgattagcatctgcgtcaacctccctgtgggggttgggcagaagctctgaggggggacagacaggcagaggggcgccaatcaggtgaggcagcagcctagcaggtgccttgggaactgaatacgcagcacccttccattattcattcccaagcccaggatccactagccgggagctcagccgggaaagggatccccaagcgggccacccggctgcccaggtaatgccctctgtgctaaaccagggactgaatgggactttggctgaggtgagatggctagaccagctttgggccttctcaggggagacagggagagagtgagggaaataaagcacccttcctttccaaaaaagcaggatccagctgccctctgacaagggattgtgtggggtggggtggggggacccgctgaggcccttgaggtggatgggaggtgccacagtgagacctgggtctgacaccaccaacttgcctcagtttacccatctggaaccaaaggggacaggtgatgtacccataatgtgcttgctcaaagtctgtggttggacgtgagcaccatgggcaggccagagggcatttatgtaagaccaagacactttttatagcagatcactcaaagtcctgcctccctgtgcctccatttcccccatctgttccagctgtctaaaacagctggagttagggtaaagggtaaaggagtacaggctgtggagtccagcagactgattctcacagctaatgtacatggtggctaggccaggtccattccctgttccctgcctcagtttccccacctgtgaggcatggggccccgatctcagtgatcttcagaacccatgcagtcttactgtgctgcaggcctatgatttctgtagggctatagccaggcctggcgatccgcctgcttgggcaggccccccctcccccactgccccttccacggaggagcccagaataggtttctatttgggctgcagctccagctggctggtggcgggctgggaggcaggggcggggcaggcccgctgcccttgcctttgccctcggaccagctgcaaagactcagacactcagccagagacagcagcccctgccactgccccaccattaccccccatagagtccccaccagcaccatgccgggggtaccagggcctgggcctgagctggccgcagcccttgaggagcagttgggccgggcactggaggagctgcgggcggtggctgaagcaggccgggtggcagtgacccaggcagccgaggtagctgtagccaccgtggagccggtggcccgggcagctgaagagctgcgggcagagagagcagcactgagccggcggctggatgcactgagcaggcaggtggaggtgctgagcctacggctgggggtcccacttgtgtccggccttgagcctgagctggagcccagcgagctgctcctggctgccgccgaccccgaggccctctttcaggctgccgaggatgccgggacccccgtggcccacccacctgccttcagcacccgccgccgctcctccaccggcaccacccgcagcactagtctcgtaagtgcttctgggttggtgggaggggtagttttgagccaggctctgcctcctcttgactttaggtatgtcaccaccttctctgagcctcagtttatctatcttgacaggggactggggcactagtgctctaagactagggcaagagggtgccaggctccagccctgaggcatgtgtggcagctgccttggcagcccctggcatgacccaggccccagcccccagctccctgccgccctgcaccctggccagaccaagcctccctgaaacagctgccacctcagctctccttacccttatagcagacggagaggccctgccaggagaggaagggccataatagttggcttggggccttgtcttcaaggggctagggagatgccctgggagggctgcagggctagagactccttagaggatggtttccagcaggggcgaggcagggggaggtggtacagaggagagcttcatagaggtcttggctcagggcagccccagtcagacacctggtcaggagcctacaggccccgggccagccctcttggcaaggtagcaggcagatggggggcaacatgtgctgcctgggcactggcccaggaggacctaggcctcgggaactggcagcacagagcagagcctgcctgggagggggctgggaacaaagcagcaaaatgaactaaggttcaggagttaggctgccttcagctcagatcccaggctgcatcacacttagagagagactgtgggcaagtcagttagctgccctgagcctcagtttccccttctgttttttttttttttttttccggtcttgttttctttgcaacagggtcttactctcttgcccagactggagtgcagctgcatgatcatagctctctgcagcctctaactcctgggctcaagtaatcctcctacctcagctttctgagtaggtgggactacaggtgcacaccaccatgcctagctaattttttatttttgtttttgtagagatgcggtctcgctatgttacccaggttggtctcaaactgctggcaacaagtgatccctcccacctcggcctcccaaactgttgacattacaggcatgagccactgcgcccggccttcccttctgttaaatagggacagtaaagtccctagtgtttatacaacacttactatggactggaaatcatcattattatcactatccattgtattaatacaattcggggtacgtgggaagccctacaacaaaactgtcagtgcctcttccctgactgacgctgacatggccatctttgggcaggcaggctggcaggctagtggttatttccaaggcgtgccagcaaccctaggatctgcttccctatccattggagacatgatgagtttcacccatacccctgcttaaagtccatgccctctccccaccctgcagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactccgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccagtaaggggccaaatggggccggcccagggctcagggtgggaacacatcctcccccagccccctgtgcctttcacatccttctcatcccctgcccctgcagatgatggcacacggacggcccgcaccaccacagtggagtcgagtttcgtgaggcgctcggagagtaaggccacctggtgtcgccctgtgcctgcctgcctgtccgcccacctcctccggctcttccttgagctctctctccgtgtcttcaactgtgccgtcactttctcttctctgcctgcggctatcaccacccctccatacagcctcccatcccatctcctgatgtccagcccaggccctcacctggtgccccttccccttttttgcagatggcagtggcagcaccatgatgcaaaccaagaccttctcctcttcctcctcatccaagaagatgggcaggtgagcaccagcacccaatccctgaccatagaggagtcagtgccacaggggacctaactgcaaacccgttttacagaggggtgggctgggcacagtggctcttgcctgtaatcccagcactttgggaggccgaggtgggcggatcacttgaggtcaggagttcaagaccagcctggccaacatggtaaaacctcatctctactaaaaatacaaaaattagccgggcgtggtggcaggcacctgtaatcccaactactggggaggccgaggcacaagaatcacttgaacctgggaggcggaggttgcagtgagctgagatcactccactgcactccagtctgggcaacagagcgagactcagtctcaaaaataaatagataaataaataaataaataaataaataaataaataaaacagaggggtagactgggatgctgggaggtaataggtctatagccagggaggggcaaagtgagagttaaggatcctgctctccttgggatctcattttattctcaaccacaccacaggagaggtggatgctcagggaggccagtgagttgcttaggggctcacatctctgagtggctgcaatagcattgaacacttacagaggcctacctaccacactgagctgcctggtggcactgccacttcccagtatctgcaaaccatgtcccaggtcacacagcacctttataccttagccccatgagaaaggagggtacccccatgtaacagaggctgttggggctggcagaaagcaggaacaggatcagaatccaggatgagaaccaaaggggtccagagactctgaatcagagagaccttgttcaagttctagttccgcccatcacgtcctctgaaatcttaggcaagttactgccagaggtctcagtttcctcacctttagtggaattggtaaggcccctccctgctcttgtgaagtttaaaatggcacacaggaaaggatcaacagagatgaattattattattactattattatgctagtcatcatttttattatcggatagtgcccagaagctgaactcccctgtaacttgagggtacaatgaggcttctcagagaactactcgtgggtgggggagggggaggcggaaacctgttgaaaaccttgctgtcatttgagactcagtgtactcctctaaaatgcgtgtgatgaggacgcctccctccctggcaggcgtttgtggcagtggagatactagtgtgctacaagaccccccctcctcctcgcgagtggtggtccaggctggggagcagccctgctctccctgcctaacatgcgcctccccaacccctagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccgggtgagctgcagaagtgggctgggcagtggggggcggggcgtgataggcagtggggggcggggcttgatagttggcccggcagaggcgggaagaccgcgcggctagatctgtggtgcaaaggcccgaaggtcatggaaggcggggcctgggatccactgggtgggcccaccgaggcatgccccttatagtcgtgtgacctggtcctgacaccgcccctacagcagccctggcggaccccgcgcagccgtgcagcgatccaccagcttcggggtccccaacgccaacagcatcaagcagatgctgctggactggtgtcgagccaagactcgcggctacgaggtgagccccgggaggccagggggcctggaggcctccccagaccccagctcaacacctccttcttagcagagctcctattacccagtacacttcctgccactgtgtggcctcacagggaacatggaaaggctcttggggtgaggaaactgaggctcaaagaggacacaaggcaagccctagattccagaatcagtgatgaagtaacagggcctcttgggtggtgggcagggttcaaggccggatcccactcttggagtcccctccttgttgctctgtaggaggccctgagtcaatttctctaaatgagggaaggagtgatgaggcatgaccatagccttagctgggtggcgctgggcctctcagtagctctgtcccttgaaattgcaaatatgggagttgacaggctgacttggaggaggctcatgttccaactattcactcattgtgcaagctacggggcctctttgtgcccagtgccctaggtctggaataacagaatgctgaggggtagacagcaggggggagttgcccccaggttcctgaccagtcctcctacggcttatagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagtaagtgtgggccctggccctgctaatgttgctgcacatctggggctggacatcgggaccaggcccagttgccctgagaacccctggagcgggccagccacattgtcagtcagcggctgagacccccttccccagagagtccccgtccttctccatccccacccccccgctgctgagcgtgccaggtgcccgccggaacgaaggagccgcaggccggcctaccagcccgggccaaagcccaccaggtggccctgtccatatcccctccatcctccctctgcccccttctccctctctctccctttctctgtcctgctctcctcccactatcaccagagcttcctgctcccacgggatcccggctggagattccaaaaggaggctcctggcccgggcaccgtgcccgcccagcctatatagtgctgccagaggcttatataggacctcagcaagccctccactttggaatcgttgccccgtctgctcacctcaccctcagcacccttctccatctgtcttcccttctttccccttctctttctggtttccctcaaatttcttcctcctcctccttctcctcttcctcctccccccacctcctctcacgcctccctcaccccctctccccggggcacagccctcctctccaaccttggtgccaacgccatcgcccccaccccgcgttcccgcttgcccctagagttctctgcacctgtgactggtttggcccccacccttgtctgcattgcacaccattagtgatgggtagtgagcggcacgtccacagtggggaggaggcatgcggggggctggcagactgcagcactggaatcgtaattgaactcatgtctctgtgtgtgtgtgtgtatgtgtgtgtgtctctgtttcctcccctctctcttctctgcctcttccctctcttccccacccggggccctggcctcctgcccccgtcccccaccccttcccggccccctaccctccccaggacccatgcggactgcccgcagctcctggatacagaggacatggtgcggcttcgagagcctgactggaagtgcgtgtacacgtacatccaggaattctaccgctgtctggtccagaaggggctggtaaaaaccaaaaagtcctaacccctgctcggggccccacggtgagaaacgccgcctctaccacctgccccgtttcaccagaatctgctcagcaaggccagagagggtccagggaggcgggtgggggaagtaaggggggcatttagtcaagccagaggagccagacatagccctgtcttctggcagttcagggcccagcaggtgagaccattctaaatgggcagtgatgacccaggtgggcagcactgtgatgggggaagcccaggggagatgcctgacccaggctgcaggtctgggccccccatctgaaaaaagtgcaaactaagctgggatctgaacaagttcaggctaaaggagggagagggagttccaggcagaggaatcagcctaggcttagcagggcaagagagctggagagcacagcacatcaggaagggaagaaacttgagtctggatatgagggaggagggggccacagttagaagtttgaccttctggccgagcacggtggctcatgcctgtaatcccagcactttgggaggccaaggtgggcagatcacgaggtcatgagttcgagaccagcctgaccaacatggtgaaaccccatctctactaaaaatacaaaaattagccaggcgtgtggcgcacacctgtaatcctagcgactcaggaggctgaggtaggagaatcacttgaacccaggaggcgaaggttgcaatgagctgaaatcatgccactgcactccagcctgggtgacagagcgagactccatctcaaaaaaaaaaaaaaaaaaaaaaaagtttgaccttcctcctgaggacaacaggagttataaagggtttccaaacagagaagggatggatatagcattctaggaccttcctcggatgaggcttggatgagagatgggatggactagatgactggaatagcttaagagctagagagacaggcttcccaatagatctggtttggagagggagagggaaggtcaagaagtctgccaggctcctgtgtgggcactggggagttggtggtgccatactccaaagtggggagctcaggagcaggaccagttcaacaggaagatgtttctggctggggactctggatcctaagccagctgtggcatttcctctctggtcacctcacctcagtaccaaagtaaagaattcagatcctaaactaactaccccattacagacaaggagctcagagagagacgtgggctaagactgtcctgggggtgggagggagagggaagatggttaggtcagagctggggccagaaactgagactccaaactccccacttagtggctgttttccttgccccatcactgtgttcccgcccattttgtagagaggattgaaaatagaggcccagaaggagcaaggggattggctgaaggaatgtgagtcagtgacaggtaggggcacactcagatgcccctcagggcctggagccattgtggggggcagtccacatgtgcacacacacactcagagaaggagcacagatgagtggcggatgggcttggtgctatctccagatcatatatggacttaggagctgctgcccagcaagccagcttggagggagaggggcccagcccagccctgatccagttggaaagtgtgactcagccgtgctgttgctcaagttgcctggtgtttggcctgtcactggggcagcctgagccctgagccctgagccccagtgtaaacaatggctttataaggtctccagggaagggagtggggcgggagggagcaccaggttggagagggcggtcgggatccccaggacgatagccacagctggaagaagcttcagagagaggctgcctttgcatcatggtacagctcgggaaacaagcccagtctgggatagggatgaccctaggggcacgtggcacatcagcagcagacccagaaccctctcactcatcctaaattcttgtaaggtctcaaatgagatagagaataactgtcctgttctaaagagggggaaacagtcatagaaaagggccttatctagcacccacaactggttagggatacagtctggactaaaacagaggtgttcggtgttctgcctcccaggtttcttctctgaaggagtccaggtgagctgggggtaggcccagccctaccacagttctgagtttgtccataagggcacgagatgggaggtggtcttgggttctcaggtgtcttgagaataaggagcaattgttgccattatgccttccctgccataggaaactcattcagcaacattgaatgcttgctatgtcccaggtatggcagataggagggatcaaggcagaagaggtcttgctctgggggttgagggacaggggaaaaggagccagagagcagactccagcttcagagctctgggagctgtcagttgcttaataggcacaacccactcactccagagtggggaaaaggctttgccaacacccagaactgggggcctgggtcccatgcggcctagcctgcacttactaagccatggggcttgaaacaaatggctcctctgctctgtgactcagtttccttatctgtgaagggcagctagcattctgaaggatggccagaagggtggtccccccgagcatggcatagatggtccattggtattggctgggatcctcatctgcctcctctgctctacccaaggcaggtgataagggttagagaacccctctgctgcccacacgttccctggcctccatctccagcagcagggttatccccaccccctgtcaaagaataggggtccctgggcctctcaacaggaagtaccagatcaggcagctagcagacaatcatcggtggaccacagggccactagagtgagacctatccatagataaagattggccagtgatgaagcccatctgggtgcaaaggccgagctgagaggcttctaccaactggagtgtgccagtgagggtgagcagaaggtggtctccagggagaacatgggcagggtttggagccagcacctccccagggttggaggaagcagacccaggacctgcctgactgggatggggctctcttctgccatctccgcctccacctgcctagctctgctcccccgccccgagagatgcctccaggcttgggtagatgaagccaggggcttcctgccttcctggaaggcttttccctgtctggagtttatgaaagaccagcaggcaatgcggcaataaaaaagaccttggggtagaggggcgccacgagaggcgggtctggcgctgacatccaaccccgtgccccctccctgcaggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacg

SEQ ID NO: 36915 - DNA, 186054 bp, Homo sapiens
tcgcgggccgaggacgcctctggggcggcaccgcgtcccgagagccccagaagtcggcggggaagttcccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcccccgccgcgccccgtctacaccaaccactgggcggtgcaagtgctgggcggcccggccgaggcggaccgcgtggcggcggcgcacgggtacctcaacttgggccaggtgagtgcggccggccccgcgcgcccaaaactttcccggcggcctccggcgcgcgcgaggggggcgcctccgcagtcctgtccgcccggccccggccccgcgcgcgcgtgggaaggctccgggaccgcttggggacggcgggcggccggggcgccctgcgggggggggtgtcgcccgggggggcgcgcgcgggacactcggcggggtgggggggactggggtcccgcgtgggcgcccacgcaggtccggcgcgccgaccgcaagtcccccggcagtgccgcccaaccccgcgctcggaagtgtggcctcagaagccggggcggcgcggacacctgccgggctccgggggagtctgggctgcctcaggcgtcgcgcgccgtccgccgctgggtcctgggcgcccacccggctctcccccgcgggggagcggcccctctgccctcgacgggcggcgcgagctccggacccggtgcgcgcgccaaggcggccgcggccgctgcttgggtgacatgagcgtggcccggcgtctcggggactcgcgctccctcggtgtccgcggctcccgggggtagatggccgggagcctgcaccctggagcccggccgccgtcggagaggccttgggacagcgcagggccgggggtcctgggtttaaaacctctccaggagcggagggagggcgctttgtgtgggggcttctgccgcggttctgatggccgagcggtgtgacctttggcaagtcgctcccctgacaagctcctttgcagtcagtggcaatgtctacaccgctgggttgtcggaaagatctaatgctgcgttgccacagagcctggaccggggcctgaccctcaccggcccccacggggccctcccagccccgcagccctcggctgtcccctcttctgtcagtgagcaagcaggccacgccctgggcacaaaggcggcattaccctcaaaggacctcccggcgggtccctttttcctctctcaaccagctaccgggctgaggggcggtgagttggggttgatccatgtttatggctcctggagaggccgttattttgaggtcacaccaggggacctctcagtgcagttaacaaatctacaaactacacactcagagggttaagtgaagtgacagggaagcaccgactcataactctaaaccttagtgccaggcagtgttaaatgtagtttcatcgttatccgtggcagaagccagcaaggtgtggtggcgtccctgattgatagaaatgacattagttctgcatcccaagccccacgttgatgtactattaggtgtgtggctggaggggtggattccaccattcgaatgaaggaatcttcacaaggcaggttcgagtttactgaaagaatgctagcacatctttggagaccttttaaatatatgcatatatatatataaaatgttacatatatacacatatacacacatacatatacgcacatgtatatccatatagatatttagtttttttaaccactcaaggccctccaaacatcctgtgatttcagattttgccgtcgggtagcactgacttcgtttgtctctgtagttcttgactctccctggctgattgtccaggctgaagaaggtgttcctcatgtttgcgtagtgcccctggctcctgccacacttcgctgctgtgcccaggtggcccagcaatttgtcttcagctaaaagtgactcttaaactacgcgataaattacaaagtgcctgggttttgggattctaaaattaaatgagcagaatggagctgaaattgagctgtgagctcacactgcaagagagaggcagagaggcacaggtaactctccccggaaatttctatctgtgggaataaaaatgcctaacccttggccatgccgcccctttgagacaacctctgtcaggctcactgagttcttagtgcagtctgctctcctggttttgcggatgggagagaagattcgccccgatgcacactccgtacccaggatattctggggagttaatcggggtctccccagctctgtctagtgcagccagcatgaatgccacgcagcccggtcactcaggcatggtgctggcagtggcactgcggtgacattcactaacagagattagctggttggggataggagctgtctcagaggcttgtgtgtgattactcacggagggcctattactctttattccaaaacgagcttttctttcccccctctaagtgcactgctaatgtggaaaaggcctggagcatttgagcctctacccactcaataagaactctttgaaaaccttatttgcctttttttcagccaggagaatttgtgactcataaataagatgtagatattattagctttgacttacagatgagtaaatgggggtgaagtaagggaaggaagctgtttgtgttcacatggtacgcatatgtcacctctgacagttccatccctgctcatttgcttctgccgtattctctgttctgaggtctcctttgtgaaactctttctccaagcccttaatgggcaattagtgttatgttctgtacttgcctgaatcgcagccctggttttctcccagatagtcgctgtgctcaaggttcttgcttgttttactttcttccatacaactaataactggattcagtttatttcacatggcccagaggtaatttagactggtggttattcacctttcttgtgtcatggctccctttcagcacctgataaaggctgtggatcctctccattgtaaaatatgcatcaccagggacaagacaagacagcctctctttgtccctctactcatcagtccaggtaacaccacaggatttcaaagggaataaaaatgtggaagtgtccaatgtcattatcggcagatgacataactacatggataatccaaaagagcctggagattaacccctggagctaataagggagttgatcagcaacagccacctgcatggcagcacatctgagaagacgaaagaaaccattcttcattcttgcataaaagctgttagatacgttgaaataggtcttttaaaaaggtgagacttttatagagaaacataaaatatttagaagaaggactgagaaaagaaagtttaggctgggcatggtggctcatcccagcactttgggaggctgaggcaggcggatcacctgaggtcaggagttcgagaccagccagaccaacatggagaaaccctgtctctactaaaaatacaaaaattagctgggcttggtgacacatgccggtaatcccagctacttgggaggttgaggcaggaaaatagcttgaacctgggaggcggaggttgcagtgaaccgagaccgcaccattgcactccagcctgggcgacaagagtgaaactccgtctcaaaaaaaaaaaaaaaaaaaaaaatttaaataaatggagagatgcgttgtgttcatgcatgggagggctggctctcatagttgccccaatttaatctgcaaattcaatgtaatctagtttaagctgtgacaagatttaatgtggaatatgaaatcacacaaatgaattataaaattcatatggaagagtaaggtccaggaatacctcagacaactctgggaaagaagaggaggaggggagttgtggtaacgacagtccagcagtagagtcaactcaaacccaagcatgtgtgggaacttgtatgtgtgagctgaagagttacaaatagatggggaaggatgggctatttactaaatggtgctgggagaacaggctctccccatggaaaaacaattagatcctcacattacacaacagtacattccagatgggattaaagactgtatataaaactttagaaagagctgcagtggaatacctttgtcacaccgggaaaggagtccctacacaagttatgaaaataaatttcaaaatgaagagactgatacattaagataaaaattctatgtaaacaaaggcatcctaacagagttaaaaagcaagaatagaccaggaaagtatttacaatatataacaaatacattagtacacagattattttgaaaactataaatcactaagaaaaaaagatacacgccaggtagaaaaatggggaagtttatgaatggagaagtcaatgaagagaaatccaaatgaccagtaaacataagaaatgatgcccagcttcactcaagttcgctgggggttattggagcactgcaatttaggcaacgatgagataccatttcacacctattggatttcccgacacggaagagtgttagcatcacgtgctggcaaggatatagagcaatgggaactttcagatgctgctggtggagattggtatcgtttggagagcaatttggcgatacacggtgaggctggacttgctagtccacagccagacatatcctggaagaactctcccacgtgtgcacaaagagacttgtataagaatgtccatgcaggcgtttttttaaatgaaggaaaacccaccttccctgaagtagaatagagaactaaatcaaaatagtcacaccatgcaagactctacagtggttagaaatgaataaaccagatctatatctacacagatacatctctcaaatagtgttgagagagaaaaaaggcaaattgtaggtgtccaatgtgatcatattcatgtaaacgttaagaaacacacaaagcaggccgggcgtggtggctcacgcctgtaatcccagcactttgggaggcagaggcgggtggatcatctgaggtcaggagttcgagaccagcctggccaacatggtgaaaccctgtctctactaaaaaaatatgaaaattagctgggcgtggtggtgcacgcctgtaatgccagctactcaggaggctgaggcaggagaatggcttgaacctgggaggtggaggttgcagtgagctgagatgaacaggactgcactccagtctggccgacgagtagagtgaaactctgtctcaaaacaaaaacaaaaacaagcaaaaacaaagcacaaagcaatactgtattaattatggatgcttatagatgtagtaaaagtataaaagtgtgggctgtaaggatctgcatcaaattctagttagcaatgacctccaagaagggagggaggggagaggaacttcaaactttatctgcagtgtactgctttacaacacacgcttatgtgtgtgggtgtgtgtatgtataaacatacgtggattatatacaaaattgtgcctagacattttgtactttttttctttgtatcagggtatattacatgtggtgatgtgtacaagtgtgtatatatacacacgtataatatataaacacacgtatattgacgcatatacctatatacatagacatatacacagatacacataaaacattgaagagagaaaaaagaaaagggagatgcacatggtacacctaccgcatggtgcttctggaccatctgaagcccaccgctggaggcaggtgcctgcaggcccatgttaagaagtccctactttagatgtccagactgggccgatccacttgtcaaggaaatggtgacagagaaacagaatgtctggctgcaggtcgcatgggcgtttggacagagctggacacggagcccaggaacccttcccttctcccctgcttctttctccttccagtcaccctcgctctaacctgtgtgcattgtcacctttgacattgtgactcagaaaagacaagttgcttgtgtggagaggatggcagcaaggtattctccacataccaaatcacaacagctcagcgtctgctgctcttggaaatgatgtttatcttaagggtggttcttggatgccatgctttcccttgggtttttgctttgcctggggtattgagctaatttgttgcttctgagtctgaacataaaaaggcaggctggctgccagggccctaaaagatctaagagccttaaatgatcttgaacttgccttaaatagttttacttaaaatagctactgagcaggacatacctggcccagaatttcaggtgagcctgcacgattcatttgtcagcagaggaaaattgtcatgctgcagacaacttgttcttgcaatgaaaaacaagccgaagccttaaccaggtgttaaaatgatgggccagaacttgttccagccacagcgtcaggggtttggtagggacaaggggagacccggaagagcagtcacctgtgacctagttctctgggattggttttcggtctaaggctgtcttggttttatgctctgagccaagctggactggctgtgcgcggctggcctgcgagaggttctgggtgtgaactgagggacagaggcaagatgagggttgtgaagctcattgtcttaaccctcctatctgacgtcttcacccggatggtgatgcctttaagtgggcaggagtttaattgaccggactgccctcctgagtcattggagctggtgcggggagtggtgatcaaagccgagccagctgccatctctggagccagaaaagctccagaaggcagcatccagggcagactcagaatcaggactgagcaggtgcaggggcagactcagaatcaggagcagactcagaatcaggactgagcaggtggctcagctgactggaccattagaaaggcttgagtttctctgggcggaaaccagggaagcaaatgagaaacacggagctgtcgatgggctgggggaggctgggacaccgcctgatactcctgccggctttgagctttgggtggtgacagggacactcagggctgtccagaccctgttctccagtgtccgccaactgcatgccggctgggaacgtcctgagcttttttggatctctgagcctctacacagattgtggcatctagaaagtagttcctctgatcttctgcagctcagccaggctgccgacacctctcctcctcctttcaccctgccctgggagggcttccgggttgtacttgccctgggtggctggcctcctcctggctcctgggactgggtcttggccttgccaccgaccagaagccctggtcttgctcccaccagctgatgtttctcctgactattgctccgaaggccctcaccagccctgcagggaggtgtcaccaggcctggttaatggtgatgaggccttagacccaggtaccttctgacaaaccagtgactgacaggccagggccggaccccacaccctctgactcaccttctactgctgtcacctcgtacctgcttcccagacaaaggtaaatcatcagacagaaaagcctttcggcttctgccagaatgaacagacaagaggcatagcaacctccggagaccccaccagccgccgtttctccctctgtccaccgggtgcgtgcacatgcgtgtgcgtgaacgcgcacagactcaaagggctgcacaccagcatggctctgtctcggggaatctgtactggctcctgctcatcagcattggaaccactcacacctctctctattggagggaaaaagaaaagccctccagtccttctaggaagccactcaaactacacatttgagtcactcacatttcagtcactcaagctgcacatttatcagctggactaatcatcttttgctgaaacctcctcctcgtgtgggtccctgtctacaagaagagacccctgtctaccttagtggcagagctggaggcctagaggtcaccatcgcctcctcctgctcccgtgctcccccaagcctgtctcactgtctcctgaatggctctcaggctccctgcattgcccctgccaccgcccagcacaggctgtggcctctgtggcctctacctgcctcagggcctcctcctgccccaccccaccgcctcgagccctggctgtagctgcagctctgcccatcccccatcttcatgcttttgcttcctttcaggctttgcttctgttgttcttcctgcccagaacggctttacctgtcaccaggttcgcccctcagccttcccacccgtcaccaggttcgcccctcagccttcccacccgtcaccaggttcgcccctcagccttcccacccgtcaccagattcgcccctcagccttccaagttctgctgcactgtcagttccatcagccgactcaccccgatttccccagcccgccggatgtacccttcgtctgggcccccaggccccctgccacctggacgttgcctgctggcttgcctgtttctgacactgggctctgggcttcctgggtgagtcagcccaaagttaggcctctggctgctctctaaggttagttccgattctgccacctctgtggtggccggcagacgtgcgttcatttattcagcgagtattgctgtgtgctctcactggcctgggcacttagagataagaaaatgtggcccctgccttgcaagagtcttaagagactcttggttatgagtctttgtgagggaccaaggccaggcacctgcgctttgtttaagtgtcatttattgaaccacccccaccatcgctttctcatcccaatcgtttgctttttggagtcactcgataggccctgccacgtacgtacttgtacatgaggacaccctctttgtgatgctgtagtttgcctcttggccaggtcagctccacactgatctgagagccctgtgtcccctgaaggccccactagtgccctggaggccccactggtgccctggagctcactgtggatgcttcacaccctgcgggtcccatcatcccatcaagctgtggtttttcctgatgtccttgtgcctctgccctttgagcatctggaggacccagcagcaggcgcaaggccccctgtctagtcctgcaaggaagggggatgaatagccatcagctgtcaggagcctcacgctccatgggatgggatcagcagcctagggttcccatggcaaccagcccatcaatgccctcagtgtcaagacaggggcaccgtggaaaggaagaaagtctcattgtcttgccttggctgcttgggcataaacaagctgcgctccacagggccccgcagccacgcccgacctgtggctctgcccagccgcacatggacccatttactgaattgggctgggaagaggctgtcactgttagttctctaatcttcctcgggggctcttgtatttctgccaccggccagcatccatcacttctagagtccttgttgggaaaatccatcttctcagtgagagtgggcagaaacagcccaaatggagcagactaccgaagctctgagtgatcagccagaccgccctggggggaatccatcagtgggtaatggcatcactcacgttcctgcaaggaacctggacttccagactttcccgctttggtttcaaacaccctgatgacaactctcagacatatctcctgtgatcatttaagcagatcaccttgagatgaccactgctgggcttgccacaggcggacagtctaagaaggtcctgtcccccttcctggactgtccccctgggaggaccccagcagtggtcacttacaagagcttccttcttgccttcaaaaggcccaagttcacctccctgatcattgccggactcttccctgggtggagatctgggaaggtggtggaggggaagggaggggctgcctcgtgttggataagggccctcccaccagaggtcaggcctgctgttccctgtctagtagaaggctgcatggaggtgctcctgtgccccacaccgttctgctcacctatcttgtaccccgtcctccagatgggaaaccagatgtctctctggattcctcccaccagcctctgcatgcaccgaccacagccctgtccgaccagcctctgggtctttctcccctgccacccagcccatggccacagccgaggccgggcctgctcactcatactctcactggtggtgagtgtcctggtgactgcctcactggcttccctgcctcccttccaggccatttcccacacggccatccgtaggattcttcagagccccactgctctgtgctcacccagaacccttcacttttaccacacgcatcttcatgaagtccgggcctttgacattcaggacactttccatatgctttttctttcttctgcacctatctgttgctgtcgttttaacctgggggccccttccttgtgtggtctacccgggccctgcccttctttggcattagccaaagtgctgcttcctgacctgcctgcagccctgtcctctccgagctccacggaggggctcggccatggcgtgcggggtgtctctctccccgctagaccctctggaccacagcgtctcatagtctgcgtctttacgtgactcattttgcttcctgaggccctagtgcagttcctggcactgagaaggtttagtgaatgagaaattgttagaattttttatatcaggacctgtgatgtcctgattccattcaccaaaggcaaatcatccttaagcgtgagtatggagaaaatgctgaccttgttatcttcacttctgctgagctctagcaggtttgtgagcagcaaatatttgtgatgtttctgtatagtcaaatatcgcttatgctttccaccctttgacatctcttggtaccttgcttttgggttctgtgtttcctgggactgagtcttgctgagtgattccagtgtcacctgcagggactctgctctcaaggccaaggcagatgttcagtcatctgtgccacgtggctactccgaggcagaaccggcaagtctggacacacctagcatcctagcctggtgttctctgaagctcagaacgagcatcttgctccttggtgggcagaagaacaagaggaaaggaagccagaaaaagaggaccggggaagccacagaagagggagggagggaaagtgggaaggaggactgaggacaggaggcatgggtgtgtcctgcggccttggtggagcctgtcctgtggaaggtttattttctgtaaagaagcagtctggctcgtgcctgtactcagcctctctgtccccacacgtgactgtccttagaatagcaactgggtcctcggattccagtaccccaccatgactgccgccagccactcctatgtcagtcttggctgtctgccaggcactgctgatgattgcccccagaaccgtactattaatcccattacacagatgagcaaactgagacccacagaggctgagtaacctgctatagtagtaagggtcagagcaaggctttcaacctgggcaacttgcattccaggccttcctcatagacagagtctgtgtctattaggaaaggctacaaggagcaggtggcatgtgagccgccacggagcttggcttggggctttctaagtggctagggcagaggggtgcagtccaggcagatggagggttggggcagaagggacctgtgaagaagtcctcctgtactatgggatcctcccctccttatcagggctctggcctggagctcagttcaaaggcttatctatgcaggaatgaaggcaacattcttgatgtagagtctaagagtctgaaggtcagggaacctttcttggataccctcctttctgcctaccagaaccctgtgtttcctgcctgctgggaggcaagtggaacacagtagaaccagatcccaagaggagagaagaggctggagggggacccacagttgcatagagggtagcatggcctggttataagactgtttacactacttgattcctctcagtataatacagaaaggatatgtggatacagaatatttttgcaatacagaaaagaacaagaaaaccataaaaatcacccatagtcccaccaccccaaaataatcactgttgacactttgggccatgactttttgttttgtgattctgtgtctgagtgtgtgcgtgcacactcatatgcaggttgaatatcctgtatctgagatgcttgggaaaagaaatgttttggagttccaattattttagattttgaaatatttgtgttatgttcacttgttgagcatctctaacctgaaaatctgaaattggaaatgctttgagtgtcctgttggattttggagtattttagattttcaggttagggatattcaacctgtgtaggtatgcatgcacacacacacagacacacagacacacacacacacgcacacacatatattcaccaatgtcttatacaaataggattgtctacttttgcaacttgtacctcccacgtcaataagtcttctatggcgtaacttgtaatggctgctcagtgtaccttggcgtagctggcccatcatttgtgtcattctttcctgacgtttaggtcagtgagttctttatcactgcgtggggaggtggatagtgctgcagctgctgtggaaggtcaggaccgtgcagggaggtggaagaggctctgccactgcgctgcttccccgccccacatgccctgggtccctggttatggcgtctcatcccacctacctgcatctcccgtccggcatcaccagccttgcagagggtccacacttggtaacatctgttcagttcaactcattaggattttatcgagcatttttatttaaaaaattatacattgcatataaatttataaatttagagtattatataaatgctcccccattgtaaagaattcacacagtgcaggtgtacaaagcaaaatccaaaatctccttcctcccctcatccgatccctgatttactccttccctgagatgtcaccactgttcacacattagtatatgtgtcctgtttctgtgccttaacagacagatacgtgcgcatatacacacaaaaagaatttttgttgttttttttttttttaatataaatggaatcacactaaacatgtttttttttttggacctacctaggttttcttcactaacagtgggacgtcttgggaatcttcccatgctcgtacatagagacctacctcattctttttaaatagttttatggcattttagagatgcaacatgttttgttataccacacctgtgaatgttcctttgatttgcctccagtttttttctgttataagcagtgttgcagtggttatccttattcatgactctgcacttgtgagaatttctgtaggatccataagaacaaaacaaatactagttataataataaatggtgattgctggcccttactgtgtaccaagtaacttttcatgtgctttccttgtattgactcatttaatcttagaaactctatggggtaggtgttattattaccctcattttacagatgtggaaacaaaagcacagagaggttaagtaactttttcccagttacacaacttgtaggtgccagagccaagatttgaacccgaatagtctgactccagagaggggacctgctgagtcaatgtatgtgtgcaagttacattgtgttagatgttggccatggctctcccaacagatagtgccagttgacactgcccccagaagtgtgtgtgggccccaccgattttgtgtagtgatgaccaattgtcatatttgccagttcttataggtgacaaatgagatctggtggttgttttaatatgcttcttttccctcattgttattcaagttaaatgttgcttggccagcacagtggctcacacttgtagtcccagcactttgggaggctgaggctggaggatcatttcagcccaggagttcgagaccagcctgggcaagatggcaagttcctgactctacaaaaaaaaaaaaaaaaaaattagccaagtgtggtggtgtacgcctgtggtcccagctactggggaggatgaggtgggagaattccttgagcccaggaggttgaggagtcagtgagccaagaccacatcaccgcactccagcctggacgacagagcgagaccctgtctcaaaataaatgagtaaataaagttaagtgtctctttatttattaggcattttaatccttctctgaattgcttatttatattctttgcccattttttcagtggggctgtttgtcttttaatgattgctttctctgtgttgtagatattcatcccttgtttttaagtacgttgcttttcattgaacactgttcagagtgtttgttggctttgcctgttgttgtttgaagtaaaatctgcagcaccatttgtttgccaggctttgggctcgtcactcagtgtaattcagagatgagtaagacaaagtccccacctaaaatagacagcacgtaactcttgcgagaggagtagtgaacggaatataggggcggagtccaaatgttttaggataagtgaggagaatggggcagcctctcaactggggattcagggaagcctttgtgaccagtggcgctagggccagacctggaggggtccatagaatgttcacagaggaatgggaagtgggggtgtgtttgggcagatggatcgtgagtgctttaatctgcatcccatccgaaaacaactcaccttcaatgacccactggaaaagagtctcatgaagaggctacttacagggtgtgcatggggacaagggaaccaacagagggtgttgaggtacccggggactgggtaggcagtggtggggagctgctgcagggatggaggcaaaacagtgttagcagatcctgtgggagctggagctgagtagggtgcagcctccttctggtgcctccattggcctgggcagtattgcctggagggcttagtcttctgcagcactgagcagggcagagaatggtggagagtgggtcagaggtgtcaggggaggtggagggagaaaaatcagctcagtaaggataaaagcagagatagaagttccagatgtgtgaaggcctcagcaatcctcgatgccattagagggtaggggggttcatttgctgctggttttacttagcaaacatttattggatgctggctcaaagcctggccccggacgaggtgctaagttataaagatgggtcaggcaggctgcgcaccccagtgatcaccgccgtggcgccagttttagctttccacgtgtcctctccgagggtcacagcagaggcctgtggttttatgtctgttagaccccatgtacctggatctgtgcctccttgtcccagttggagtttatttaggtgtgtctgtctgaggacagattttaacatggaaaaataagtccatttttggccgccattgaattcagtctaacatacatcttgatcttctgctgtttttttccaacttaaacaaacaaacagaaatcccaatttgtgttcctcttgataaagcccaatttctatagaaagaaaagaaaccttattgctgtcctatcaaagtaaccatttatgactgagctcattaacagtcttatacacggttctgtttctcatttgcaggaatatgatgccgttagccaagaacaagaagttagatttgtttcagaggcttagacaactttatgtatcatgactttgataatctaagaccctcacaaccattcattcattcattcattcattatttatttatttatttacttatttatttgagacatgagtctcactctgtcactcagggtggagtgcaatggtgcgatctcagcttaccgcaacctctgcctcccaggttcaaggaattctgcctcagcctctctattagctaggattacaggcgcacgccaccacctccagctaatttttatatttttaatagagatggggtttcaccatgttggccaggctggtcttgaactcctgacctcaggtgatccacccacctcggcctacaaccattcattttagcacaagatgcaaaagcctgtctgtgggaatagatgctttctcttccccatggagttctgtgaactcattagtactttctaggatttttgtttgcttgcctgctttttcaaggaatttgctattctaccttgttctgatatttggtcaaatcagaaaacgttagaaaaccaaattgattctttcttacactaaataatcttaaaatccaaatgaaggctaggcatggtggcttatgcttgtaatcccaacactttgggaggccgaggtgggaggatcctctgagcccagaagttcgaggctgtagtgagctatgatcatgccactgtactccagcctggatgacagagtgagacactgtctctacaaaaaataaaaaaattagccagtcatggtggcatgtgcctatagtcccagctactcaggaggctgaggccagaggattgcttgagcctgggaggtcagggctatgcagtgagctatgatcatgccactgcactccagcctgggtgacagagcgagactctgtctctagaaaagaaaagaaaacaaaacaaaaaccaatccaaatgaaacctcagaggtaggtatggacacattagctctgggagactgtcaatacaaggctcacattgagggaccagaactaacagacccacactatcacaagccaggtcttaacagccttccttttccaaccagggaagggcagctctcaaacctaaccagaggatctttccactttctcttttgattgttactcataaagagccctggatgtattttctattttcttctgtcaaaagttcaatggctacagagaactatagaaaatcctgtcttaacccaatttattttcttattccaagttggttctactttccagcaattggttcctttcctggaggtagttgctttgtgcttggtgtgtgctgatggctgtgccagcctgggcatctcatcatgccagggagctgctcagcctcctccctggtctctcctgaaaactgacctcctcagtggagtctcagtgaccaggcgccaccattgagagatccttttgtctctccaaggttgagggaacctgtttgtgcacttgccactgtcattctccccacagcgtcagttttgtttgaatcgtgctgtcaggttgcatgaattagattgcaagtctcgagcttgggccatgtttctgcatgcaccgtgggtgtgaaactgatgcctggcagattgtcccatcgttagaaacactggacagagccggaagggagcagccatgctgcccaacccgttttcaatgccatgactttgtcctgaggcctcttcagggagctgtgttaacgttgagcccagtttgatttctgcgtcggccccttcatagcagaagacgacctgctgactgctgtggccaggccacctggccgtggggctttgaggagagactcaagccaacaagtgccgtcagtcagagcatgtctctggtctgcctgtgtccccttgctgggttctcagcaatctggggcgatgcctccgttcgatttttttttcctcagaggattatggagttttctgggtcatttagcttttttttatcacaatttcgtgtttcttaggtccatccataggagaatggaaaaacaaatgtgatacattcattcagtgagcactcttttattcagcaatagaaaggaacagacaaccagcatgcataacaacgtgcatgtgtctcatagacaggccaagtgaaagaaaccttacatgagggtgcctgactccattcagaggaggttctagaactggcaaaaccaaatgtgggggcatgaaagctggaggttgaccgggaaggcacatgcgagactttctggagtgatggctgtcttctgaatctcagtaggggtttgagttatacaagtgtgtacatttatccaaactcaacaaatgtgtaatttacttttgcttgtttcatcatatctaaattttatctcaaaagaaataaatctataagcaaataatgatgtgtatgttgaagtctttagggagatgtatgttgtgtactgatactgcagtttactttggaatgcaccaaaaataagatgtgttgacaaatggatagaaggatggatggatggagagaagtttgatcaagtgattttagtgaatatgttaatggtagaatcaaggtaatgggcatatggatgtctgccatacaattcattcaacattggtgcatgtttgaaaaatttcatagcaagatgttgggagaaaggtatttttgtggacgtgggagagaccccatgttgtctttgaagacataatcataaatttatgtttagagatgaggattagaagcctttctagggatttagtagggcaaatgatgtcatcaaagaaatctcctggaatctgggttcaggggcatttgcttttgtagaggatgttctggggctacactggcatctgaaaggattactgtggctctctgagccactaacttgctaggctttccccaggcagagtttcagccccagggagaagcttcccagtaaatgtaaatgagcagagtccgtggtttaaggaccttcctgcggaggagagagaaggaggagagataagccgcagacacccctggcacggcaaggtaggctgggttgcttgcctgctaattatcttctcggtcttgctccgcagtgtttctctagtttcagaatttgaattgctgactttgtgtagaattttcagcctctcgagttgttgaattgaagggcagcaccacagccattccctacagagtcctaacggacaggcgtcctatgtcggaatcctgatcctgtgtaaccccggggatgtaccagggcaaatgcagcaaagacacagcggtcagactccttgtgggagaaccccggcctaggagaagctgctggtaaatttagggcacgttggagaagtgggggtggggagagaagagaagaatgaaagcattattctaaggagctacttttatttatagattctcctaattctattaaaatgaatgccggagggatgtaaaacttggaacacataacacataatagaaatgaaaggacattaaactaaaatagggaaaaatggtaaaatgagaagagaatcttagtaccaagaggaagatgtgacatttttctgaaataaaataatcttacagcacagtgtatggggaaagtgaattaaataaagtaaggacttggttagcagaaaacttggaaggaaacaaaatatttcataatgaaaaggagaaagtgttaagctgactcaaggggaaaacacatacagatattacactaattacattataaagacagataaataagatgtcattgttgtaaaaggaaataaaactaattaaatgtttaatgtgctttaagagacattggtgaaataaaatatattaactatggtaaaatatgtgaacaggcataattcgcctgccttgttctggcagccagcacagtacctcacctcctgtgtacaaaacaagggacgtttgatccctgagttggaatggttcagctctttcttcaaaaaaaatggcagttagaagcacctccaacaactgaatgtttgcaataatgccagtcccgaagtgagcactcagcgcgtgttgttgccagtcatattgatatcatcacggcgattatcattagcactggatgagagagaaacagcacgtccttccagcgtcaggccttggagtcagactaggaaagcactatttttaaagtaggaatttaaagctagtaaaaagtgtcacggagaagatttcagatccactgtttcttttaccttttgtgttggccgatttgaaaagcttaggatggaaaaggcagaagttaagccaaactaggagacaaactgctgagccatgattcagcagctgggacatttccagcctgcacaccgtcctcaccggctcccagcgaggcacccggctctagccgctccattcagcagcgtgtggacacccctgctcagtccttcgcctgcctggcatgttcttcggggctcgtgcccaccaccactgacgcaaaagaggaccctcttgcctgaaattaattaactaaggattctctcttaaagatgaaagaaaataaaacttggggttaagatgacagacggagggtctctcggcacttcacccatgtcggcatcttggagccagcgtagaagcttatgaaggaatggtttctcgcctgcacacagtcacgcagggcatgtagcagctctctacacacgtgcatttgcctgtaaactacaaatgctcactgtcttcattcccaagagactgaagtgcctggagaggctggattattatcctctcccccagcttttcttgctctgggcatcacttgggatggattgtacagaaaactgaccatcttaattaaatgagcaggagttgtaaggctcttctagaatgggagggcaaaggtgggagtgttttttctccctgtaatagtcaaatttccccagaatgcctaaaaaaacacgtgtttctcatagcgctattttgatctagtagttcttgcaaaaagagctagtgacaaaatgagaactttgagatcagaagagctgggtacgaatcccagcactttcgacgacaccttgatcaacagctggggacctctgacatccttgaatgtcaaatcattcacctgtaaaatatgattgcaacaatcattgccaaaatagaattctatatccagctgttgtgaggattgcagcataaacttaaacctccgtgagacgagctgtcatcactagtgcagatgtgaggtctgtctccttgcctgacgggcacactccatgctgatcctagagagagctgtgccttcctgtgtggatacctaacagcagtccatactgtgaccactggcccagcatcaaggacgtggatggccactcccagttattagtaccaactgctgtctccttcatggacattttgcctgggatggttctttattggattttggaggagccatacaattctgggtgtttgtggagtcctggagtcatggcccaccttctgacacgagagctgaaatttggaagcatcagatttctgtgattttatttaaccagtaatctaaaagctcctgctggaaatggagagtttgcatcctgctaaggaataatatgctggatgtcacccaattccagagcatcatcaaacagtagctaggaatgtattcagatgcaaaaagtagatgatagtggcttaaacaaagtggggctcactgttttcacacagtgaatatgaagatggaccatccagggctggtgctgtgacgatgatgatgatggtgacaatgacaaggatgacaaactcttactgggcaagaaactgctctgagggcttgatctcatttactacttactgctaacccacaaactaggtactttccctgtctccacatcacagatgaggaaactgaggcacagagcattcagatgacttaacccaattagaaatggcagagccagagctgacaccacacttttttctcctttgttatttttgaaacatgtttaacatttaaaatctattatttgacacatataaaatatttcccacaatatatttgttggttatacaaagtataacaatagaacctgtgaagccaccacccgtccagtgactaggctattaccagtattacctacgcgttccttgcaccctaccacctgccagacacctccggctcccgcaggaagccactgtccgcgtggcttgcgtatctccggcgtagatgtgcttagacaacgtgttgcttagctttggttttgagcactgtgggaatgatgtactgtgtggggtattctgagacttgcttttctccccccagtttaacatcgtgtttctaaggtttagccacagtgtggctatggccccagcttagctgtggttctcttactttcactgctgtgaacactaccgtgttttttggccagcacatctcaatgtatctgtccattctcctggcatgtttgtaattcttttttaagaattgttgttggccagtcgtggtggctcatgcctgtaattccagcactttgggaggctgaggcaggtggatcacctgaggtcaggagatcgagaccagcctggccaacatggtgaaaccctgtctctactaaaaatacaaaaaattagctgggtgtggtggtgggcactcgtagtcccagctactcgggaggctgaggcaggagaattgcttgaactgggaggcagaggtggcagtgagccgtgatcgtgccattgcactccagcctgggcgacagagcgagactctgtcttgaaaaaaaaaaaaaaagaattgttgctaagaacagccttatacaagaccgctagtacacaaatgccagagtttctttggggtgtgtgcctagaattgggattactgggtgtacatatacggcatatgaatcctttgtcagttaacaggagtgggaaaccgtgtttcccagtttatgaattttttttacctgtatggggtgtcttctgattaaactggagagttaacttttacataattgtatataaaaatttattctcttttaataacaattctgttaagttataattcacataggatgcacctatctagagcatgcagctcagtgggttttggtacattcagagagttgtacaactgtccccgcaccccatctgataacattttcatcaccccagaaagaaatgctatccccgtcttagcagtcagtccccatctaccccactcccttaaccctaagcagccactcatctactctccgtctctctagatttgcctattctggacatttcatataatggaatcatacagtaataatagggtctttttgtatctggcttctttgacttagcatgttttcaaggttcatccattttataacatgtattaatatgtcatgatttttatcaccagataacattccactgtaatgaattgcccacattgtgtttgctcatttatcaaccgatggacatttaggttgttcccaggttttttgctgttgtgaataacgctgctgtggatattcacgtgcaagttgtatgtggacgtatgtttttacctttctagggagcttatctagctgtggagtggctgagtcatatggcagctctatgtttacatttctgagaaactgccaggctgtggacccacccttcacggtctcaccagccatgtctgagggttccagtgtcaccacatcctcatcagcacttgtgatgatgcgtctttttttctgcacccatctcatagatggagtggtttgcatttcccttacggctaatgacgttgaacgtatgttcctgtgctttttggtcatttgtgtctcttttttagagaaccgtctgctcagatttttgttcatgtttagtgggtttatgtggcttttattgttgtatattctagatacgagtcctttatcagacacgtgacttgcagtcattgtcatccttctctgggttgtcttttcactttcttgatggtgtcctttggagcacggacattgtttttttaatccactctgacattctctgtcttttgattggtgtgttgagaccattcacatttaaagtccttgctggcgttgttggatcagtatctaccgtgtttgtaacttttctgtttgttacatttgttctccgcacccctgcccctccccaaccccactcctttctgccttctctggttttcattgagccttttagataattccattttgtctccttgcttaatgtgtcgattatacttctcttaaaatttttttagtggtttccttaaagattacaatacagttcatacttaactgatttaagtccaccttgaagtaataccgtgcggcatcacgtgtagttcaggtgccttagatcattaccaatgtccccctcacggccccatctcttaggacaccattgtcttccttcagttagcgcttcctctgttcttgtttaagaaatccttcctaccccacagtcagaaagatctcctctagtgctagtcagtgtctcagaaggcaacaggtggcccctctgtcctcttctaatagccctcatcccgccagctcagagccagagtggagcctcagccgttcctgggtgtgtccgcacactctgctctggagctggggaatgacctcaggaggggctgagctgcactggacgtaccatcagatggtcctgtttccatgagcagaacaagacgtgctgtttccacccagctcaggacctgtgcgtctcagtagcacatcagggctgtagaatcagtgcgggtttagggcctgtgtttagtagccagtgggaggtcagcgtgtgtccctgtccccagcacacagccgcctggcaacaagtggccatgcgagtctggggaacgtgtgaggacaggctgaggacaggctcaccacacacgctgattgcccctcgcagggccctttcttaaagggtcccagcctccccgtcattggtctggacactggatgatgttgcaaatccccactatggttctgctcagcagacccagtaggtcccagcttctgtgtgtcaagcggcatctgatcaggcttgccctctttttcatcttggagcctctccccaggtcctgcgagtcaagtacactgagtagcctctgtccccttgcttaggtgatcactctggtatgcccgccgctggcccctactacccaggatcccgcagttcccgtggagagtgggaacctggtgctgtgggagcatcccttgtcaccggcgggatagagcggacagcctccatggacttctttaggaggacgctgaccctcccccaggcattttcctaaccccttggtgaggagaccagctccaggcctccccagggagtataggccaggtggcttaacagggtgtcacgcagtagatccctccagcctcccatttccctgcattcccagcagaccagcagcagctacatttgggaccttgttagaaatgaaaatccttggaccccaccacagcctgctcgatcacagactccgggagagggcccaacaatctggctttaataaaccgtctggggctggagaaccacagctctgcaggatgtcccggaggtccagcatactgacctcatcagcgattggtttttattaattctagacttggattagccaatcttgtagactatacacacccctcgatgttcaaggttcacattaaatgaccaaattgtgagggaaccaccttgtccacacgtgtgggtacatatgacctacttgcatttcgtcccgcttggagcccacctcccaggctcctgcccccacacagtggacatctccttctgacgcagttcctgtgccttggggtctgccttgttttatgggcccaggtggcgcaggatgtgggtgagtctgtggagaaagggcaccagcttgcaaggcagcagccccaggagcagcctgggaaggctttgtgcagaggaggcctgtttcctcctacgtgttgggagagttgtctctgcagatggtgggtgagagttcgctgccaaaaccactgtcttccctgccctgcggacacttcttcctcaccttcctaaaactgtaagagacctggagccgttgagcatcaatgactctttgactcaggaatcttaaaaaatcacaccctggggctaccatgggggccttctggttctccttgtgtattactagttgaatgtttatagctttcaatttctttttccccttctatatgctctctaaggacataggaagaatctacctgacctcacagctttggtaggcactgttattgccacaccctcttctcccagtgggcaccccacaccccaactccccggcacgttgttcagtgggactgccagtatcatgtataatcatgaatgctgtggattatccttattcacacacacagactcacaccctcacacccagaaaggcaactatcccagtgctcccagaatagatgaacaaccgaatcccagattcccttcgtgaggatttatttgaagaccactttcagtaacaattactttatcagtggaggtctcagcaggaaagatacggcacatagtagagcactttgaggaaggtcactagaccggttcccaaggcatgggcggagttcagagaaaccaccaggaactggtagcagcagaattgttgcaacgcttggccccaaaggaagaggggagggaatgttgatggcacctggaaggagaggttgtattgacaagtctccttggtagagcagtgatattcggggagaaacacggccagccagaagttaccctgtagaagggggcagaggagaaaacaagccaattcgaccctcctcccaacctgcctctctcgtctctcccattttctgtttccaaaaccgacccacagtcagagggcaaaggagccaaccagaaggcccctgtgtgtgatttttaagattcctgagtcaaagagtcattgatgctcaacggctccaggtctcttacagttttaggaaggtgaggaagaagtgtccgcagggcagggaagacagtggttttggcagcgaactctcacccaccatctgcagagacaactctcccaacacggaggaggaaacggccctcctctgcacaaagccttcccaggctgctcctggggctgctgccttgcaagctggtgacctttctccacagacttgggcccccatagccatgtgcctggggctgaaagcacggtagaggaaaccggaaagtggatttagagggacaaacagaagatatccaacccactctcagacgtcctcctacaagttttagttttacttctcacacttaagtatttaatctagctcaaattggttttgtgtttgatgtgaagtagggattttattttatttttttctcatatgaataaccaccttttcccagcatcatcagtggattagttcctcctttcaacactgatattctatcagtaaatcaagttctgtatttgcatacagattgtctcccttttctgttccacgagttaaacttgtctgtctctgacccagtgcctcacagacttcagtactgtatcttcataataaggcttgatatgtggtggggcaagtcttattctttttcaggagttttaggctattcttggccctttgttgtttcatattaactttgaatcaacttgacaagttccacaaaacaaaagctgttgggattttgactgaaattttatttaatatatacatctatctatctaatgtatctttatgatatgggaccttcctatccatgagcatggtatctctttatttaggtctcctttaagtattagtaaagtttgtaaattcttatatacacaacttacacatctctgataaaggcataggtaccttaagtgtctaacagttgttgctagtatatagacgtgcagttgattttttagattggtctcacatctagccacctttcaataaagtcccttatttcttccaataatttgtctattttttatgtaaaccataggaaaccatagatttgatatggttatctatgtagatagtcatatcatctgtgaataattgtagttttgtctctccctaatcaatctttaagctaattatttatttatcatggctgttgttgactagaactttcagtataatgatgaataaaagcattgattttgggcagtcttatcttgttcttgattttaaagggagtgctttcagggtttccacattaagattgatatttgctgtttgttttttgtaaatgcctttttaacaggttaagaaagcttccttcttgttttaatttgctaagagtttttaatcatatgggttttgaattttatctaatgcttttcctgtatcttctttattctgctactgtaaaaattacagttattgactttctaatgctaaaatacccttgcatttttggaataaactcaccatggtcatggcagactatctttcttcctcgttgctgaatttggctttctaatattttagttaggagttttgcttctatattctgggtaaagtggacctagagtttccctttcttatactgttcttgtctgtttttaggattaaagtattctggcctgataaatttttactttttctgttctctggaagagcttgtttaagactgggatgatctataccttgaaattttggtacagcttacctgtgaaactgtctaggcctgttctgtgtgagagagatgggtgtttaagcactgtttcagtttctttagtggaaagtttgacaagtcctgtatttgttttttagttagtggtttcataaattacaattttctaggaattttttaatgtggtctgtgttttcagaattatgagtgtaacggcattggtagtgtttccttattgtttttaaacctctgcttgatctgcggttacatcctttttccacttatcatgttatttattcgtttgcgccttaatttttttctttatcagtggtgccatgggtttggctatattgccagatttttaaagaactgcatttggccttttaaattctattgtaaatttgttttctacttttacagagttctggtcctaattgtattaccttcttctcatttttttttcttttaactttttagtttgatgcttaatcccatgaattttcagcatttctcttaccacgaacacctcaggttacacacatctttcccggggtcatgtccacagttcccatgagttgtcctaaatagtattttcattatcattccattctaagtatttttttatcccaattatgatgttttcttttaccatgagttatataaacatgtgtttgtgaatttccaaatgtgtgacatgtttagtctttctttgccctgttgacctccagcttaattgcattacagccaaagactatgctttcttggaaatcagttcttagacatttggggggtgtgcttgaagtcctggtactgggctcagtctttgaaaacgttgtgtgtctctagagagaaatgttattctctgttgttgggcgtggagttctaagtctgctggattacacctcttgacagagtggctcagaccctttccactgccattggctttttgtctaggtgaccctctgctacccctgtcccttatggcccctggaatcagggagcttatgtaggaggagcaggtgtttgggctggccctggagggtgaggaagatttggcttgatggaggtaggcagggggcctgggtagaggggacagcataatactggtgaaggaaggccagggaatggtgtggcatctcgaaagagggccagagggcaggaaaaggctggggcagggaccagaggccctgggaaagacccctctttagaagaggggcaggagagagtcttctgaggggagatgagagagagcccacagagaggaggacacggaggggtggggttgggtaggcccaggccatcgtggggggtcttcctgggcaggagagggacctgtgtgacggttcataggggcatagtggtggccatgtggctgtgtggggaggaggccctcagttcagtgtggggcctgggatagtgggtggcaaacatcagatggaatttcacagaacctaacgcacatctctctccctcgaggtgaatttttctttacagacctgtgaatctaagagatgatgtaacgcctgaactcattttataacatcagaagtttgcgacttaaaaatgtttcagaaggtgggggcgtgggctgtctagggttctaaggagaacgtggttgaaacagctgcctaaagggactgagggtgttggaggacccggtggcaggcgcatggatggaggaccaggaaccaccaaggtcaccatgggtgggaggcatcagggtgagggaggggtgttggtgaggggcccagctggagctgtgttcatagttgctgggatggaggggacagggcaggattcagggtgtcagcagagtcagttacctgggaggcgtggcacaatggtgatggaggagggggagcccaatgatagtgcagtgaggaatggtgggggggacgggaatggtggcagctggtggtgtggacttagggtggggggacgggaacggtggcagcgggtggtgtggacttagggtggggggacgggaatggtggcagcaggtgatgtggacttagggagaggagacgcggagcaagccgggagaactgggtgggcctggatttgtcctttcctggtaggattactgtggccacagaatttattgtgcaaccaggatgtttctaggaagtaaaagggagagcctggacacttacagctgggcaacaggatggaggaagccagcacacacatgattccctgtgcaggcacgtaggggctttcagctaagccaagggtgtgtgaggaagcaccaaaggtgcagaggagtttctcccttgttttggcttcaaaatagatgtttgtatataatagggattcccaagggctcagtgggcggagctagcagtgaggctgggagaggagaggtggcctggagagggtttctcttctgtccggaagcctttctcccttggctgagagaagctacacacacgccacttctctctgaacacgtggctcgtgaaccacagtcctacagctgtcagtagtaaaatccaggcccatccagcatgcttgcgggatgtcggggtggttaaatgaaatggaaggcagtttgttttttccaagtgagatggatgtgaaggaattaggtagaagctgacagaggtatacccaaaactgctaaatttagcctggattcaagaaagaggttagagaggtggcattgtgagtaattagacgcgtcgcagagagcgtgaatgattgacagagtttgtgtctgtggttgccgctggggagaaacagagcagagtgggagtcttcggaaggagcgaggagccaatctgctgggtatgtggagcctttgggaccgtcagtcgcgcttcgggtgctggggtctgtttgcgctggagaagatacacatggtgaaagggagagtgaggcacagtccctggagacagacgatggtctgtaaatggtgagcaaacaacagtcaggagccttgctggagtctgtaccaagggccctcctaagaagccgggtcctgtgggggtccagtgactgtgtacagcccgggggtccagtgactgtgtatagcccgggccacattgcccagctcgggtctctacggcatttgggtttatgcctcagctcaaagccttgcggaaacccctttcaacatgtgcgctgtctgctgcagagactcaaacccactggggcaaagcgaacacacagcactggagttgggtttcacgtccctatcaccacgacctgtgcccaccaacctagaaatagttgggtgaacttgctggttgtttgctgagatagtgcacatggcagtcacataggtctttactgtgtcttgcctgatagcccagcatgagtagaacagccatggagacctctgagagagcaggacgaatgtgtctgaccatgttgttgcaagccacctaaaacgtggctggacccagctccacctctggagggacgtaccacgggcaaccatctgtgagggtattgcagacaccagatgtcagcgctggtagggggtaagcaaacatcagatggaatgtgagcataagagatgacataaggccagaatgtgttttacaaaatcagaagttttggacttaaaaaatgtttcagtctggaattggacagatagcgcaggctcattttatggataagaaataagttagtttcaagaaaatggattgccagacacgaatggtattgcacacccagaggggtggccagggctgcctgtgtgtgggctgtccccggcacagctcctcggctcccctctgccctgcaccctgtactgttcaccttggccctgtatggctccgtctaggtgggattatcttccccacaggggccactgataaagaagcactctatatatttttaagaattgaaatcaaagggcaaatgggatttctctaactttgcaactagctttattgcaatgcacttccccccacaaagggagctgcatccttgttcttttctttaagaaatactatgaaaaaacccagctgaccagcctgcgccctgggaggctggggctgctctctgtgtgccaggccgtgagccgagcattccatatgcatcacgcctcatttatccccctagaaaccttgggcaaggaaatgctgctaatcccaatgcatggaaagggaagctgaagagaaatttaggaacttgctcagagatccttttcacttaaacagaggagttgggattcagatctgggtagtccttggctccaaggcccaagacctcaactgctgagttgagatttttatttatttatttatttttatttatttatttatttttgagatggaatctcactctgttgctcaggctggagtgcggtggcacgatcttggctcactgcaacctccgcctcctggttcaagtgattctcctgcctcagcctcccaagtagctgggattacaggtgtgcaccaccacacccagctaattttttatatttttggtagagacggggtttcaccatgttggccaggctagtctcgaaatcccgaccccaggtgatctgcttggcctcccaaagtgctgggattacaggcatgagccactgtgcccagcccaagctgagatcttgatactccctctggagtgtccttggtcatgcaaggcaaggcctggggtcccttcattgctacctccttgcctccctttgaccctcaccttgtgtattccccctttctctccccggctccatcttgcctcgaaagacgagtagagaagatgttccctccactgctaggactccagcttctaagaatgtgggtccctgtttttatccaggggtgcatctggcagattgccgttccttgttatgccctctgagagcccggtaggcaaagcggtttcctatgtgcctccttcatcttgctgtgtcatgctcgctcctgtcagcctctcccctggatccaggccctgggcccatgtgggcccttctgggtccctcatgtctaaaatacctggctcgagcagctgcccagatatttgttgagggaaggaatgagggaatggacagacgcctctggagacctgcagtggcttgagaaaacaaggacaagggttccagacagaagaggaaggaacggttggagcagcccaggagtcagggtgggcgtcactattgataaacgcacagacggtgactgcacagagtctcgtcactgtgggtgggtcttcaccaagtccctgttgataagctgctgttacgtgaatcagcacgtggaggggaccatccgtccttccatccctggagtaggatgatctgtcttctcttaccctccttccaagcaattacttctcatctgtaaattagtgctgctgaagttttactttgagtatgcaagttctgttgaaatcatttattggcaaatattccataagccacagatgttagtgcaaatgggatggagagaaaaggcaatgtagtgcctccccgatagagtagaaactgtggccagcaagggtgcagagatgggctgggacctggtcccctgacttcttagcatacagcttgccggagaaatcccaaatgccatttttaaagagccatatgaaaattgcacaaagtctatttttagtttacaagccaagatatgctttgcaaccgggaaaggatgtccctcagttgtattttggtgaagtcatgacagctgcctcatcagtagcttcttcatttttaattaccagcgtggggttgagtcacagaagcagaatgacagtgcatgtttctctgtgcctggttttaattggtgtgattgagttggggcattgatgcagctggatgaaagctttctgtatcttcatgcactgggagctgccgacctcagcagggcaagctgtcacaaggccagcagcataggagcttggtcactgtgccacctggtcagcaggcctttgaagccatcatttgggataggctccaggataaaaggaagctgagcttgcatggtgtttggctgacactctcaccacccatgactgtcagtcccggtcaggtgactctggccgtccctgagatgattgccacctccttcctgtgtccttgttccctttaagggaaaccacacaatagagaggggccaaggatgggaagcgctttccggagctaagagctgttaataataacagctgggcagcactgccgtgcttggctgtgccttggggtcggctatgccttctccctctcaggcctccagatgctgctggtacactggagccatagtcccagcatcctgagtgacacaagagaggtgggaaaggtggggacagaatgcagaggagagttttttgtttgtttgtttgtttgctgtggtcaaatacacataatagaaaatatatcatcttacctgtttgtaagtgtatagtttggggcatttagtattttcacgttgttatgcaaccatcaccactgtccatctccagaacttttttattttctcagactgaaactctgtacccttttatttatttatttattcattcattcattcattcattcattcattcattttttgagatggagtctcactctgttgcccaggctggactgcagtggtgtgatcttggctcactgcaacctccgcctcctgggttcaagcgattctcctgcctcagcctcccaaatagctgggattacaggtgcacgccaccatacccggctaatttttgtatttttggtagaggcggggtttcacgctgttggccaggctggtctctaactcctgacctcatgtgatctgtccacctgcctcggcctcccaaagtgctggaattacaggcagaagccactgtgcctggcctgaaactctgtaccctttacacaccaactccccactcctccctcccccacagcccctggcaaccacattctgtctctatgaatttggccattccaggtaccgcatacagggagaatcgttcagtattcgtccttagtgcctggctcatttcactgagcacagcgtcctccaggctcatctgtgttgtagcatgcatcagagtttcctccctttttcaggctgagccatattccatcgtgtgtccctgccaggttttgtcgatccactcaaccagccacagacacctgggttgctcccaccccttggcttttgtggaaaatgctgctgtgaacacgggtatgcagatatttgttcagaaccccgttttcacatcttcgggtacaggaggtatatatttttaagtgaaaatttgaagattaatttttctagaattccttttgatttcccttgggataacttgctctcaagtgatggtgttttaggtattaaaatgtgaatttccaacatgtctttcataaagacaaaatcttatttttaaaaaccttgtagcctcctccaacatgacctcccttggccaagtagccatgagctgcagcccagcactgacccttctttctggggagtccaggagggggcctggcaggagccagacgggctccccctgactgccttgggtgctcagtgtagtttgttctctgatccatgatgtaagcagcgtgcccaggtgtgctgtgcacagcctttggtgctcaaggtcacagacacagtccactcttcacgagcagagctgccctatgctgagagtagacctggactcgtaccggagcctctctcccctggcaaattctctagatgagactttcttgaggataaggcaccccctacttctcgcatactcagaaagaaaaaagtaaacagtgggcctcctcaagttgggaaagtctcaaccaaatgtctcgatccccactttccaggcgacaggctgcctgtagcctgcaggcatgtgttaggcaggctacacagtggtggtaacatgtacaatgagttgccattattaaaaactcgggagagcgcatgtcggatccaaatgctggcttctctggaagagttcaggagatctcgcagttctgggttcctggagcctccgcaggctcacctcctccctgacatggggtcccaggctgggccctgtgggcatcgggggtacctcacccaactagagaggccaaacatggcacagggaagttagcgagcagcagggagatgtggctcaaatccattcccactaacacatcagctgcacaggggcagcctgcggggagcaggggcgtgtgctctgcctgggggtgaggtatgggccctgggcacatggggcagggccaggcctcaagcagcctccctaccccagaggtcacctgcccttgaaatacacctcattttctgtctcttttacaaaataattcctggatcccacgggccctcctttgatgggaggaaggaatggggcagctctgagaagcagtctgtcgccgcttctcagcatggggttagagaaagagttttgtcttcagtttagaccatacattctttaagctttatttgggaaaggggctaaaaggtctggttaccttgttttattacaattaaaaatttcttttacaattttttgaaacaatcacaaacttacagaaaaattgaatgcacagggcaaagctcaactgacccagcgcagagaacctggtgaccccggccccgccagccccagtgctccagtgtgtcctttgcataaacaaggactgtgtctgcagagccgtgcagcacagccatggacaccggggaattccaccggtctttatcagttgtaagggcccctaatgtagtaacatgttccatctgtgctctgtgggtaaccaatctgccatgtcctgtgtcttcactttccctgagtgggcagcctggttatctgcctggactgacatctggagtagcctgttcccacccgtagccccacgggctcgattccacgttcccccatgtgagcgccctcctcaccttctgagttgcagcagtgccttgttctgggccaccccggatcttcccaccccacacacaccatgttcttccccatatgatgactttagactggaatttttcaggaaaaagaagagttttacagcttatcttaaaattaaaacaaaacaaaacaaaaatgaatactcaagaggcattggatttaggaatccggtaaaacaactaattccagacagccgtaaagaaacctgcaaccaggaaatgatttaaaatggagatcttcaaagtcaggattgtagttttttcaggtagctttttgtagaccttgaaaatataggccgagaccacatgtagaaattaaacgttctcatccgaagccggaccatttggtttggcgacttaagggaagagaaaaatgaagtttgctaagtaagaattaatgatttctcaggaatttttaggatgttgaacagcttaattgcatagtttgggtggatatgtgttgaagaaagtaattttaggagactgggaaattgtgcaatcatcttaacttgggtcaggattgtaattattgcaataacagaatgttgctatgtgtatatgtgactgaaatgggaagcagtttttaaaaaatgctttaagaaataacaacaaaatgtccattctctctctctctttctggacttccttaattataaataccaggtaatccagtgctggctaaatataggtccagtggtcatctatatttataacgtttttttcaggcggaagtcactagagcaatacagaattaatttggtgtgtaggtttttatagagtctaattagttgtgtttttcttaagcaaaccaaccgggatcaataacattatataactgaactcggacgaccatgacttttagacatagactcttcccagaaagccaaggccctcggcagatgccggccctgaagacagacaagcggctccggaagcaggcacgctgcagctgcggagcggacggggtttggaacatctgtttccagccaagggcaggctttgggagtgataaagtacagtttttttttgcaaagtcagaagcctcatctgcagtccattcatcactgaggccttgaattgagacattctgtggctgcttatcagctgttcccgtgtggaagggtttggctgggctggcctggggaggtggggtggggattttgcagacttaccaaagtatgcgcttagccgacccacccccaccaacaacgcagcctgctcgagggctacgaactgcacctgtgtctgcagtcacgtccattggagagctgagtgggcgggtggacctttggaactatttgatgtcatttggggtagattcggcgtgcttctcggtgactttgctgcaaattaaacatgtaaagtagattgggctttcctcctccattcctcaggatcttcaaaaaacatttagtcttttctggcagagtgaacccgagctggcagcgcccactgagattttgtttgaagccagctacattcacatttaaagaaacgacatgatgggggaggccctttctgtaaaccccaagccaggcctttcccctcgtgagggttcctacccctcccttgtgtggccctgcaagccgcttctgcttgtccacacctgcgcccgagagttcttctcatggctggtgcgtgccatgaatgaagggcactggccagtggaagggagtgcccggccaggccttgcctgcctcaagtcctcagaccagagaggccagtgggggtcttgcccagaccatacagccgggaggtggtctgcctggctccatagcctcctcccgacctcacagctgtcctgggacggggactgagagagagctcaaagacaggacagcagagcccgggccagaaggcactgggggcatgctcaccccacctctggatgcggggcctcactggacagctggacacagatgggatggggggagacctgtgtatcctcccaatgtcatttggagacagaagtctgttcatttcatcaggcagatttcaagctcctctgtgttccagacacagccaggccctgagaattgacagacaacatagctcctgcccttgaaggcttatggtggagggagggaggacaaagggtgtcatagccatgtctgggcatacagggcctgggaggcctgagagggcttcctggagtcagtgacagccgaggggatggttaaaagcagagtaggagttgaggggacttgagcgagcacaggggtgtgaaacggtgtgtgagggcagggccccttacactggatgacagagggcagtgtgggcagggccaggcctgtggctggagaggggtcctggctggtcgtgtattctccgagacaaggaggagtcagggtgggagtgtcagtgcggtggtacgggagagactaagaggccagcgagggtccaagcagaggggtggggctgcctgcactagggctggtgcgatgaggggagcgggtttgggagccattaagagccccctttgggaaggtttggtggtggcttttaccaagacaaggaacgcctcaggaggagaggtttggggtgcaggatggcgagggtgcagtgttgttgatgctgctctggcgtggtggaagttatgtgctgacctaggggtcctgccaggagccagtggataaagatggtgcagatccggcccagcccctggaggactcagccattatggggccacgtgcttgggacccccttaggcgggagaggctccccagaggagatgatgctgagctgagcctggaaggacccaggattggttggcaggaaatgaagaaacagccttctgggcctgtcttctcggtatctcatgcagttcctggatacagctcagcttctcccgcagaggatttcagaacccacctccccagtggctgttcagacctctggaaccagaacgtccatctggggccaagcccccacccacatggggttgctcaagctactcaggtgaagctgacatgtacgaaggtggcgagccatagatctggagttctgagttagggcaacccagcagtggccccaggaggctcactcggatgtgagaactgtgggaaaaccaaggacctacctggtatgtttcagagtcatttgtttatgaaccttacataaacacacacacctggatatgtatatacacgtgtatatgcacagatacacacacacgcctgaatacatatgcagttggctgtctttatccacgggttccacatctacacattcaaccaacctcaggtcaaaaacatgaaaaaaaaatgtatggtggatgtagaaactattttcttgtcatttttccttaaacaatatggtataacaactatttccacagcatttacattgtattaggtattataagtagtctaaagatgatttaaagtattggaggatgtgtgtaggttgtatgcaaatatgatgccattttatatcagggacttgagcatctgtggattttggcatctgcagggtggcctggaaccagccccccacggatgccaaggcatgactgtatacatatatatacatctgtatacaaacacttgcacatccatatacatatgcacacacacacaccggcatacgtatatacacgtgtatacaacactcacacattctatacatccacacatatgcacacacactcgtatacagacataatggaataatatgtacctgaaacataatataggcctcccatgatttccttattgaaatgaaggaaagtgcacacatgctgagggtactggttctctgggaaagaacctgccgcaaaggacaaggaccaaggtgcctgaaattccccatggtaactaacaatcttaaccatgccgagaggcagaaggttcaacggtgaagaatcctgactgttcattgactaaatgaatcttgaacagtttcactgctctgtgcctcagtttccccatcagtcagatgaggatggtcataacatctactccctacagttgttatgaaaatgaagcttattaattcatctgaactccaagcttgctgcctggaatggggcatgtgcccagcaagcgtcagctgttgtaatgagccaggggcactcggtaatagtgaggatccctggctgggggacaggtgaaggagggggaattgctgttccccactaactctgtacccttttgtaccttccatgttttgtatcatgtgcacatattacctatatttttttaaatgtcagagcatcttgttaaagaggattacactacattaaactctcttcactgtgagttctttgatctcattccttccagtgttctggtcaagaacatttagcaaggtttgtaatgatgttctaatgatgttatcagtttgatcaagtaatgcatataatcgcctatcaacgttgagtaaagaaacatgagcaccctgtattcagcaaattgtttattttcttgaatggtgcatgagacgggctctaattaattcattgtgaagataccacgggcaccaaagagaacaagaacgtatttaaatttcatgttatgacattacaaagacaatgccttgtggactagcagtcagattcattgatgaagagcagatggaggtcaggggaggacacggggctgagcaggactgggacgcagcctgggatggtggaggcagcgcctcccttctataatcgagggaaggaggaggaggctgccagggccctccgatagcggcagtccgtggaagccaccgctcctgattctaaaggcgggctgctcaggcaccggctggagaagcggtgcgtagtcgatgagctgtgagcacgggagcagagccagcgcctggtgtggacaccgtccgaggccacagccaagcagcagccacccaggacgtccaggctgctgagcagggaggaacacctgccatcagggcaaatgccacataaaaaaagaacctcactttacctggaagattatttggaattttgtctttaggccgcccccttcctgagtccaccgctgtccatttgaccctgaagaggtcctaaaagtgtggcagtcatcttaaaccctactcgtgtatctgtatgtcatttagtatcaaattttgtcacctgcttgtctgtgagcagaatggggaggctgctggtttaggaactgggagccccacagtgtgacatagtcttaacctccctgggcctcagtatactcatctgtgaaatggggacatctctgtgggtccttgtcacaccctaatctgtgagtcagggccagagggcagccaggtgtccttcatgttcaaccaggccagtggccacatccccacaggtgaccctgcgtgagcctgggggcctcacagcctggcatcctgtcccccttccccatgaaggcacccagagatgtgaaggaacagcctccctcactggggaggggcagaacctcctcgtacctggggtggaccctgctgtggtaggtcagatgagaagcctagaagggcttaggtgggtggggaggacgagagacagcaatggctgtatcataaacgcagcatcatccgggccgacgagactttcaatgggcctgtgttcctgggcagctgctcctgcctcctgctgtgtcacctttgattctctcactggttttgcccgtgatgaaaacctcacactcctgacctggtgcctgatgttgcaaagggagggcagagggcaggaccacatgagtcagacagaaggacggggcctcttggagcatctgacaaggtttatggaaaaagcacgtctcagagactcaatgagatgctgaaggtctaggcttgcagccgcacctgtgtttgagtcactccgtgtatggaccgccacttcccagccctagagaacccttgcttgacatcagagactttggtgaactcccctgatactctcagcagcaaatgctgtacatcacaggctggcagccttttctgtttcagagttcacatatgaactctttgatcctcgtgggctctagggtctctgttgcaaccactcagctctgctattgtagtaggaaggcagccatgaacagtagggaaagggtgggtgtggctatgttccaagaaaatttatcaaaaaacggtaggtggatatatacccaaaagaattgaaagcagggacacgagcagatatttgtacacagcagcattattcccagcagccaagcagtgggagtaatccacgtgtccataaatagatgaatgaataaacaaaatgtgagatgtgcagataacggaagattagtcagccttaaaaaggaaggaaattctgacacatggtccaacactgatgaaacatgagcacattatgctgaatgacataagccagtcacagaggacgaatgtgtgattccagcttcttctgcagctggctttgcaagggcagccttggctggtgtccccttctcccctgcagtgggagcgtccctccccggccccccagctctcatgctaggccggacataagtgtccaaacagatggagttctggccgctgctgcctccagaggtggttggcctggtcagcattctggggactgtctgtgcctttcctggatcgttcgtggagaacagttgacatcagcccagacccaggggcctttgcaaaggacagtcatggcggccccggggcagggggctggatggctttgggactggcctttgaggggaaaggtggcttccccaagcctggcttagctggtcaaaggccaggtgctgccctgaatggcttccaggcccccctgtcatgagcctgctaagggtcagcactgctgcaattagtctctttgccagcaagttttattcaactcttcgttcctccatgtccctgactgggaattgactcgaatgcccagagttaaaagaccaaaagttacgtaacgtctcccagggatgatggcagcttatgagcaaacatgttgattaaacactgcggcaagttgagactcggtgattgcctccgtagctaaataacagctctagtgcgggtgaggaggagccttttgacacgtgtggcagttaactttgttgaagaagtgagcaaggtgacttatctgtaggaagaaaaataaaagtgcttgtgagcaaaatagggcagaaataatgaggtttatgatggcagaaaaatgtgagaatcagaattgcggaaaaccgtgtatcgagcacttactacctgcctgctgggtctctgctagctctttcacacgtaaatatcgcgttcaaatttcggagcaacccttcagggtggtggttattagtctcataaggaaactgagagagggtaagcccaggtcacccagagggaagggtcacattagatgcagacctggatttggccaaaagctaaagcatcccagacccagagaagggagtggaggagcccgagagagaatcccagctcccaggaccaccagcatttgctgaatgcccactaggttctagacactcagctaggctctatataggtgattcccattgattcctcatgactgtcttcgtatttgatgttctgtggttgtaagcaacagaaacacactggagcaagctgaagtagaaaagggaactctttatttcgaggacaaagtggtgtctcctaaacccacgaacaggagacagcaaggctgccagggttgccggaaaggagaactgaagggaagcaaaggggctgggaggctctctcttgcactcctgccttatcttcttgtgtaaagatatgaaaatggccacagcatccaagtccctccaggtctccacctgggccagtcaactctattgaggtcagactatagcagactaaatggctatgaatgaggtggaggcagccaaggagttgtgagtcgggtaggctttagtcctacttaacttttaaaggtaagtacctttatccccattttacacataaggaattgagattcccatgagtcaaatgtccttgtccaaggtcacatggctaatcttggtggaggggtaggaagggtttggaccaaatcgatctgactcaaaacccatgtttgtaatcatcatatagaactgctgtagaggaccattagtcttaaatttaccctttaatcaagctagaaaagaaaccaggatggtttagcctgagaagatcaacctgagggtctgtatgatatccagtccatcttgattttaaaatcctttttggaggatggtgatcaactagcccttctctacagccaagaagcaggcctccgataacaatgtccccatgctcgagcccggacagacgtgaggacaagctggtgctacagcgagggccagcccttcttgaaggccaggggctggggcacagggctgctgttggttccatccggtcctcaagctgaaatctgtcctgacaaactgcccctggcagaaaattgggacacctcggaggtttagatgttctcatctgaccctttcacaatccccaagcagatggatccatgtgttttctttggctgtcctgttgcactggagagtgagtgttcattcttcgatatttcagtttacccatggggtggagaggatggggtttgtttataaatgaatgttttggtgtagacctgacttgacaccaacttagctacttcagggattcttggccctaaacgaacattcatttctgtctaaaaaacttggccatgatagtccaaactttaaatgatgttaatttaccgtgagatgtgatggagtatgtggtccatgggaaatatgacttagtgttatttatctaaaaatgagtgtctgaatccaccttcacgtttataaacactgcacacatgccagagatatgaggagcagggtgatggagggtgtgtttcctctgggagaatgagcccctcagataagggggagattcttgtggggtggaagattttggaagctgttcgtgagactattaattgatggcattctgcttcttgtcttgcagattggaaacctggaagattactaccatttttatcacagcaaaacctttaaaagatcaaccttgagtagcagaggccctcacaccttcctcagaatggacccccaggtacagagtgtccggatgctttcctaagggctggagggtttgggtctgtggtcttaaaaatggcggagtctggattttaatgtgattctggatagacatgagttttccatattcactttaaatacagcaagacaggtgtagctacgaatcagaccatctgaactaaatcatgtgagtgaggatctctcagcattttaaaatcaacaaaacacaatactcacaggagatacatatatgaatcttacccatgaaacaaaaactctaagcaattcaagcaagtattttaataatgaaattagagatcaggcaggtggatgtttttgtggttgtcataacatgtatgttaatggttactatgaatttgaaaactgaggcagtaactatgactttttttcctcaaagattcacatgatcttcaggattaaaacaaatgcgatttgaaaggaggctaacattttaaattttaacataacccgtatttattgggtggttaattatacttcctttctgcatagatttgaaattaatatttgagaaagatcaatcaacagttatgtgtcaagattaaaaatttaagatggccaagtgagcctccagtgagttcattcatttggcaggtatttttggaataccttccatgtggctggctctgtccatagcagggcccgtggagctggcggcagggctgacagaaaacgaagcaggaaatagaaaaatatgtgatatgtcacagggcgatgagtgctgagaaggaaaatgaagttcacgtgagaagcagtagcagccccagcaaggaacggaggtcattggtaaatcatagttttaggtcacagaaatcatcttctcttaaaagttaacgtatatactagatgtttgtttgggccccctggctggtgcacaatattatttcagctatttccagaaaatacttagagtaaagtttttatggaaaaatgggttcttggtgttgccccaacccacctgcttcaatgacaatcagggctctttttgtattgactgagcagggatctgttggagagacgcgttatctctgggctctgtacctgaattatccttctctggggcatcgcatggtgagggttttgatttgaagcatatgaggaagtggtccccatggagctcacccatggacctgggctgtgaaaagacagacttgtcttgaatatatttctggattggttttataggtgggtggatggatggatgaatggatggatagatagatacggataagtcgaacgagatagatatgaaacattgtgctaattccattattccttcatagcaagggaaggagttaagtgtttactaagggatggctgtgcttgggcactttacatgcaccgtctcaccccatcacatgggggtgagattacgtctacttgtgcttacaccatggaacatgaaggaatgtttttcaaaggggccagtatatttaatcctctaggaaaaaagccagattgtagttgctccttcccaaagagtggggcacttggggaagggtggatcagtagaaaactgagcagcagggagcctctgtacagggtgcataggctgatcccggaggaggcgtgagttctgtgcggttgagagaccgtcatctgtcatcttggaggaaattctaagctaggaaagaggtcgacgcagcatccctccacactttcactttaagcaagcacttgatctgccgtgtgaagaaacatcctcattcttcaactgaagtcttttgagttgttgaattgccaccacgcggatagttacaatgaaagcaagctgtttgcatgcaggaagcccatctcataagcatgctctgagaagagacggggaccgtggatttcttggtcttctttccatgaggccttccaagaattaataaagcagattcttaatggttagaactaaggcagagtcgaaataggagacttaatctgtgttttgactacatcctctgttgttggtgactatattttaaaacttttaaaggtactcaggtcgactgctcatcccttccttccaaaaatattaatggtgcacctgctgagtgcaggaccctgtgcctgagtaatgcagagctgcccagcaggtctctgtgttgctgagttctcggtgaagatggggatgggagacctgtgcatgagcaaggcaggctgaggcagcagagacagactctgtggggggcttgagggccaccataccctggacctgcctcctctctgcagcacctgagctgcttgattgacccattttaggtgtgttaaaagtcctatattcagtttgggtctgagggcaaagcattcccaggcattagttgtctcctcgaagtcagcagaaggaaggatagagacttcctaggcaaaggctaacgtagcagttaaattttttcaaataaaaatctccttctcacagagcttcttaataagctcctggcaaggcttctatcaatgcatcctgccagtaaagaagaaaggaagaaaggtaaacagcctgggcatcccaggccttcctggaacgttcctaggattggctgattgtttctcatagttctaattaaattgttagccccagggaaagcacacagacatctgaaccgattatgaattcagaatcgcaactgaaatacctctgtttaaatttgtctagctttaatgcaaaccaaatcaattagctgtcagtctgactaatatttactccacccagtcattacaattaaacacttggtgaaattagctgttttatggaagtatttagtgttatcttttattgcagtgcatcagaacgtttccctacgttggcaaagcatttttatgataccttcacatctggagagttgtgtaattaatattattaacaaaaggaaaagatgatttaatattattcagagacttcggaatgcgaggctgccattgtgttcaaatgaccaaactggaaatgaatgttatggggcttaggataaagttccatcaaatgcagacggtatcttattttaattagttccagtccctattgtataggagtgctttgataagtgatggaatgtacagtccaccccatgtcacataaaagcagatagaatgtacatttgggaaagcaaaacaaaactcaagggggtgtcagcagcaggactctgttaagcacgtgtgtgcacgcacacttattaggcatcttcttcgcactgatcctgtaccggaatggtacagtcattttccttgcattcttaattacctttacttgatgtttttcttaccgtctttgaaaagggccattttgctcagattgctttgttactcagccctgtccttggaggaacagcccaagtgttcgcagtgtgcagttatcggtcgctgggtttttccaaggcttgtcatttaagcaaactgaaagcatttgtttttaacttgttcttttgccaaaagtctggagaagggtggatattacagaagcgtcgaccaatcactgaaagggctcacaaatttttttaaaattacttgttctgattatgttccaagctggcttatagttagtcgttgctgcctgtgtcttccagaccttacattttagcatgatgacttgggttcagctcttttccttccctacagatctcagccagattggtgatggaaatggaaggataaagatgttcagagggagccttggtggctccttctagggccgtaggaggcttgggttcaatgcttcatttcagtgctttaaagcttagaagttgcaaaatgattgcaaggaccagaggaggcattctgttttgtaggatgggactttgcccccggagtttaatcaaagctcgggtttccttccagcagtgatgcaatgttgaagcagatctttccattaaccacagatggaattttatctaacagttttgtgtgctagagcaattcaaagtgcaaacaaacagaaagttcctgacaagagcacatagacagtaagtgaccacattggtctcaggggttgatgaactgtgtcatgggctgagggcagggccaggcagctgcccagggcccagaggatttgcccacgtggggacggtggactgctcccccatgagggtgatcgaatgacagtgacaagttggctgttcacattttcagcaccacccagctggttctagtggcatggctgctaggaattggtaaaaagtttgaatgtgtaaatttaccttaaaagacagcattttattctttcacgacatgctctgcccttccgcttagatatctcaaagacaatccaaagtcagtatgtcccaaacccagctcactgtctctgaccctagtctgtctcagagggaagcgctcatccgcattccactgcagtgccagcggcctctccttcccccctacacttgttccacctcccgtacaacctggccctgccatgtcctgtgtctcctgccctaggcccagctcctgtcatctcttgcctgcaccactgcactgccctccttgctggcctcatgtgggcatccttgccccggccagtcacctcccatgctcctgagggatcctctgaaatacggccaccactggcctttaagatcctcctcgggtgactttcgctctttttccctctgcagagcttttgcacagacggctccccaccttcccctgctgttgctctcttccccaccttcccctctgggctccaatatccctgccaccaggaagcctgctcagaggctgcggacttggcctgctcttctagcagtcgtatgtttgtattctagatctggccctagagtaggagcacacagcagtgtttgttgggaacgatgactagttcagtttgtttgggatctgtcagggacagacagagtcggcaggggagctgcaggtggttcctgggggacctggatcgtcaggcttgggagggcgttcagtgttccagaaccagaggagaggcgatgggaaggcggactgacgctgctgtgcggatgcctcgggagagaggaacttggagttcaaagcatgcaagcccatctcttgccaatgcaacaggaggttatcgagggtcaaggccacatatcatttgcttttactcccttacaagtccagcagcaacccagagaacagtagacaatgcttcctgaagcatatctcaagttccagagatgtgactcctataagcaagttgtgtgtaacataagcaacttctttctatgtaaatactttagaagtaaattctgacccaccttggctaaattatggaaaaatcctaaatatagttttcagttgacaaagctgtatcctgtattgctgaagctaaaataacagaggtacagacagtgactgcatgtcagacacgttgagcagtgttggacctcatagtttgttagtctgcgggggcagttgtaacaaagtcccacaggatgcggggacttcaaccgcagaaccgtattgtctcacacttaggaaggttggaagactgagattacggcgttggcagggttggtttcttctgaggtctcttgatcctcacgtggttgtccctctctgcgagtggctctgtcctaatctcctcttctcatgggacactggccagattggattagggtcccccgcatcatgacctcatattaacgtaactacctctttaaggcccttatctcccattacagtcacgttctgagctaccccgggttaagatttcaacataagaatttaggggttcacaggtcagcccctaacaataggtgaagctgggctccagctgcctcttctgttgtcagtgagtggaggtgggtggcgggcggtggggagaggggcaccttctgtcccctttcagcaaaataagaactaacttacaaatgagtagctttactttcccaaagagctttcacacgcactgtcccatttccgtcatcggcagagcgaggacttccctctctcatgactgttaagcaggggtcttctggcacctgtagtttaacttcaatggaaagaattcaagaaatggtctctacgctgttgcagttatggctgcaggggaggcagtggggagggagctgggctcgcagctgcctggatgacacgggaggtggtggtgggggtggctttctaggctgagttagaatgtcctttattttctggttcctcctccccctcctctactgcccgggcttactcactgggttcccgctgtgtgtttgccatggcagcctggggtttcccggccccacccctaggtgagccagtgctgcgccggaggtgggcctgggcatctcgccatgatgggctctcacgaaaccatgtaatcgtctctcacttgtcacgatggccctcttgccctgctggaagatgacagccacaggaccaatccctcactcggagaacttggatctgctttctgcctctgtctagcttggttcagtggttcttagccatttgggggaatcacaggcccctttgaaaagctgttggaagttgtggggcctctcgctctccagaggaaaaaagacatcatgctcatgccggcaccattttgcatacagttctggggtttctgggactcgagcctgtccttccactccttgagggactgtgggatccagggcaagatggctccagtgtgctgcatgaatcgtcgcctgtcagtgagagaagggccacgttgcacattatgcagtgacgggcacttgtcggggagtgggatttttctttctttaaattcaccagtcagctttctcactgagctctttagctggttggatgttggcccagcgaggtgctcagagcagtcaaggttgatgggaatcaagatctaagcgccacagactgttgagtgcacaagctctgagagagggaccggtcccagcccctgctttacagtgtggagggagaggcccaggcagggtgcccacctcccacacagagagaataacaggcttattttctacggtgccctgattgttctctcctggaggaggctttggagcttggtggctcctgggtgccgaggtatggcctccgactccctcccttgatatgccctggtggacagtcaggtctggcttgcagtccccttgttctttcacagttacagaataaagtaaccttcgctttgatgaaaccagggagaaaagagaaaagaaagagctggccgagctgtctcccttgcgttggctacaactgtgcagaacctgtgtgaacctggtgtccgcagccctgccggtgcgtacttcaaagaacctcagcagcttgactcccttgatgctgtgtgggacccctggaccgctgggggagggtgcctgtgtatgcccttcgtggccttccctccatctcagagcaaagactgaagcccctctccttttaggactctccagctcccaagaacttctaggggccttcctgagccacagcagggcccctctgaataggcacaggcttgaagttagggcagaaggacatggtggctttgggtggacgtgcaagtgggagggatttcatgctctctttggtgacactggctcatgagtgaaagtttcaaaacaccctcccctgtcgcttgtcacacctgggaatgatatgtcagcaagcttctggcccacctgtggcccacagggaagaagacagggccaaggctgcccatggctgctcgctgaaaggatgcttggacaaggatcacaactcggtggcatggacagcctgcagcatggcaagccatttactggaacgcgggcagggccccctcctgggtctctgcttgtttatgttaccctttaggaacatccttagattttacctcgtcttatcaacagagggacagtcaacggatgcctcattttaacttggcttctcgagaaggaagctggaggaagcacacactacaaaagaaagtgttgctgcgcacctgtcttgagaagacgatgaagccttcttcatgattagaactccctgccccagagcgtagcttatctataactgtgctgcatgtttagcaggaaacatacatttggaaaatagagaaaaggataaaaaggtcagagtgaagttctatcttcaaagtatgacgttaaagaaatcctggcactttctacagatttgcagagaaagacggtttctgtttgggctagaagtggcatttggcaaaccttgcctttgccccaaatcacttatagttgattttccacaagaaaagtcaacagatgtcatctagcagtcatttagacctaatcacattttctttctttctttctttctttctttttttttttgagacagagtctcactctgtcacccaggctggagtgcaatggtgcaatctctgctcactgcaacctgtgagggttgcttccattcgatgggagggctggagttttagtcgcttggtttggggctggtgacacacctctgacctccacagagtgtccaggtggctcctggtttcaccccgagggggcattgaaggcagagctttgcatcccagctggggatgggagggggaggcactttggtcctggccgggaaccaggtatgttcatgctgatcttcccagaacctagcgccagacacacaggaagactcagtgcatttttgttgagtgagccacagaataagtgaccccaggatgcctgctctctggagacactggggaaggtgaacctggaaaatggctttctctttgtggtgggtaggaggtgggatccgggatccccttgtgctgtcctggagctgggtgagaagcaagggagtgactggaacccagaggaagggacacagtgccgggagaatcagcctctgccaccgcgctgtctgcctgcatcccgtctccacggagaagcccccacgcctggtcagtcatctgttgtacagtgttcggttccattggcctgagagcacctcacttgccgtcagagacttacaatgagcaggtgtgttagcagagagagggctgcccctgcgaccacgacagagagagagccccaaactgtgctgcgggccgcaggctatcacagtccccctcagaactgtgtgccagtgttgtggggttttgcccagagcccagcaaggaccaagggccgggatgcccaggctcttccatcctgctgaggaaccctcttatgacttctggctctacgctttcccacatctcccagctgattagtggggtgtcacccacttgggcttggaagggcagagtgtgcctcctcctctgactggaagtgtggtctggtgggcacagcaattggaaggggctggatgttgttagaacagagagttcagggccccttagcacaaacagggctcagcctggcaggagggcgggacatccctgggagctttgggctgtgcgggatctacataccactgtattttgtaatagcgtgctgaacagattatgaaatattgtttgcggcatcttagaccaggtaaaaagccttctagttcaggcagtaatatatggggacattgcaaaatgccatcagccggtgttaggaacaaaatatctcattttatagttttattttctgtggaagtatctgtcagcggccattataaattatctaggacttggtgctgaggattttttaagtgtgtgacgtgaaactggttttgagccctttgcagtgtttctaaggcgtctggtctgctggtgttttatagacgaattacatcggggtgggacaggctgggatgcctctcttccggcattttgccctgtacaccaaggatgtcttggaggccatccccagccctaaatttgagctgtgtatgcaggtgctccgctctccttgctcagggtgatgtggggaggccaaggctcagggaggaggaagagaaatcttgtccctttgctcttggggactgttactccctgcccactcagcctcaggtagctctgttctagcttccagcacgaccctgggtcgccagccttgggtcaccttggggccccgcccccttctcttgttcctcccctgcctctagctgcctcctccaggcagcctgccctgtttggaactcacatcatcctctgattggtgggatcccctgaatgtagtgcagactcctcgagagcacggccctggcgcccatccttatcccacccatgtcaggccccagagccaggctgaaccccagctttgagcattattcaatcaggtggagctgccgtggtaagaccaaagaaaacattcccactcagggtccaagaagtctttaccccaagatccttttaaaatgaaaaagtttttccagcttgaaaagaatgtgtacacgggatgataagagcaggagtgctccaggcactggtctgagggctttatatgtgttgtttcttatattaaccctgtggcaacccatgactgtccccactgtgtgggtggacaccaccctgaggccatggatgtccactgtcagctccaagtcacacagctggtgagcacggggctgggttttattgcaggtggcctggtgccttgatccttggtcttaaatatcagtgatacagccttgtgaacttttttccttgatcgtgaaaacaaatcatgctgattgaaagacatttatgacatcctgaaagtaattgtaaaattttaaattagcaataatgtcaccacccaggaactgatgctactactattttgctgtattcctttctagatttttctctgtgcatgttttggtaccatattgctggtggctgccaaatattccaatatatggcttaccatatttacttatgtccttactgtaaagcaaattccaataccagttaaccaaacactttcttcattcactgctttcccatgtgtgtatttcctttttcttcaggacaaggatcaccagataatttatcggcaatttcacaaggctggcttccttccttctctccctctctccctcccttccttcttgtctttctgtctctctctctctctgtctttttttttttttgacagggtcttgctgtgttgcccagactggagtgcagtggcaccaatcatggctcactgcagccttgacttcccaggctcaagcaatcctttcacctcagtctcctgaggagctgggactacaggcatgcgccatcatgcccagctagatttttttttttttttttttggagaggtggggtttcaccatgttgcccaggctggtctcaaactcctgggctcaggcgatcttcctgcctcggcctcccaacgtgctgggatgacaggcgtgagcactttctttcttttagtacaacgacttcaaaatctatcagagtggtgttatttcttcctctgtatacacaaacaacttctcatctttcaaatgtagtcactttgaagtgaaaatgtccccaggaacttaccatctaaaatatctgctatgacacagatattcacgcacaaggaaggctgtagcacctgcaaagaggctacataaaatcaagaaatcatttctaatataaacagtaattgcatttcttctggtaggtgaaatggctccagcaacaggaagtgaaacgaagggtgaagagacaggtgcgaagtgacccgcaggccctttacttcaacgaccccatttggtccaacatgtggtacctggtgagtaggacaggacctctgtctgccccaggacacttgcactgccaggtctctgaaatgggttaatttccctcaacaaagctaaattcaaacaacatctccagacagacacacttcaccttgagggtgtaaaaccactaccgcaaggctgtgcagtaccggctttcctgtggattttttctgaaactttgtgcagcacactctgggatgggggctctttgagaagggaagtgatttgatgcaggctgtatgactaaatggcaaagcccagcccatggacagagctcctgctgggaggcgatgccctgggaaaatatagattgcaggtgcagaaaaagcaagggagccgtctgcatgattctcgatccgagtgggaaagaggagctctgctatgtaaggcagggataggtgttccctccttttttacttgcaagcctaagcgcctccctgtggggtgtgcaccgagtgtcagttctgcatctggaatgtccatgtcggggggactttgtgtctttcgtgcttacagcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgtaagtcaatcctcggaactgacatgcaaatatattcaactgtgctggtcattaagtaaatgcaagtttaaaaacagtaaggtcccgatctcccccagcccccattaagttaggcagtaaagaaaactatgctggaaagaattaggaagatgaatattctgctacttgctactgtcaggggcaagggttttgcagagggattcatccacatgcttgcacagtcacatacacttttaggaatggagcctaaagaactaagaaatgcatggagggggatcatcagcgtacagatagtagcaacacgaacagtgacagggtgacagtgtgaaaacacgggctctaggcccagagtgcctgggttcctatcctgggtctgcaaatgattagctctgagatcttgagtaagttacttaacttctctgtgcctcatctgtaaacattttaccgtctgtaaaatggttcataagagaacgactctctcacggagttattgtaaggactaaattagttaaatgtaaggacacaagcttggcatatcgtaaatatcatagatgcaagaaatactctaagggacttgggcacctaccggtgattaagtaaaccatattgtatccatctgacagatcgttatgcagcccttagaaatgaattttgcagactacgtgtcaacaacactggaaaccttttatcatatattttaaaaggagaatgtaaaattatgtgaatactgctgttacagtcatataaacaaaagcatacctattgaaaatataaaatgaaggaaatcctgacccacgtggaaacgtggataaaccttggacgttatgcgaagtgaaataagccagtcacaaaaggacaaatactgcctgattccacttacacgagtgactcggagtagccaaactcttagacaaaaaggtggagtgggggttgccagggcctgggagaggggagtggggagttagtgttgagtgggtgtggggttttgcaggttgaaagggttctggagatgggtagcagcgatggcctcaagcactgtgaattaatgccactgagccgcacactcgagaatggttaaggtcgtgtatttcccgtcacatatattttaccacgataaaaacgtatatgagattatagctatagtaagagaggagccccgcgtgtggtttctctatttgccaacggaacataaaatccatttcaaacagagctgtcacatgccatttctcctcactcaccacgattccatttcttaggattcctacgccagctacgacgtgaacggcaatgattatgacccatctccacgatatgatgccagcaatgaaaataagtacgtcacctcgcctcatctccccggcttctcttcccctccctgcagcgtcactattgaatgtgtgtgcgagggagctggagaggcggtggctgccggcgtatcttccctgcctgggcgcgaggcaggcttctccaggagtcacaggccatgccaggcacagcccttcaggcacggccagcttctgtggagtcagcctgttcctctggggtgtcaccgctgccgggcagctagaaatgggtgtttgacagacatcgttcctgtttccaactttcttgaaatattttaaaagagaaacccttaagtctaaccgtctccatgacctgctgtgtgaagacagcagtttggtctgtttgagcacacaggtcacgtgcctgagcttttgtgactctgtgaccttaggaatgaggtggaaggggcatgagtaatgctggatagacccaggttcagatcgcagctctcccacttactggctgcgtgcatgccgggtgagctggttgaaacttcatgtcttagtgtcttagaggctcgtccaggccagtgatgtcccctacctcacagggtcacaggaggggtcagtgagatgatgcatgaggaatgcacccagcagattcttccgaaatggtgggcgtttttgtgtcactgtcattttgcaagtggaggcagtggggtccggagagcccaggtgactttgcagtgtaaacggcagccctggggtcagtcctgggaattcatttgctgtctctttccttctccatcagcatgccccataccctgagctcttatcattcctctaaaaatatttagagggaaataataaaagctttttcttcctccccactgttgacaagactcttgctgaggggcgtctcccgattatagtcttttagtttgtggtcgctttgattctgagattcacaaacgggtgcgcaggcaatgctgtgcaggaagcctcggccactggagttccacacagcaggctgcagagctcccgcgagcctgcagcagcccagcctcatgcacgtcccaaggtgcccttcctgctgccagtgaggatgcctggggcaaaggaggaatgacccacataccacgcagtgacccttgaagggcaggattcaatcccatcccgagccatccattgagctctgtgaccccgggaacagccctggccttgaagctgtgtggcttccagggaaggacagatgactctcttccagagggctgctgcctggggcgatttttaaaggcagctttaaatttgaatcaatgattcccatcctctgtggactcttctcaaagatgtgctatttcaagttgctcctattttggcccccgctggaggaactgacccgacgtggcacatcagagaatggggtcattactgaggaaaacgcatttgtttttctggtcatttcttcatagtctcccagctgctgagtgtttaatttagagcgttcttcctcagctccagcttaaatggccttagaagcacaggaagggctgcctcagggtaagcatggtgttgtaggtgcataggggatgaggcaggtgacatcagcaccagactgttccttctttcatcctgccaggcagcaggtgtccctgctgccagccacaggagacacgaggccgaggtggcgcagcacccaccctacacagcagtggccatgtgccaattacacgtgctgggaggaggaaggtataggaccacgggcactggggcaggcaccttcctcccacatgggggtcaggggaggcatgctggaagaggtgaccatgcgtgagcacttgccacattcaggatgccaggaagggctgtacccaggctgacttggtgccttctcccagagtggggttggtgatgagaggggatgcaggaaatgggctttaatgacatctctgggcttcggacaactgactctcttgttgcattgaactgagccaggcactgaattcactgaaacttgctgggctgcgtcctcacttggttttttcctttgtttcagacacggcactcgttgtgcgggagaagttgctgcttcagcaaacaattcctactgcatcgtgggcatagcgtacaatgccaaaataggaggtaaggccgggcgtggcagcctgcgagccgaggggcctggggcaggggcagctgggagctccctgtccgctggtctcagcagcctcctgttttttggctttggccatgtcagcagacccctgggccagacgcagcagtgccgtctgtatcatggcccaggcagctgacccacagggattggggcctcaagacagaggaactgcttactgttttgcctgaaaagccattgcagttcccatcagaaaggtaccctctctcctctggtcctgctggcctggctgctgactcctagaagtctgcgttgattccccgctgcccatagccctcagtggctccgtcacttcccagacagagtgacagcttttacccgggaccagagctttccctgggttctgactcccactcaagcctgctggcccacttctcctgcccctgctctgaccttagaggacatttttcatagtgccccttagacacatctggtcttcccgattgatgcctgggcttgaaccattcccatccccgcctcccccgtctttccacttggctctgtccacctgtgccttatggcagcctcatgcctgctctgttctgtgaagtgctccctggatccagctgtcccccgtctcattcaccagggaatcagctcttcttggtccctttacggagcagcagccgcccctgccccgcgtgcgtctggtcttgccatttagcttctcacactgctcagtcaagctgcccttgctaggatgaggctttggagtaaagtattgaatgtcttcctattccccacgggagcccggcagtgtgacagctcagtcacccaagtgctctgaaggcccctctaggtgcatgtcactgacccgggaactgagcaagtgggggcagcagagaggagtgccagagggcctccagggactgcggcctcacccaggaggcctgtctgcttctcagtccgaaggtgctcctgctcactcaggtggctgcagtgggaaaccaccttcccgggggggcactgccatcctgccactgagccttggtgagggtgcctgcagccgctttctgccgttctgccaccgagccttggtgagggtggctgcagccactttctgccgttctgccaccgagccttggtgagggtggctgcagccgctttggctccacttatgagcagtaccaggcagggaggttgggccacggttccctggatcaccagtccttgggggaatttcttgtgtttcgaaaagagggtccttagcttttacttaattaggactctgcctgccttttcccgtggaaatcttgaaggtggcttggattttcattttatagcagaattaacccccaagggcgcgttctgcagaacaaatcaggagactctgtcaactggcctggctcctttgtggatagttcttgcaaactgagatatataagttctccctggagcctttgatgatgggtgcagagccctgagacgtctctccaggatctgtagaatcgggccaacctgggtgccagttccattcccaccactcactgtctgtgtgtccttgaacaacttacataacctctctgagccaaggtttctttacctgtggggtgaaatgaccaccaggcagctgcctccccagttttgttatgaggatgaagtcagataccatgtgtgaaaccatcggcttgggctaagtctgcaggggatagctgagctcctccttccctcttgctgagactctcagtgggagaataaaaaccatttgtgttgctttgagtgaggggtggaccccacctttggagttgcttgagccttgctcccccaagtccctagactttgagcatggcatcctctgggagccgttagaaatgcagaatccccaccccaggcctacggagtcagggtttgcattataacaagatcgcaggggatttgtctccacgtcacaatgtgagaagcgctggtttagaggactccctggggtctcacaggtaggtaacacctgcatcatggattgcggggaggagtcagtggaagtaacatgcataaagatcctcccagatgaggtgcacagtaaatacagcattaccgttagatagctctacactcatcgccaaactctttccctacgtttcccgagtcctgcaagtgaaggtgctccctccagatctggaaaatgtagggatagaatttggcatgtgtttaaaacaagaataatagcaatgcactgtgggtttataacgtatgaagcaatatatatatatatgtatataaacaacagcaggaatggtaacagtcatggtgaatggaaacgctctatcttagatttatacattatacagaaaatagtatactattaattccagatagactgggataagttaggatatgcattatagtctcttgagtgacaactaacaataaagacatgaaaaggaagagctctatggtcagctccagggacatcccagggaaattccctgttgtgtgccagcacacacagagagggagctgtgttagagcacctcacccagaggtgggcttggagggagaaccaggaggaagcgggttggctgcctgtgtggagaggctaaagctgtttgcagcagctttggagccagtggctatcactggatccttgggtcaaggccagcctcaaccccacacctaccttccagagaggtgtgagctccacctcatgtcctcgatctttatgtggcctgctcaccccagccccacgccgcagacgtaattgtctcctcagcactctcacgggtagtcaagtcctgccgtgtcaagctcagccacaccctcatgccctgctctcatggggtgcctgctctgccacccctggggctcctacctgcccctttaacttcaataggtggttctgtgccatcttccttgttggttccctccaaagacatgctgagctcctagaggcccagaactgtgaccctcatctctttcgtctctctgtcagcggcatatccagtattatacatgcagcatgtgctcaaccatattcaatgcgttaattaaaaaatatccctgttatcatgcatatcccaacttatcccagtctatctggaattaatagtgtactttctatataatgtgtaaatctaagattgtttccattcaccatcactgtcattgtttgtgctgttgtttttatagattctacttcacatgttataaacccacagtgcatttcttgttttaaacatgtagttgaccgcaaactacttatgacaagaaatacatttacctgcctgtgtaccattccactgactggtcttccttactttttctagcttcagatttccatctttccatttatcttcagcctgtcgccaggctctttggtatttattgaggttatctctcacctcttttggtatttgttgaggttcaggtatgctagtgaaaaattctctccaattttatctgaaagtggcttctcttcatttttcttaaaagaaattatgctgaacacgaccttctaactttttttttgtctttcaacactttaaaggtgttattctgttgtcttctggtatccattgtttccgacgatgagtcgattgttaattgccatccttattgttgttcccttttaagaaacgtgatttgttcctatggctcctttttttttttttgaagagatggggtcttgctctgtcacccaggttggagtgcagtggcataatcatagctcactgcagccttaaactcctggcctcaagtgatcctcccacccgagcctcccaagtatctgggactgcaggtgaacacaacctttcccagctaattaaaaaaaacacacacctttttccttgtaggatgagatactgctgtgttgcccaggctggactcaaactcctggcctcaagcgatcctcccacctcagcctcccaaagtgctgggattacaggcatgagccaccatggcccttccctgtagctgctttcataatgttatttttaaaaatatctgtgctttgcctgtggctctaacattcttttatgtagttttcttcgtattaattccatcttgggttttctgtgcttcttagtgggttattctttttaaagaaaatttggaaaaaaaattgtcaatatttcttcaaatttttttaagttccattttctttctactctctgtgggcacagttatagttgttagattgcttaatacgcctcacaggttactgaggcactgttcatttttttaacccttttttctctgcttcgaatggaatgatttttattgaacttcaagttaactaatccttccttttgttgtgttcagtctggtctttaaaaaaaatttcagggctgggcatggtggctcacacctgtaatctcagcagtttgggtggctgaggtgagtggatcacctgagatcaggagttcaagaccagactggccaacatgctaaaaccccgtctctactaaaaatacaaaaaatcagccaggtgtggtggcacatgcctgtaatcccagctactcaggaggctgaggcaagagaattggcttagacctgggaggcggaggttgcagtgagctgagatcataccactgcattccagcctgggtgacagagcaagactccatctcaaaaaaaaaaaaaaaaaattcagatatttacttttctgtcttatgatttccatttgactctttttttactgtttccgaatccctcatgtgtctccatctcttcagtcatgatatctatcttttattctagactctttaacatgtttgtaagaaatactttaaagtcttttgcacttaattccaacatctaggccattttaggagtatgtttataatgactgatttttctctttacagtgggtcatgtatttctctttctttgcatatgtctagtaattttttattgtatggtagatattgttacattgtagagactctggattctgttgtctttgaatatcattaagtttctttcttggccaggcgcggtggctcacgcctgtaatcccagcactgtgggaggctgaggcgggtggatcccgagatcaggagattgagaccatcctggctaacacagtgaaaccccatctctactaaaaatgcaaaaaattagccgggcgcggtggcgggcgcctgcagtcccagctacttgggaggctgaggcaggagaatggcgtgaacccgggaggcagagcttgcagtgagctgagatcgcgccaactgcactccagcctgggcgacagagcgagactccgtctcaaaaaaaaaaaaaaagtttcgttctagcagttggttaaatgtgagcttgtggagacctgattattcttttttttaatgtttgctatctttctgattttcgcatagccttagggaaaatccattagccctagcatatggtctttactcctagaccatgacccttttggtatttcagtggaaagcctgaaatgtttaaacccagacctctaacttagcaagtctgaaactccagatggactgccctgtagtgggcagcagctgaaatacctgctcagctcctccagcctctcagctgctgttttcctactggacttcttagtgggttgcccatgtatacttcagggttcagccaagtggttgtgaggagtttatatgttctcttctgtagatctctcctttctgaaatttctcctctcaatttccagcagctctgacagtcccaactctatcccctgactcctctggagaataagatgacattttactgtacttcagtatttgagttctagcctctctgcaccaaaagaaatggaaagttccctcaagaggaaaagtcatgtcaacttggagcatacccagtatggtttgtcaagaattgaaccccctgcctacctctgcccttttctggttgttcttcagtggtcttaaaaagttaattttttctaagtaaatattttttcagagtttataattattatctttaataagaagagttagtctgatataagcaactctgtcattgttgaacttaaaacttgtggtttatagttatcaattagattgtgtattagttatctattgctgagtggcagtcattctaaaaatgcagctgcttaaaacaacaaacacttgttttccagcacagatagtggctttgctgaatgtttctgattcagggtcactggtgaagttccagtcaagctgttggctgtgattgtagtctgaagacttgactgagtctggaggattcacttccaagatgggttacttatggggctgttggctggagtccctgattcctcactgtgtgtacctttccagagggttgcttgagtgtccccataacatggtagctggctttctttataacaagtgattcaagagaaaaagcaaaaccaaaccagcaatgtcttttatgacctcatctcagaagtcatgtaccatctcttcagccatactctgtgcattagaaatggatcactaagtttaacaatacactcaaggggaaagaaatttggtcgcaccttttgagtagaaaggtgtcaaaaaacctgtggacatagtttaaccaattttctttgtaaaactgcacattccttataaatgttgtcacataaaaataattaaatcaactgaaagaaacaggaactgtccaaattatatcttaagaaatagccaggcgtggtggctcatgcctgtaatcccagcactttgagaggcggaggtgagcagatcacctgaggtcaggagttcccgaacagcctgccaacatggtgaaaccctgtctctactaaaaatataaaaatcagctggatgtggtggtaggggcctgtagtcccagctacttgggaggctgaggcaggagaattgcttgaacctgtaaggtggaggtttcagtgagccaagatcgtgccactgcactccagcctgggcaacagagcgagactccatctcaaaaataataaaaaagaaacaaaactccttcaacccccagtttccctaggtgtgttgccttcaggtgcattagcacctaccctggggagaaattttacactgtcaggaatccacagaggcatgtgccatcttcattgtttccagagaggagagtggggtacccctgtgcggtcactggtccctgatgtctttcattttagagagactttaattttatattaagttgtcaagctgtacattgatgatttgtgcccccttttcatatataattttttaataaaaatctgtttaaagtttttatgggctgggcatagtggttcacacttgtaatcccagcactttgggggttgaggcaggaagaccttttgagcccagaaatttgagaccaacctggtcaacatagtgataccctgtctctacaaaaaattttgaaaaatttagccgggcatggtggcatgtgcttgtagtcccagctacttgggaggctgaggtgagaggaccacataagcctaggaggtcgaggccgcagtgagccatgattgcgtcattatactccagctgggtgacagagtgagaccctgtctcaaaaaaacaaagtaaagttcttatgatgtcacatttgttcatcttccttcatgactcttgagtttgggatcttgcccaagatagtaaacctgttttgtatttcctctaaaaacttagttttaggacaataattggtcttaaaatttttatggttttctctttcctgtttagctttttttttttttttttgagacagaatctcactctgtcacccaggctggagtgcagtagcatgatctcagctcactgcaacctccacctcctgggttcaagcaattctcctgcctcagcctcccgagtacctgggattacaggtgcccaccaccatgcctggctaatttttttgtattttttatgtaaagacggtgtttcactatgttggccaggctgatctcggactcctgacctcaggtgatccacctgcctcagctgcccaaagtactgggattacaggtgtgagccactacaaccagcctttctgttcagctttttgatccatatggaatttatttctgtgagtagtgtgaaagagagatccccccaaatcaatatttggtgattgccacacgtggccctcatcacatcctagatccccatatggacactgggtctgcccttacgtttccttagtcagttccttcataagccctaacaataccacgctttgaattattacagtcagtttaggagagttttggggttttgtttttgtttttttggtaactgatagggcaaattttctcttatggttccttttcaaaaattacttggctattcttgcacattttctctttcagatgaacttgagaatctgcttgtcaagttccattaaaaaaaaaaaagccctgttgggattttgattgggattgcttggaaattatagattaattgggggagaatgacatctttacaatattgagtcttcccacccaggagcatggtatgtttttatttattcaggtcttcttttacattgttttttaaagttttatcactttctccatatcgattttatacatttcttattagatatatatctagattttttaaaaatttgtatttctaattggtcattattgaaacggatataggaaagctattgatttttgtatgttgggttttgtttctggtcaccttattgatctctgtgggtgctgttgtttttccgttggattctcttggcttttctggagagatgttaaataatagctatctgtaaatataatggtggttttatctctttaatattaataactctctttttcttgccttatttgaatatgtagcagttcctgatgaatattgaatagtggtggtttataggttctgtttgatttctgacttatacaggaatacttctaattttatgccatttgtaaatgtcttccctgtagttaccctttatcaagttgagaaaattttattatattcctagatttctaagagatttaatcaggaatggatgttgaatatttaaaagtatctattgagattattatattgtttttcaactttattgtttaatctgtgtagtgtaataagttacattaatagatttcctaaactgggctaggcacagtggctcacgcctgtaatcccagcactttgggaggtcaaagtgggtggatcacctgatgtcgggagctcgagaccggcctggccaaaatgttgaaaccctgtttgtactaaaaatacaaaaattagctgggcatggtggcaggcacctgtaatcccagctactcgggaggctgaggcaggagaatcgcttgaacctgggagacaaaggctgcagtgagtcgagatgacaccactgcactgcagccctgtaagactttgcctcaaaaaaaaaaaaaaaaaaatcctaaattggaaactttttctttcatttttgaaataagttccatttgctcatgagtattgttgttttgatacatctgcattcaactgctgatgtcttcttatggttttacaacttcatttataaaatggatagaatcacagtttctgtgttttgtgatgtttctctctaacttgtttatcagagtcaggccagtctcgtagaaagagttaggaaactttcttttcctgtgctctgaaatagttaatatattgtggatagtgcctgatttctgaagtgttggtagagctgattaactagtctgattggatatggtgactttcaaaaggactagacctattcaggttttctgtttcttcttgaggagatttttgtaattaaatcttcctagaaaatcatcaatttttcaagattttcaaatatatgacataaattcaatatcatatgctcgtaatttaaaagtacatcctccatgtttatagttataattgtttctaatcttatttgtgacatctcctcttttttccttgattgatgaaaaatttctatttttaataaaataggttttttcacctcagtgtcatacaatatacccatgtaataaatttgcacatataacccctgaatctaaagtaaaagttaaaattataaaaaatagtgtacgtaaaaataaaaaaaaacaggcttttgcagagaactaggttttttttaattgagttcctttattttctgcatcataaatttctgcttttacttatttattaattccttcagcttttaaatttgttgttgctgtgttctaattccttgaatggaatgtgtatttagttctttattttcaggattttatgtgttctaataaataaataaataatcatacattctcctttcatcacctcttactagtttaattatatggtgcttttcttgctatatatttctgaataattgtacgtttcagcttagatttttctctttaacccaggagttatttagaagagatttataaaatttttcaactgcgtagattttctgatgctccttttgttgttaatttttaagtttcttatattgggttcacagaatgttctgtatattttctgccttttggaatttctggagaatatctttgtgtcctaatacacgttcagtttttgtgaatatgccaatgggtgtttgcattagtccgttttcacactgctgataaagacatacccaagactgggaacaaaaagaaatttaattgaacttatagttccacatggctggggaggcgtcagaatcatggtgggaggtgaaaggcacttcttaacatggcggtggcaagagaaaaatgaggaggaagcaaaagcagaaacccctgataaacccatcagatctcataagacttattcactatcacgagaatagcacaggatataatataatatagtagcttttccaggcacatggtacaagctgccagtggatctactattctggggtctggaggatggtggccctcttctcacaggtccactaggcagtaccccagtagggactctttgtgggggttctgaccccacaattcccttctgcactgccctagcagaggttcttcatgagggccccacccctgcagcaaagttctgcctgggcatccaggtgtttccctacagcttctgaaatctaggtggaggttcccaaacctcagttcttgacttctgtgcacctgcaggctcaacacacaagtggaagttgccaaagcttggggctcccaccctctgaagccacagcccaagctgtacgttggctcctttcagccacgactgacgtggctaggacacagtgcaccaagtccttaggctgcatacagtacgaggaccctgggcgtggcccatgaaaccactttttcctcctgggcctctgggcctctgatgggaggggctgctgtgaaggtctctgacatggcctggagacattttcccatggtcttggggattaatgttagattccttgttacttatgcagatttctgcagccggcttgaatttctcctcagaaaatgggattttcttttctactgcatcatcaggctgcagattttctgaacttttatgctctgcttcccttttaaaacagaatggctttaacagcacccaagtcaccttttaaatgctttgctacttagaaatttcttctgccagatactctaaatcatctttctcaagttcaaagttccacagatctctggggcaggggcaaaattctgccagtctctttgctaaaacataacaagagtcacctttgctccagttcccaatgagttcctcatctccatctgagaccacctgaccatggaccttactgttcatatcactatcagcatttttgtcaaagccattcaacaaatctctaggaggttccaaactttcccacattttcctgtcttcttctgagccctccaaactgttccagcctctgcctgttacccagttccaaagttgcttccacattttggggtatcttttcagcaatgcccactctatgggcaccaatttactgtattagtccattttcatgctgctgatgaagacattcccgagactgggaagaaaaagagatttaattggacttacagttccacgtggctgggaaggcctcagaatcatggtgggaggcgaaagccacttcttatatggtggtggcaagagaaaaatgaggaggaagcaaaagcagaaacccgtgataaacctgtcagatctcatgagacttactctctatcacaaaaatagcacaggaaagactggcacccatgattcaattacctccccctgagtccctcccacaacatgtgggaattctgggagattcaattctagttgagatttgggtggggacacagccaaaccatatcagtgtttgaagagtatttttattctatgctcattgagtaaaaaaaatctgtatcagattagggattgcaactggtagcccataagctgcctttggcctgcagacatgttttgtttgactcacacaagtgtatttttgaaaacttgagtaaacatttacaaatcacagtattttatgtaaaaatatggatttggggctttctatgaaagcttagaagctctggctgtgctgggccctcattccttaatggcaacagtcggctacgattgctcctaactcaaagggcagtctacccgtccccgggtggccttcacagacctggctgcttcagccatttaccctgcctgcctgatacctttaggcatcagcctctatcacctgtgtgttctatcaagttcattcagaagttctggagtctttcttactttttgtctacctgatctgtttctgagaaggaatgctggtttccatgatgattatggatgtgtcagtttctttccgttttcgctgtacacattttatagctatttacaaggtacattacaaggtataatgaatcttcatcaatataaaatcctctctatctcatttttgccctttaattgtactttggctgatataacacctgtactttgattgataaaagtagcacacttgcgaatttattttatcatccttcttctcatatattctttatttctaatgttggttttataagcagcatgtatctggatttatattttaacacaattgaagagtctctttaaagaaggactttgttatattcatacatgtgctgatttcagatatctttggatttatttctattgtatttgtttttatctattcatccatccatccatccatccatctgtccgtccatctgtctaccaatctgtctttacctgccttttgctggttagatgtagtttcttctcttttctttcattctaatgggttgaaatttttacattctaaatctgtttttctgttactctttaaacacagttattgggacttatgtttctctacagtgtttagcgctaatcagtacttaactctttcacctgagcaacataagaaacttaccatagctccactcctctgccatcttctgtctgtcgtcacctccttgaattgggataattcaaaaatttaactccatattatttttaacaagtttacatcatgcatcaacaattgtgtgagcttaagtataaagtctaattaatttctttggtcaccattgtttcttttttcttacatctttgtatgtgatttttttattttactagattttctcatctattaaattattcattctcttaaaagatattttgagtgcttgctataggtatgaatggttatatagatagtaaattttctgagtccttgaagtctaaaaatgtcattattttctccctacaaatttggctaggttttgactttaagttcaagataattttcactcataatttaaaaggtattaccccatggtctttggtattcagtgttgctgacaaggggcgtctctttgtctcaggtgaatttttttgctctgaagtctactttatctgatattaatatagctacttctactttcctttgattaatggttgtacagtatacgtttttccatccttttactttcaacttgcctatattgttatatttgaattgagtctcctgtagataacatatatttgggccattttttaaaatttatttttcttttataaaaatttttattaatttgaagagtacaatacagtagaaattgcctcttttttcttttattgataaatgacatttcacatatttaagaggtacctgtgaatgttttctacatgcatggaatgcagaatgatcaagtcaaggcatttggggtatccgtcatcttgggtgtttatcatgtctatgtgttggtaacatttcaagtcctctcttctacactgaaatatttaacatattgttgctaactgtagccccccggtctgctgtcaaacgtgggccatgtttttagattcacttgccaatctcttttagttactatatttagatggttaatatttaatgtaattattgatacattaggggttaagtctgccattttaacttctctattattttcctctgtatttagtttctctgttttttttttcctgccttcctgtgggttacttgaacactttttaaaatctcacttggtttataatgtttttgagtatgtcttcttgtatagcttttttagtggctacccttggtattacattatgcacatgtaacttctcacaatcaattttatgggtgttgtcactttaccagcgtgaggtacagaaaccttaccttcctttatatcccattattctctcccatttatatttgtaatatacatacatattaaacatacattcatttagaaccacatcagacagtgttgtaatttttgcttcaaccatcaaatgtaatttagaaaacttgaaagtaaacttggtgaatctgtaggtttatatctcttgccaaatttggagagcgtttagccattatttcttcgagaacttttccagcccccactactttttttcctcctcctcctcctcctcctcctcctcctcctcctcactcctcctccattattagagacagggtctcgctgtgttgctcaggctggagtgcagtggggcagtcatagctcactgtaacctcgaactcctgggcacaagcaatcctccggccttggcctcccaaagggctgggattacaggtgtgagccaccactcctggccctttttcctctcctcctgtccactctagtgacatgaagtttaggtctttgttatagtctcacaagtccctaatgctctgttcatatttttaaatttttttctttatgttgttcagattgggtaattttatatatatatatatatatataattttccagttcactctttcttctgtcctgtgggttctattactgagcccatcactgagctttttgattattgtatttccagttctaataattctacttggttcctctttatatcgtgtatttctttgctgagactttcagtttctttattgagactttctattttttcatttgttttaggcatatttgtaattgctcacctaggtgtttttttcatggcctctttaaaatctttattaatatacaactagtatatccttaaaaattaaaaataattttaaaaggtaaacctaaaaagaggaagaaaatgaataaaatgtctgtcagatggttccagcatccgtttcctccatgttggcatcggtgattgtctgtctttatgcatttgagatcttcctattcgttcttggaatgacatgtgatattcctttgaaacctgtacatttttgcattatgttatgaggctatacctgacttcagccttctgtttcagctggcttctctggccctgttgctgcagaggacaaggggtaccatttcattattgtcaggggtaggttgtccagggcccccattcagcctccgctgatacccaagcgtgggaagtctccttatcagtgctgagaaggggcagtggttcccactccctgtgtgcctcccatgaccccacagtgcaggtcccctcattactgtgagcagcagtgagcctcctgactctccaccaggcatcctgacacaactccaggggatggaggggacacgttgttactgctgggtgtggttggaagaccaggctcatggcatggtatctgctggcaccatgcaagtgggccccttttgaggttgctggaggtaaaagcgctgcttcctacctgctgtttcctgacatgccccagcagtgaggtcgggcacctcatttcgtcctcgcatgggtggaggtctaggctcgccactcaggctgtgctgccataggtcggggtggtaccacggttccttgctgtggtatttggcctacttattgtgtatggttttttccatttgttctattggccctgtctcgtcgggtccctctgttcttgttcatgttgctttttaattgggtgcccctctttcttgggatgggttttcctcaaacatgggctgcttcttggtcgtccacccctgcatgtgctcacagatccccatgtggctgtgggtggttgtctggtctgacggcaggggtctttctgtgatgtggagtggagggagctgttgcttgatagcatttcttctgagaagggtgcgaggcggactccccgctcccagggcatcgtcctggtgctctggccttaggaccctgtctcactgcaccagcctcaagatgactctgctgctgtccccactcagcctggaggctgagacctgccaccctagctccttactccgaggcctgtttggggctcctcctgtccttgcacgcccagcctggcaccttcctcagctctggaattgttccccactcagaagtcctcgcgccaggaccccgcctcctgctgctacctgatgccctctgcttcccgtctttcctcagtgcctcaagacagctcgtctgtgctgatcttgtttcccaaggctggttcagatttgttcgttctaagttttattcctagggatccaggccctggggagaggtaggctgcgtgctcagtcttcctcctgggttgggtctcttgagtcttttcactgtggtgcagatggtgacacctcttgccgattgctgttggttgccaagcacttgtagtcatctttgcatccagttcttagtgtgcctctgtgcgctggacatgatcatggccgtttcccaccaggggagactaacagagagatgaattgccacatctgggttcacacagctgccaagaggcagcgcagaggcttgagctcaggcctgttgccctgaagcctggattccacctttgcaatcatagccttctgatgctaggacatcgcggtgaccagatgagaacagctgccaccaagcccagtggccagaaacagaagcagaaggggaagccttcgcagtgtataactgtatacttcttgactgaattctgattccttccaagcatattttggcctcgcctcttcctcctggcctaaaaaggtatgataatgggaacagcacaggagggagcgagagagggcagcaggcatttcctagcccctcttcttattcatcctttctttgctctcttgctctgttcacctttttgtctttttaattttgacctggcacatagttctccttctctctctctctaatgctccttccctcccagcccttctgcttcagggtggcattggtggtggggggctccagacttggctgcctccactgccatcagctcacctccaaggtgagtgcaggctgagcttcatggcaagcccttcctgctggggcctgcagaattctaaaggccctggccaagcacagtggctcacacaaaatccctgcagtttgggaggccaaggcaggaggatcacttgaggccaggagtttgaaaccagcctcaacaacatagtgagaccctgtgtctacaaacaatttaaaaattagccaggcatggtggcttatgcctgtaatcccagccactcaggaggctgaggcaggaagatctcttaagcctagatgtttgaagctgcagtgagcaatgattgtggcactgcactccagcctgggcaacagagcaagactcaaactcaaaaaaacaaacaaacaaaaaagtgtgaaggcccctcccagaatgcaggctgaggatgtgatcccatccactgcaccaggtcctcctggcttcgtgccccatgcggcatcctttgagaaaagcttgctggggagccaggtgtgctggcttggccggagtggaacctgctctctcagggaggcttgcaatatgcaggggaggtgagtggagccctcacccctttaactttaccaggcttctaccctttagcaagttcctcacgtgtgctgatacttaaccagattcagacactttcctaaggcaggaggggtgtcatgagggacactgcattatggtacactttccctgcattttttttttttttttgagacggagtcttactctgtcgcccaggctggagtgcagtggcacgatctcggctcactgcaagctccgcctcccgggttcacgccattctcctgcctcagcctcccgagtagctgggactacaggcgcccgccaccgcgcccggctaattttctgcctttttagtagagacggggtttcactgtgttagccaggatggtctcgatctcctgacctcgtgatccgcccgcctcggccgcccaaagtgctgggattacaggcgtgagccactgcgcctggccttgtatttttaatagagacagggtttcaccatgttggccaggatggtctcgatctcctgacctcgtgatccgcccgcctcggccgcccaaagtgctgggattacaggcatgagcccccgcgctcagcctccctgcttttcagaagcatcgccagtccacagggcaggatccctgaggctggtctggagtaggctgcatttggggcctgcagcaagggcagctggagaccgcagggagccctcccacctgacaaacagaaaagctcccctgctccggcccccggatataggtgcatcttttcagaccatgtttgccctgtttctgggaaggaaaagtaaacggcagcgaccagattcctgttggtgtttttgctccatattttgattggggaactgaatcatgtttttcctttcataaacacgaaaatgttaagtacataacagctaaattaatccatgcccataaattggttaattatgttaattctgagtcacagaattcagtctcgttagtgtttccattaagcagtttaggcctgtgagcattttaagagaacagtttaagctgtagattaatcttcaaaggttcccagcgcattttcaactgcaagaggattttaaatgcactggggggcttggggggatttggtgaatgttaggagctgctgctgtcagggagcgggtgttccccacttcctcgtccctcacctcccccaacacatccaaggcccctgcctgctagatctgagcatcgccaggctaagcaggagccataggaaggaggagatgggcaagaactggcatagccccttctgccctgtgtctccctggtggccatgccctcctcaggccgccctgctgcagacacccgcagagaatgggtgaggctagctctcgaatgctgtgggctgcatagccctgggttcctgagagggctgctgaggggctttcttcctgggtgtacataagaaagaagcagagagacaggaagagagcacgctgagtcttagaaacaagctcctgggtggcctttgttcatggcggcatgaacgtctccttttcgccgtccgtgtccccttcagaggtccgttcaggatatgggtttgctttcttggcacgtgcgcctcctctagggttccttgccgtacttgcgtgtggtgcagatgtacgggtgctccatctggctcagaagcctgctgtcctgtcctgcatcccaagctgccggctctcactggcttcctgtgtgtgcctgggccatgcacttctgttctccagccctcattccctagcggggagaccgtgaaagggtcagcctcgatgtcaaacctctagaccatggctaaggcttttccaggttttgtattgttctttgaagaatcaacaggacccgattatcaaagagagacctgtttaaatatgtacaatcattttcggtattatttaggtttggcaaggccagcagatgaggagaccactgccatgcattgaaaaggtggtttgttccagttcccaagaggatgcgtcccagtaccgtatgtggggccacacagagaagcagcgggttctgtcaggaggcaggagagaggggaagacacgggccagaggccttgtggtggtttctgtgggaaggagtgggtgaggcagagaaggcaagttcagaatcagctaggctgaataatttcagcagactcaggggaataggggctgtccctagctgcctgacacctggccttgggtggttaggttaagggagtagtgacctggtgtgtgagagcccatgatggaggtggctggggtgtagactctggattggttggcttgcatgtgaaaagcacactcctgatgggtagtttactatcccgagaccctgggtagcgcctgaaggaacagtctccccagggtcagcaagccccagatgtcaaagcatcagatactgaaaatacaagaggaaggggagaagatggatgataccaaagttatcccagacgcagtaccagggccagggcctcaacttagcttttcattaatcttctcaactgccttggcagataaatattgtagaaaacatgatttagagaggctgagactatggcccaaggtcatgcagagccgacattccgctccaggactctctgaccccagctgtcttccccctaccatgagctgctctgtatcttgccaggggccatacccttgccacaccacactgccagcctcccacgctggtcacggcccttctcttggaggtcgctggctgagagagctgcgcacctgtgtccgtgacacagctgtggagatgggacgccagacacatggaccacagactggggaaccagtctcagttatcacgggacctgacctgggacagacctcatctcctggatccagggctgcatgcaggacatgcccataaggagcgtcgctggctacagctgtgtttccactgtagaaggaggtggagtggctccatcagggcatcaggaacagaacaggaagcaggaagagatttggcttggtgatcccccgcgcgtccccacacacttcatgtcacgatggcgaacgtaggtctgccttgacaactcggcagaccacagctccctggagctcctagaacaaggctgtcctgtgggggcatagttagcaatttgaaagccgtgtctattgtcttaggtgataatgagggttgacagaaaccttttaggattgtagcatttctaagtaactgttgaaaccttacttggcccggaatggctgctcatagaacagaatgtgctatagttttactgaaaaaaacaaaacaaaaacaaaacataattctctgtggacttactaaaataaacccagggctaatgagcaaaatgtgttggggaggcctatttgtcacactcaggaagcgacagtctaattttatttgctcctgttcattgcttctgcattgccattcattcgctgaaggcaaaatacattacttctcaataaacaaaagtgggcccagcgtgtcccgctccctgccttcctccagccgttatccccccgggcaggagggctgacttgtattgatgtgcatgtgtgcgtgtgtgtgtgtgggtgtgtgggcttgtgggtgtgttcttcccattgctcttaatgttgagcttcctagaaagttttcaggggaaatgctgtgtctcgtgctgactggggccggctgcatgttgataggttcaccttgccttatacaaacctgctatttggaaagtcgagatataaattagaagcaggcggccgggtacggtggttcatacctgtaatcccagcactttgggaggccgaggtgggcagatcacttgaggtcaggggtttgagaccagcctggccagcatggcgaagccccatctctactaaaaatataaaaattagccaggcgtggtggtgtgtgcctgtaatcccagctactccagtggctgaggcaggagaatcgctcgaacctgggaggcgaggttgcagtgagctgagatcacgccactgcactccagcctgggcgacagagggagactctgtctgaaaaaaaaaattagaagcaggggaaatggaggaaagacaggtcactacggaaaaaaagtggctttgtttttttttttagcttcactaagtgagttgtaaaatcattcatttcatcaagttctcccagggcatttaaaatattattgggtttaggagattttataggaatgcacgtattatttaaagcaaggcaaactggtgtgattccttcctggatggagcttctgtgggcagctgcaattgtcagtggggggattggttcccatagcaccccgagttcttccctcaaacacaaaggcaccaggttctccaaagcaaccatcttccttccactcaacactcctcccgcctcacacccacagactcgtccttagagtggactgggcaggcgggttcattgtgccacgctgtgctctgaacccagcatgcccaaaagcagtccgttagcaagctgaccatggggagttcattgccatcaatgccatcaaaacaatttgcccaaatcaaatttatacctgacattttatagtaaatgggcctttcttttctcattagagaaatcattactgtttttcttctccttggcatttccagagagccattcacatttaaagctcatgttggaacagcaggcttctactgaaaatatttaccttttctttgttggcaacttgtcagtgttggggaaaatagatgcttcattaagatctaagcgcgtgatgcttgctttcccacacatcagtcagtctttttccaagatgaaaagcatggtgagaggtgttgggaaatcattctggtcatatgtttttatgtatttttggatgtcttctggcatcccgttcttcttgttcaaaaataggcatttcaacacctataacttgtagagagaatcctagaacaggatcagcttcaccacttagagcatcagaattggtcttgacccccgggtggccagtgaggtctcctgccctggagatccatggctgaaagtaagggcaaagagaaccctgctgccatttatccagcagttccggggccagggcctcaacttagcttttcgttaatcttcttaactgccccggtagataaaaattgtaagaaacatgatttagagaggttgagaccatggcccaaggtcatgtggaagcgagattacaccccaggactctctgaccccactctcttcccctaccgtgagctgctctgtatcttgccggcggccacgatcttgccagcctcttgcactgggcctggccctgacccttctcttggaggttcctggctgagagagctggacacttgggcccagtgtccctgacacagccatggagatgggatggcaggcacatggaccacagatttgggaaagaccccacttcatgtccacccgacccctcctctccacccagaaaggacaaaatacagtgagctgatgccacagcccatgtgagctgggcctagaggtggctctgccctgcctataaaagggggaaaggaacttacaatagatgccagcaaacccagaaacccagagaaggttggcccctgttacgactcctttgatcttcacagggaggtgagctcttgctctattaaaattaagaacctctgtttgtctagagctaccataaacacagtgagaagaccaggcatacactgggagaagatttttataacctgcattaccaacaaaggattaattctcagtacaagcaaaattaaacaatgtatcacttaagcatatatacaattgtattaaactagtagtatttaaaaagcaatggcctgcgaggtgggcggatcacctgaagtcaggagttcaagaccagcctggccaacgtggtgaaaccccgtttctactaaaaagcacaaaaattagccgtgtgtggtggcgggcgcctgtaatcccagctacttggttggctgaggcaggagaatcacttgaacccgggaggcggaggttgcagtgagccgaaatggcgccactgtcctccaacctgggcaacagagcgagacgccatctcaaaataaataaataaataaataaataaaggcaatggcatgaataatccaaaaattctgatcattttcctctgagaagctgggggtgacagggaggacacagaagtagaggcccccagtgggtcacgttcttgttcttgcattgggctgcagggttcatgggtatccgtttttttattaggctttataactaacgtgtatgtgacatacaatcttttgtgcttatcaagtcatgtgtttttagaaaacaaaaagaaaaaccaatcagttattgttactacctccatttttttttctctctctttttttttaattattattatactttaagttttagggtacatgtgcacaatgtgcaggttagttacatatgtgtacatgtgccatgctggtgtgctgcacccattaactggtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccagtttcatccatgtccctacaaaggacatgaactcatcattttttatggctgcatagtattccatggcgtatatgtgccacactttcttaatccagtctatcattgttggacatttgggttggttccaagtctttgctattgtgaatagtgccacaataaacatatgtgtgcgtgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatgatatctcattgtggttttgttttggatttctctgatgaccagtgatgatgagcattttttcatgtgtcttttggctgcataaatgtcttcttttgagaagtgtctgttcatatcctttgcccactttttgatggggttgtttgtttctttcttgtaaatttgtttgagttcattgtagattctggatactagccctttgtcagatgagtaggttgcgaaaattttctcccgttttgtaggttgcctgttcactctgatggtagtttcttttgctgtgcagaagctctttagtttaattagatcccatttgtcaattttgtcttttggtgccattgcttttggtgttttagacatgaagtccttgcccatgcctatgtcctgaatggtaatgcctaggttttcttctagggtttttctggttttaggtctaacgtttaagtctttaatccatcttgaattaacttttgtataaggtctaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtcgtatagtttgaagtcaggtagcgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgatactacctccatttttacagatgggaaaactgaggctcagtggggtcaaactagcagcaaacacacacgttgaatgcttactgtgtgccagaccctttacacggatcatccgatttcatttgtttgacatccctctacatatgataagtgtcatcattgcagtgtgcagaagactgaggctcagcgagacgggagaacttcagagtcactacctggtcacagttgatggtgaaggcaaggtcttcacctgtggcatgccccacgtccctcctgctggctccgaggctcactgtgagtgacagctccactctgtggacctccccttgggagcaggcgtcgaggcatctaagtccacttgccttgtgccatctcagtgcctggacactggtggctaccctgggccgtcctgcagccagctcgctgaggtaggaaagagaggaagggaaacaggtggagtgagaagagaagatagataacactgaagttacatttattcctactgctcatagtaggctttcaagctatgaagagatggctcttcccgtgacttcagccccatcctccatcgctgcccacgcccacgtggctgacactgccgaatgtctctagcactgttgttgaacttctgatgtctcctatgcctcaaccttgctattgccttggtgtaaatttctctgacattgattttgaatacaattccaggcttttggagcagaagtttccagttaagcttggtgtcccacctaagtgttaaggtcaacatgccgagccctagagtggtcctccctctcccaccaccaactatcctacctggcctcccaagaactgcctttggtgactcttgtattctctgtcttgcttcatgcctgggaaatttcagggcatatattaaggggaaaaccttagggaaacctgaaccttcaaaactgggtagaatgaatggatggaatggaagaatttactgcagcgaaatcatcttcaaattccttttaggttggaagcttcttaccctggcaagtgaagaagtacatttggttatatgtttataatccatgtgctactgggtgaaagatgataggacaagaacatttgaaatgtatgtgttagggatctctgcccagcagtttccatcaaaagagcacacccatgattatcgtacaaatggatgggacagcaggattctactcacgtaaaatgtttgtccctgagcacctagggagggtgtcacctccagggtctccttcctgttgctcttctgcatgagtcctgcaccacctcttttaacctcagggaaaacttcactattttgttttttaaagtcagtcatatttaaagttgctgcttttgagtatgcactacgtgttgatgtagattctggaatgtagaacaaacaggcgcagactagtatgggtaaggtggggaacccctacttcagaaggtgaaccccagaaggaagctgcctgggccaggggtgtgtgcatgatggcagggagctgcagccactaagccttggaagagtctttaatggcacagggaaatgccctgtataaagctcagtgggggaaaaaaaggatttagaaagaaagtatatgccagaggcaaagaaaaagactagaagaaaataaccagccaggtgcagtggtgtgcacctgtgatcctagctactcgggaggctgaggtgggatgattgcttgagcccaggtgtttgaggctgcagtgagctatgatctgtgtcactgcattccagcctgggtgacagagtgagaccccatctgtaaagcaaaaaaagaaaagaaaatagccaaaatattattggttatttctctttttcccaaagtttgggcaagagcatatactattcttacaatcagaagaagtcctcttttccattacgtcttaaatagctctaagatttagaattcgtcttgatgaaggcatggtcatcgcacacacagagctgggccccgtgggtgaggggctcccgggggcctctgagtggggagctgtgggtgtcaagtggccatgaagagagttgacccagggtcgggtggcaagattctctgagccccagagaagtcgactttctgtatctactagaatccaggaagagtgtgtccatggccgtcattaccccctgcttccccgtttcatgccaggtttttctcagatgccttctctgggggaggcactgttgctggggcaactttctggctgcagagggcacccagtaataaaggcaaatgccaagtatgaggcaagaagggacgcccctggctgggatggcaggcattgggagaggcttatgggagcccctcacccctctctttttggggtgctctcgaggaagctggactctccacctctaaagacccctccagggaacatagaacccaaacccaaatggagatgagctggccagcgaagtccaagaccccagtcccctccattgcaacctggggtgcgggcttctgtcttccaggttgaaagctcatcatttggttcatcataagttatacgtcggagtggaattataaaggagagagaaacagatgtgaactctcaacagctgggagaggtggaaagcctctggagttccattatagaaatgtgccttttggccaggagtggtggctcacgcctgtaagcccagcactttgggaggctgaggcaggtggatcacttgaggtcaggagttcgagaccagcctggccaacatggccaaaccctgtctctattaaaaataaaagttagccaggcatggtggtatgtgcctgtagtcccagctactcgggaggctgaggcaggagaatcacttgaacccgggaggtggagcttgcagtgagccgagattgcaccactgccctccagcctgggtgacagagtgagactctgtctcaaaataataataataaataataataataataataataggtcttgttttttaaaataaaaaacagaaatatgcatttttagataccagcaggacatcatagcactgagggaagctgaaccctctctttgggacgtagcttgctttcttttgttgccctggcctgagttctttcacatcagccagcatggagaagaggagccagttttgcagaatgactgggaacagcccctgctggggagggactctgtgatgcggtgtcctcatccgagcctcctgggcccgggttcccgtcgctgtgtgcccggagcctgggcgccgacaccgagcctcctctgtgctttcaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaaggtgtgagtaaccagggctacaggggagcgctctgggacaagggtgacagtaaacattttaacaagtatcagagtgacactggccacagccctgaaacaagacagggaagactctgctgtgacaggtgccagggccagtgtggaggagtcactcggggagtctgagaagtggctcttgaccggcgagagcagaagtgtttttgcctcgttccagaacagctgttccagtgacagccaggtggccactgctagcacgaccctctctgccttggagtttgcccatccctggctgaagggggtacacaggtgggtgacgggggtctaaggcagctcacctggcctgttacttggactctgcaggggcctcggcccacctgcccttagaaacacccagctgtggaactctgtgcattcatcgcggggtatgtgctcacccaggccccgctgcagcaggaagcagtggtcggggtgtcccccaccagcgcacagcccagcccactttgaacttctccaggggaacctcacaaggggctaagcagggcaaagatgcttctctgccgatgggccaaggggaggctggcaggctcctgcgaggccacccgccagccactctgtggtctttggttccggatccttgtgtgtcaggaaggctgaggaagggggaggaggtggctgcagatgagccagttcttacaaacagggtggcaaggcagatttctgggtgaggacagcttcttggagcaggcagacagagctgtggtcagcgtccaggaggccctgggtggccgaacaggtcccagcccaacgtacaatgtgtggtcagtgactgctgtagggagtggggaccaggggagttccagcaggaagtccaggcttctctgactcctcctgtgggggatgggagaatgggagggggtggcaggagtcaagcccattaaatttatatcgtttaaaatatttttacagttctcatcgtattataacccatgcatagtgattgcagtgtggctcataaacagctagtaagtcagtcggatagtaggaagagattatactgcaaacagcctctctctgtctctgtctgcccacccccgagtcctgccccacggaggaggaatctgttttcaaaccatgttcatgatttcctttctctaagtaatatcatttgatggctttcctgggtgcgttgagtttggtcaccatctgttaatttcctcttatcagaatgagcgtttttctctcaggagacccctagccctgctgccctgccgaaaccctggagtttcctccacttcttacctttcccgggcgtcaggcctacactgcatcctctgcctcctgccagctgcacctgcctgcacctcctccgaaggacttggtgtcactctgcaagtgtgaggcggaagcttcctcctctactgcccccaccccccaaccactcaggtcttgaatgcctgagaaaccaatgaccaaatacagggtatctacccacctgtccctccgagtttagtactcacccagacactaaatgtgagaaggaaaattaaggaagaggggcggtgtagacacacacacgcacgcacacagcatggggtcttgcgggcatccttgggacactggacagcttcctttatctccattcccccaagaaaacaccgaggcagcttcaatgaggctgctgagcacctaagccaggcccaaggctgggctgagtgagtgctggcacactcgggtatgaccaagtcagctgctgcccaccaagaactgccgaatacataaatcacccttccattacttagctcccagctccaacccactagatcgcttggatctcagtcttgatgacaagcgagacatcctaaaaattaagctgaatttaagcttcggagagggtgggtaagctggagggcgggtttcctgcatagaacatattgctttggatggtgttcctgctgagcgtctgtcatttctacgggatgatttccaaagatggagctcctaggatgaggcaccctccgtccaggaggggtcctggttgtttggcagtgatcgttcgggctctctggttcactgagcctatgggaggcttggggaggttggagctgcagagagggatctttgcattcggaattctgagcagtgttggtttcatccagctgtcaggggagtggggaagttgcagaggggaccacgtggtttcccctcattcttgtcacagttttgtgaaatactgaggtcatttgattttttttcgtcatttggaagtaaaatatgtcatacagagaaccttaaatcgcaactgtctcgatctgtcactgaaaatcctcctagaaatttgatgatctcaaaccaaaccacattcccccatctgcttttcctccttgtggccctatttgtcgcctacagtcttctgtaaaatctgactttatctttggtagatgatgtggcccggcggtgagagactgtagaagctgtaacttggcacaaagatctgtttaacgttggtccttaggaagcctggctcctctcacacctagttattcagaagggaccattagacattgctgtggctaaagacactggccgcgtccaggtggccggtgtttgctggccctcagtcgcggtgcttctgagctcatgaaatgaactctccctccccagggaagacatcgaaatacgatttgattgggttgaagttgtgagtttactgaaaagaagtgcaagttcatggctagggttgaaatgtcccctacagcttctgtcccatggcttccatgaagccactggaagatctgggaagtgaaaataaagtcgtcagagacagttaaaacatctctacactcctcagacctggctgtttcctcgcctcatttccatgtctccttcccagaaaccgttttaaggaggggaaaggttgttggtaccttgatgcctatgaggatgggttggtctcatagtaaatgcatgctacatgctgtaaatgcaaaccttgagcatttcaggctcttggtattcaaagtggggtccagagccagcagcactggcgtcccctgggagctcattagggatgcacactctcaggcccaccctggactttggggcacaagtctgcattgtaacaggttcccaggtgactccagggtgtgcacattcaagtttggggagcactgtttttggccattctctgctcctggagcagtaaggttgcatgctccaccttgcaaaaggacaacattttataagtcatttcaagtggggtggggagttaggagtggcagtgtctaggactaattctcacctggaataaggacaggctctgatgggttaaataccttttgatttgcattgtagttgctttaaaccggcttcagctgaatctcttcctgcaggtaatcacgtgcacacacacaccaccttcctgagctctttgtgcctttctctcagaaggttagcttttctgggagggacctttctgttgagctcttggccaccccgacaggttcaccttgcagatgcagaaagcagagtggacgcggcagccttaagcagcggggctgcgtgagctccaagaactttcctgtgggctttcttgggagcctcaagttggagctggagtctccttggtttacaaacccccgtggtgtgagcgtacagagcaggcgggtccactcattgtgctccaaaagtgagtgtgacatgtttggtcagcagcaggcttcaatttggctctacggggattgcagaattggtgtgtaagttatctttaaattggccgattgttgagcataagtataaatttcctctgtttgtttgggaaggacggtccttagtaaggatgtgatggccagccagtggctccagtttcccgtggaggtggatgctggcccttctctcgggccagctgtgcaccaccagcccatccagccatctggactatatccgtcagttcagtcttccactcgctaatctttagctggtacttgtggctggaatgattctcagtgtggtcagaaatcatccatcctgtgggtatgggatagagcggagctgcaggaatctgccctgactggctgctgtctttcaaagacttgctttcatgtgtacgttcttaacaatgaacaccggtgcacagctgggcatggcggcacacttctataggcacagctactctgaaggctaaggcaggaggatcacctgagcccgggagttccagaccagcctgggtaacgtagcaagacccctgtctcaaaaaaaaaaaaacaaaaaacaaaaaaacggaaagaaaacctacacacaaatgaggccctggccttggctagtgatataaatcagaccaccctgatacttacccactgcagagaccacagggagctctgacaggacacccacaagctgctaccagcttcctggacgtaaccctttccacctattctgtcttcacgcagagttcatggtcctatccctctttgcaaatttagctctctctgcaagaagggtacctcttcaagtatgttttccagaaaaatcattcttttccccaccagaccagctctttcaacccagaaaaattaaagttgtaaattcttccatcatctgtaatctcagtgtcatttgcagcactgctagctctctttgatcctaggccattgcgatggaaatgacaggcatggctctggaatagagcagcttgtgttgggacccttgattttcctgtgaagaacagaggagtctttctggccccttcccctcgtatgatcctgtgattctgcaattttaaggctgctgctacaggcaaaggcacaccattaaaatccaaacagagcccccaaaaccatgctctcagcagcatccagatggtctgaatgcaaccttcttatccctttgaaggaacatttgggagatgggactctaggttcggggggagacccaccctacgaggttctgctgcggggctaagccttgttcctcttgtccctccagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtaagttctcttggcaagttggagtgcttacagtgagtgcctcagccctctgggaatgagtttcttctccctttctcagaaagatggcttagattgaggccagattgttccggatcccagggtcccagcctcacccatcggcgaacaatttgagcctggaggtaaaccccagtcccttggcagccttcctcggacactggctttctaatctttgcacagaaatagcagttaaacccctctctggctttagagatctaaaaatattatttaagaacgaggttccttctcatgatgtcttgttttaactctgaaattctgtggtcacatgtcttggaatccaatgaacccatccagttccagcgtgtacaacagagtaagagaaagacttggttttatactgagacattctagaaatccaggagttcttctaggcattctgttgctacagaagcactttttctggacactttaagtcgagcagtggtttctgtctgttccgcttacttaagtgaacataagcatgatttgtcttttaaaaggtaactgttttagtactcaggtagaatttgtgctttttccttccctacatactttcctacttaaaaaaaaaaaaaaaaagaggaagggagggtttccagttcaaattaatgcagaattgaagtgcaaagtcattacgttgacttgtagacattttaaaaatgagactgtggagctggccagacatggttaaattttaaagctcactagcatcttttcatttctgcggctgctcagccacatctttcgaagttatttgcaaatttatttttacacttttctgtgggagcatacaggcttcctgttctcggctttgctccgcaccagtgaaaggtcagctgccatcgttctgtcgccagcctggtagcagctcggcctggttaactaaggtattaatttgttattttccttttctgctggagtacgcacccctgggacgggcagctgagatgctgaatggtgtcctgtttatgtagaaatccagctcatttgagcacggacctgctagggtcttattagacagacagttggccaaaacccaacatagtcttgctggccgaatggatgcaggttcgaatttgctaagttatgggacagtttataacatggactgcgtgcaggcaggatggtgtctctcaaccctggaagtaggacttgcagctttatttgcattacgaatcacgtcagcgtgtgatctgtatgccatgcatgtgtgcgtgccttggctataaaatgctttttctttcttattttaaaattctcttccctgagcaataatatgtgggtaagaagggtatagtttggagaacggtaaaagagaaaatatactttgtcttggtcactgcccgggaagtctgctctgacaggaggggtgttattttcagctctactagagtccagcttttgttctgagtcctcttagacgtcctccagggagacgagtgctgctcaggatagtcgacatatcacagtcccagcattcaggcaggcctgtgatggcgatcacaaccctgtccgcctgcattctctgtccctctgagtctgaggaatgtgagcaggtgtgtccacctggagcgagggatgtcctgtggtgacacatgactctttatagaggagtaaaacctaaagaaagcatctctcaccagaacaagagggtatgttcgttcactgaacacgagctgtgtcccaggcgtggcactaggactcaggaggggctgtccaccttgattcagccatccctcccagggtaggcccctctgctcgctccccaggacccccttctctgaagctggagaaccagctgtgagcctcacatgctcttgggagcgtggcctcctgcccagccacccctagtttctcctcctggccaccatttaccaagcccaagtacattcaggtgcctggctgtgatctgccgagaacccctgaaatctatatcatggtgtccatttgcatatgaagatgctggagtcagagagggagcatttttgtcccttttcccatgccctcagctgccctccccatgttgaggtaccccagccccactgaaacgaacaaggaggaaactggtctctgttggccttcccgtcacatcttcctgtgtgtgacacagaccagacccccaccttccctagacagttggcccagctcaaacgtgtgcaaggaaggtgctgagttcggaagaggatctggattgctctcactgtgaaattgattctcaaaggttaggcaaatcggctactggagtcctgtggtgggtgggtgggtgtgactttcctattcctgccataacaaattatcacaaacttagcagcttaaaacagcacaaattgatatctcatggtcctgtaggccagaagtccaggagcctcagccgagtctctgctttgagtctcacgaggccaagaccaaggtgctggcagggccgtggttccttccggaggctcccgggagaatctgtttccttgcccactcgggctgttggcaaaactcaggtccctgtggttctgggactgagtttcccatttccttgtgggctgtcagctggggcccgttctcagcctttggaggccacccacattcattggcttactcctcagctccctcttcaatgccagcagcggtgggtccagtccttctaatgcttcctctctcaaacagccttgctgccttcctcttccaaggtggagggccctgtggtggcagcaggtctactcagataatccaggataatcttcctggtttaaggtcggctggctaccaaccttaactctatctgcaaagctcattggaataacaccaggggacaaagatgatggggcgacaatcccacctagcacacctgaacccacacaggctgaacccccagcacccacttcccgtttgagtccaacgggagatacacgtcagcctgagtggtagtgaggtccagaatccatcccacacccagcctgggccagtgcctccgaggagggcaggcagagcccccagctagcggtacctgccttgttgccctgtgcagtaggccttgggcggtcaagaacatgccaggttgatctgcttcttcaggaggacgtcctggtggagaacccagcttatgacctactggctaaaggcagaaactctctctgagccacctgggtatctctagctgctctgaagtcagggggtgacttaggggtagctagtgtggactctgatggttttgccgtgggtactctcggctgttggtgacaggccacaaagtccggcagacccagggatgagggcttgtggggtgcgtcttggtttcatgttgttttaccattttttccacatgcgcttctgcagtagagagggaaccagctgatctattattatcaaagcgtacggtctgtgctcccagctggccttcttgcccctgcctgtcttcctacaaagtgatttagcagggagcaccagatgttgtggaaacctgtggttgccgagatgcatttgcctaacaccttatttgttcccgagacccagggtcacgcttgccagttagtggcacctgaagtagcccagccttctccacagagtgagttagcctgtctgccatcactgcctcactgtgcttctctctcccccaggtcaccacggatctgcgtcagcgctgtaccgatggccacactgggacctcagtctctgcccccatggtggcgggcatcatcgccttggctctagaagcaaagtaagttcccacttacctttttctaaaaaaaaaaaatgtttagattgtggtaaaatacacatgacattggccattttcaccctattgaagtggacagctcagcggcattaagcacattcagtgagtcgtgcacctgcaccaccatccctctcccagagcttcgtcttcttcccaggctggaaccctctgcccgttaaacagcagctgcccaggttagtcagctcaggctgccgtaacagagtcccacggactgggcagctcaaacaacagaaatttagtttctcaaagttctggagcctggaattcctggatcaaggtgtcagcagggttggtgtcttcttggcttgcagaaagctgacttctccccttctgctgtgtcctctttttataaggacactggtcatattggattagggcccaccctaataatctcattttatgttaattacctttttaaaggccttatctccaaatataatcatattctgaggtactggggcctaagacttcgatgaatacattttggaggggacatagttcagcctataacactccccattgaccccccgccctagcctctggcaaccaccattctactttctgtctctatgaatttcattgctttaggtgcctcatgtaagtggaatcacacaggatttgtccttttgtgcctggcttatttcacttcacataacgtctttaaggttcacccgtttgtagaacgtatcaaaatttccttcctttttttaggccatcctgatgggcgtgaagtggtttcttcctttcttaaagcccaagtctcctgccctttgtaggacacaggggctggctgggccagagtccaaggcctgcctctgattctgcacctcacagcaaatccacactttaggttgcgctggcttccttttaggaactttcatttataaattaacagtcaagaaatctcttgagttgcgtatgtgttgttggttcagaaagaaaagcaagttaaccgcacatggagtcatagagtcaaaaccaaattgtactttagtcaccaaaactggcagagaacaaaccagccctctgcagtagtcatctgttgtagatgagttttcaaataactcaaaaagaatggttgggatgcctcaatgcttgtaattacgtgtgtttgcatgtggatttgcacaagacaaactgagcgtaacactcaaatgctaccaatgtaacaaaggaacagtttgatatttttgatttccaggccaaaatgttagcttctgtgtcctgaggctctttttaaaaattcttcataatgagttgcttgtgtggaaactcacattcgcatactttacccttccttgcgctgtattttcctccattccttattggaaacatgcaaagagctaaatggaaaacaaaccctgctccggggcgcattgtccccttaaacttggtcagtgggcatgtgaaagctcagacggtcatcttcctcatcatgttagctcctcctcagacacatacaggggacggatcaggcaaacatcatttggaacaatgtcagtctagagcgctcgacacttacaggattggtcaaggaaggaacggttgatgtctgggaatttgaaaacctgtgttgagcagacctgtagcctgggatagctctcgcctgtgcaggttggccccaggccgccttctctctctgttcactactgctgtggaaggaactggggcaaagccagatggttctgggtggagatgctccctgagagtctggggagggcccccagacagcgtggggccagaatgaaggaaaacccatacgtgttggaattctctaaagggagtcccatggttttgggacagtcttggtacttttcaaacatccgttcttcatcaaaaaacattttcaacatcctctcttagacatattttccatgcggttatatttgtgattttattgctagagtcaaaaataaaatagattttttcataagaaaatggttcctaactttctcactccctggacccattctgtcctccactccaaaggtcatcccggcacctaaattcaagatttccaggaggactggctgtagccgtcttcgagtacgccctgctgacacacagcagtaacttgccaggttgcacgggcagcatggggtgtggccatgtcagcacttgtctaaactccaaagcctgcacctgtgacctctctaccagggtgcacggccatgggctactcgaggcctcagaatctcccctaacagtgaggttggcgtgtgggccgcaggaaggccagtggatgcaggaggagaacaggtgtgcctggcagggaaagtcctggagactgagccactggacacggacggggagagacggtgaggaagccagtgaccagccaggagcagcaagaacacattggagaagtcaggggaggccagggctggagcctggagagtgtgagcccagggaaggagtatacccaagacttaacgccatgggtgagcttctcgtaggaaaacaggcaaagagggggccgagggtgggagtgtgcagagcagccgccatacaaaacagtgtagcgcgtccttgaaaaaattaaacagactccccagacgatcagcaatcccacttgtgggtgatatccaggattgaaagcagggactcgggtagataccggcccagccatgttcatggcagcatggttcacaacagctgaacggcgggagcaacccgagtgtccatgatggacgaagagatcagcgaagtgtgctctgtacacacgtggaacattcagccttgaaaggaaggagattcggatacagattatgatgaggtccctcaaggacgttgtgctaagggaaataagacaaatcctgtgtggttccacttacacgaagacctggagccatcaaactcatagagacagaaagtagcgtggtgcctgccaggggctgcagaaggagcgatggggactgagtgtcccgtgggacagagtttcagtctggaggtggtgaaaagttctggaggtgggtgtggcggtaccagagcaatgtgaacgtccttaatgctactgagctgtacctttacaaatggttgaaatgggaaagtttgtgttctgtacgtcttcgcacacccacacacagagtgggccactggagagacgcctgtgacatcccagcaggtgccactggggaggccggggcagctgggtacttcagctctctctcttctgcgtctccaggccccctcagctgcagcagctcccccgattttacttagtccgtgttcctagggtcacattccctgaggcagcacctgtggcgcggcgtgcgttcctagtaaacacgcaccgagagcacggtgtgcgttcctagtaaacgtgcaccgagacaaggctggggcttgtgcttctggtcacctgcatcccaacgagccctgggaagatggtctggaaggaaagagtatgtgtttgtgatattagggagtgagagtcttggactcgagagatgttcgtttattcttggttaattttctgattgaatagaaagtcctaggtaggcatcaatttaaccgactaaaaaaggaataaaagatctataaatatttatctgtcaaatggcggccggaaccatgagcccatacatctttcttttcactcagctgtttgatagggcaaaaatatattcctttcattactgattcacatgtaggtgttatctttaccatgttttaaagcagccttgcagaaagcttgtatgttcaaatatccaggttgcatagcatttaatactgattagaagaaaggaacaatgctcttattttatactattctctgtgtacagatagtatgaaaaatactatatttcatcgaatccaagatgccataaagttgtaagatgcacctttttatgtaccacagaaaccagaagtgctgccattatacaatgcatccatatctcttagaatttttgtaactattgaagagttcttttaggctgagagttatttagacctggaaatgacactgtgaatagacaggaccaagttcagcacctccaggcaatgtaacccgttcctggttgctgtgggcagaggggcttataagaggtatcagatcataagatggatctggatttcagaggtgttaaaaaaaagaaaaaggtgggccaggtgtggtggctcacacctgtaatcctaacactttgggaagccaatgcaggaggattgcttgaacccaggaattcaagaccagcctgggcaatatagcaagacctcgtctctacaaaaaatgtaaaaaattagccgggtgtggtggtgcacacctgtagtcttagccacttgggaggctgaggtaggaagactgcttgagcccaggaggtcggggttgcagtgagccaagatcacaccaccgcactccagcctgggcaacagggcgagaccctgtcttacacacaaaaagcaggggtgagcaaatgtgtcttagaaattttaaaaaatcatctgtgtatttagttacattagtggcatgttgtattcttttgatgaaatgtttctacttccccaaaaagaatattttgcaaatttagaatcatatataaaatcttgaattataatctacagccagtgggtccacacaggatggaatctcggccaatcgtggtttgaatgtactcttatgcactgttgtatttgcttaggatgaagaataaccccaagtatttaataaacatttactattatgttaagtgtcttgtattttcagaatttcccatatggctctgggcaaactcaggcagagcttggcagcaaggctaggctttaatgcttatgaattttgggtcacccattgaacctttttttccctcaggatttagttgccggaaacttgtttacaaagaggtggtgaaataaacccttgccaaggaatgcagtccttagcctgaggggcttgctgaagttcagacgtgggttggctgccgaccccctgcctctgagtggcctgtgtggctgccgttgttgagctgtgtggactctagggtgtgttgtgtcattgcagcagccagttaacctggagggacgtccagcacctgctagtgaagacatcccggccggcccacctgaaagcgagcgactggaaagtgaacggcgcgggtcataaaggtgcggcagtggcgttctggtggaccattgggtggccctggaatgtgtaggaaggggtgtcatgaattccttaaaaggactctccaaatagcattagttgttattattaattgtgtgtcacaagaatttaaaacgcatgtgcagctatttaagaaaagtatcccggaagctcacagtgacattacggaagaaccctcaggtcacaagagtctggggtctcctatactctataactttggccacaccgagacaccacctataccaatatttactcatagttctctttaagccaggagcaatgacgtgtgcctatagtcgcagctactagggaagttgaggcaggaggattgcttgagcccaggaatttgagtctagcctggacaacacagcaggactccatctcttaaaaaaaaaattacttcccccactacttttttttgacataaaaaaatgtattttaaaaggaaactgtactacatctagttaatcataggtttgatatgtagttacgtattttttctaatgtgcattaaaacaaatccataattattaaaataaatgttgtttgtgtgccacctgagggcagcttgcatccttagccctgagtagctctgtgattttgaaacttgccttcagtttcctcatctgtacaatgaggacattgagatagttttgtaagttactttctaactgtaaaacttcttttggccagtccctgtgttataaaagtaaatcataggacagtggggcctctaccctcagcccagcctggtacagacctaggtaccatgaaatcaacccagggtcagggcttcgttaggctggctgttggcggcctttgaagcaggtaattttaggacagtgctactggctttgtttgcctgacttctttttttttttttttttttttttgagacagagtctcgtcttgttgcccaagctggagtgcaatggcacgatctcggctcactgcaacctttgcctcctgcgttcaaacgattttccttcaaataatccctcccgagtagctgggattacaggtgcctgctaccacgcccagctaatttttgtatttttagtggagacggggtttcaccgtgttgcccaggctggtctcgaactcctgaccttgtgatccacctgccttggcctcccaaagtgctgggattacaggtgtgagccactgtgcccgacctgtttgcctgacttcttatcaggtatactgaaaaatatttcatttggccgtagtatttatgttagggaggaatttttttttaaccttttctgaagctcaggtctaactaatttgacactaagtctgatactactatctgtaaaatataggtcaagcatagttaccctaagtgccgagggacattccttttaataaggaggccatcgattgggctagttcatctttgttttgcaggaatgtcggtggtagtggtgtactgtaacaagagctgacccacattttaattctggcctaattaaataggagaatagattgtatgcagttcttgaccttgcctcttaaattaaactttgaaagtctcctgccctggccaaattaaatactggaccgggccagttcgcaagcctgtctctgtgctgtgctgttttcccggaatgctctgggaactcagcagggaaagaaaatggcaaaaaagatgagtacagccttgtgttattgcatttcgggcacgtggtaattgtgtgaactgagaggtctcagattttgtttctcttgtctggtcttagattcagggagcatagatgctgacaagcccttttaatgtaaaggaacctgtctttgtctcaaaaaaagaaactcctagaccttctcagcacttctactctgtaccaaagcgggacgtgtttcctgacccacactcctaaatttagcagaaggagttgggttcagagagagtgaggcagctgggacctttgagcagccctcagggggacccgtcctgcagcctggggcccccaggagacctcgagtcttacggtccctctgtcctccatggggcccggcagatgcaagagccagccttgctcccttcctgggagaggcaggagagcctggctctgaagggcctgtcttttcagttagccatttctatggatttggtttggtggacgcagaagctctcgttgtggaggcaaagaagtggacagcagtgccatcgcagcacatgtgtgtggccgcctcggacaagagacccaggtaaggctctgctgtggcatcggtgacttctcaggcacgtgggtttggagctgactctgttgtaaggtgtggctgggggaggtgttcacacatgcattctgtgcacatgtgcgtgtgcacgatgcatgcctgcacacgtctgcgttttctcttgtggattgtacagctgggaaaggaatcacttcttaagccaccactgttttgaggcctcttccccttttgtagcagattgctccacgataggggatcagttcctcagcctgaaccactcagcctagtattggaaattcttacccgtgtttagcatgtcagcccaagtcaggaatctgctcctcccagaaagtgaaatggggagtagctgcaggtgtcctttctgtcaccaccggctagagattggagctgtagccccagcccagcctaactggccctgggagtctgcagtgtgaatccaccaggcctgagcaggagcagctgggtcagcctcttctctgttgcaggttgtggggtactgcttattattcacagagcatagcagctttgtgtggcttttatctggctccgtacaaccttcttaaggcttaagcgctgggatttttttaacaaggctcgagcagaagggccctggcttcatctctctcccgtgagcagggcacacccggaactgctctttggagtaagtgtttctaaatctgttatatttgttcattgattgattgattgattgattgagaccgagttttgctcttgttgcccaggctggagtgcagtggcatgatcccggctcactgcaacctctgcctcctgagttcaagccatcttcctgcctcagcctcccgagtagctgggattataggcacccaccaccatgcccagctagtttttttgtatttttagtagagatggggtttcaccatcttggccaggctggtctcaaactcttgacctcaggtgatccacccgccttggcctcccaaagtgcttggattacagatgtgagctaccgtgcctggccaaaatttttatttaaaaaaaaaaaagcagccataaagtaaatcagaaagcaagaaccctagcccactaggagaggaaatcagattattccaattctgccatcgcagctgtttttaaggagaacggtgtttctctgggccttgtatctgatacagaacggagtgtgtttttcccataactacttgttccctttggaaaacgtgtttgaaaaagaaacagtgtgatgactgaaagtgatatatttctttatcaacaaatacaggtcactctctttagatgctcttccttgaatatgcctctactcttgtaatacactcttgccacaaatagttgagaaaaatgtgtctggtggagggctcgcatatggtaggagtgcagagagtgtgtgttggctgagcagctggatgaatagccacagaaggatcttttgaaaaatcacctttttctcccgtggctaattgcacactgaccgctgagtggtcactgcaggccccgacaggtcggccagacacctgacaagcctcagtcttgacttcttaaggcgtcggtttctctgaggagccttagactgtcaaatttgaaacaacgtgggagagtctctgagataaaggaggttttgccttctctgtctttgctggaaaacgcctgcagcctggaccctcagaggctaggtgagggaggtgggctcctgggtctggttcctgacctgggggctgccctctgccccggcgcctccgctcgtgtccccgtcagggcggctcctgaatgaagcattcttctcctgccagaaatcgttttaagatggcagagtggtgcctaggtggcgagtggttgtttttatttttattttattttgttttttaagtgaaagcacacggagtctagacagcacaggttgagggagcccgccgtcacatacagtgtaacattgttcctgtcctttgaggaaagtaaggaccctccaaactccaagaggagaagaatcagacttctgtttctgaagaaaagtcatctttacctttagcagtttcagactctttctgggatattcagccagcctaccgtctcacaccacttgcttatcagatcacttgcttaactctgtaacgtggttgttgcagaggacatacgggcctccagagagaggggtgttaccaagcagagttccatgcctcacgtccacctgtgggtctcccctcctggcagggagctccagccagctctgccactgagcctgcctgcaggtcggggtcatctgcacctgagccgcgagtatccccacagctatgcgagttttccccatcggggttcccagctgctaggatcacgtggccgaaaatgaaaaggaagcgttcccacacagccattttcccgtcttcttctaactgccccctctccgtgcacgtttgtgggtccagctgtctactctcttggcctcattctgatttcttcctctcatggtggaatcctaggacttcctgaatgtcctgaacctgccctaagctgcttcccatggtgaagagcagagcaagagggaagacagagtgtgtgtatgcctctttatacacccctctcgtgtgcatccgtgtgcactgcgtgggatatggtgactgtcttttctcttgaacaggagaggatgctaccctggtgtgaccaaaggtcagacagctgtgttcactggatgttaagcacgggagtcctctagctggggcatgtgtccacacctgtcaggtctatggtgacgtcacacatggtcctgagggagaggggctggggtgttcatacgtccacccctctggtcacgggcaggggcaggaaacctctgtctacccccagccgtgggctggaatatggccatggttcagggagactgtcctcatggcggtgactgacaggaagagtcaaatgggctaccccttctgcatgtccctcctgtgcacccagcctgtgctcccaaactagcattgcatccagggccccgaatgactgcacagagctggtgccccgtcacccatggtgtccccctgcggagctgctgtctccaacgctgccccagtggctggcatcacagccccgcctgcccgagtcatgctcaggcccaaaggcgcggaaaggccaccagcacagcacaatgcgggctgcagaggaaggagctggggcggtgatgccagacccaccagacacagtccccttcaggaggcagctccgtcatttgaaaaaaggccatccatggtgtgaaaaggactagccaagaggggaccccaagtgatacgttggcatttctcacctggacactgcacatctggggactggggggtttgagcctgtctgtgtatggatccacccgaaagataagaagaagtccctggaagggtagagaacatcagggaagaggggacctcaggtagggctgggcctgggtgagaatcaaggagccaggccccctgctccaaggtaccacgggatcgtgctgggcagtctctttactgcctggtgtttaccctgccctagagcagtctgagccccagaactgaggtattgatgtctgagccacctctccaggagcccacacggggtagggcccatcataggctttcaggaaatgctaaagctaaatgcagaggcgagaggaaatcacttaaactgaatggcagctgctgttagcaaaagagagtgacttgctagagtcctccaggatagcactggatgaaagtgccagctgtgcctgggcctctgttgtgatcgtcagaccgtagaccagaggcacgtcgacctactcctgggcacaaatggtttccatctgtttagaacctttgtcaattaaacgaaggtacataggatcatgaccaggggcatctgcctgtgcaaaatgattttaaaatctgtgtgtattaaatagaaagataaagttgatatttttatatcttttcttcaaatgaaaaagaaaattaagcttagtattattccaacgaatgaaatagaggcccagctattaaatattctatttgactcttgatttttctagccagtgcttctgtcgctgctttgaaaatccaggcttctgggaaacagtgtatgatatgcatgactcccacctcagtgctggggacactcacaacaacagggtcttttaaaccaacacaaagcgataacttacctgcacgtctttagtttctgctggtttggaaggttactgtccagacagagcttacagtttagcttggcctgtcttttaatgaactcttcacacacccacaacccacacaagacacttcagacccaaaagccaatgtgttgctttgactatcaaggcttatctgtagagcagataatctttttatagatgttcaggaattaactctggattagccgcatatcacctgcttttctggaatttcgtgaaactagactgcgtatggcggtcattttaaaacaactctatttatgaagacatatggctgtggatgagagataatggattgtgattataaaggcacttactgtgtgccaggcattgctctaagcactttatataaaaatccccaataaacatgtgaggttggagttctatctttatcctcattttatggaggaagaaatggaggcagaaaggagttaggaacttaggcccagaggtggggtgctgtggggctgagctgctcccgcaggctgcttgtctccagagtccaccttgcccccctaggtaggagctcaggcggtactgagccaatgagagcgacctgcccacccgttagaagacctcacctctgtgacctctgtgccaggagctagctgggcgcaccacctccagggatgataaagtacctgaccctggctgcccagagcttcctccggccttggccaggtgccagtgcctaagagcacagctgctggcgtctcatctgcggcaggtcagctgggcaagctggtgaggccaggagcccagcggcctggtggagtgccgtgcggatcagacacaggtcaacccagctctactgtgctcaagcacacagcctgatgtgacgtctttttaggaagccaagagccctcgttttctttgggctgtctcagaactatgcaggtgtctgccaccctcccatcccctcctcaccttacccagcctctccctccagggcatctgacctctgtgtatacctgggtaccacaggaggcccttacttctggtttctcctcttgggctgttgttatacagagcatgcctgggtgtcctcagaagatctgtggggtgctgtgcagtcccgccctgggggtaaccacagtggacccacaacacttttcctgcctgctgctaccccttgtagctgcgagcaaacttaaccagctggttatgttcttgcaaccctttcccttcctggcttagttttgaagcaaacttcttttccccaaattgtaaaggctacttatttctaaaattaggatttggaatttgaatacagttgattctccctatttgtggtactgttccacaaagtcaccacgaacactgaagcgttattcctaggagagatacagggttaagttcctgtgagcctccggtcacatttttgccagcctgtccatatagaccgagctttatgtgtatgggtttaaagacagcttatttaacatagatcattggttcattcactttagactcacagcggacagcactagtgctcgttgctggaaccaagcttgtcttacccgtgtgttttctccttaaggcaggtctctgctttctcatgctgtttgacactagacagtgtttcagcactgcacttggggccatttcaaacagtgaattcaccaacagaaaagcacagagccaggcatggtggtttgcacctacagtcctagctactcgggaggctgaggtgggaggatcgcttgagcccaggaggtcaaggctccagtgagctaggattgcaccactgcaccccagcctgggtgacagagtgagaccctgtctctaaaaaacaaaaaacagcacaaaaatgtgaaaaatgtggcactaaatacactgtgaaacagacacttgtttttatttgagatggagtctcactctgttacccaggctggagtgcagtggcgcgatctcggctcactgcaacctccacctcccaggttcaagcagtggtcttgcctcagcctcctgagtagttgggatgataggcacatgccatcacacctggctaattttgtatttttagtagagacgggctttcaccatgttggccaggctggtctcgaactcctgacctcaagtgattcacccacctcagcctctcaaagtgctgggattgcagccgtgagccaccacacctggccagaaatggacacttatttatggcatgagagctgcaccaacaggcggtgttgccttgtttgacctcagctgggagtgtgctcgttgggggactcattatgttaccactctgcacacatctacacatgacaccaaagtgccgcaggtgttagtttgggggatacaaataaatgtcagccaccaggtgaatatgcagatacagcatatgtgaataatgaggattgactgtatattttattttctcttttactccccttcaggttgaattgtagactgttagaattggaaggcatctttaaagccagctaattcagtcccctcatttaacgtacaggaaaaagtgtgctataaatttaagcatgacatattaaagcaccttctgacccaattaactgtggacggcattgtgtaagttaatgtactggattagctttttttttgaggttaaattttatttctcacctaagtgatgtgctatggtttgatcatcaaaagtaattttggccgggcgccgtggctcacgcctgtaatctcaacagtttgggaggccgaggcgggcggatcgcctgaggtcaggagtttgagaccagcgtggccaacatggggaaaccccatctctactaaaaatacaaacattggccgggcatggtggcgcatgcctgtagtcccagctactcaggagtctgaggcgggagaattgcttgaacccgggaggcagaggttaccgtaagctgagatagcaccactgcactccagcctgcggacagagtgagactccatctcaaaaaaaaaaaaaaagtaatttcatgtgaggaaaattctcagtctgaactcatatgaataaggaagcccacagatgaatgaagcagcttacctcagagcctaacgacagtcttgttgagagcgtgcatcctggaacacaggtctgagaagtgacctagaagcctcttgccaccttcacacgggcactgtgtgccctccgacctgctgttttcctattgcttaatttagcaagtctgtcccaattaactcttgccattccattcactcccgttagcgggtctgtgaaagggtttcctggatgaccttctgctgtaatgggcctcagttctttagcctctcctccccaagccaggtgccagcacagcagctggcaggatgctgctggctcctgattctggagggtctctcaacatggccctagaacattcatgggcccagtgaggaacaaagcaagtgcgttgtgcaaggatccaggttggtccaggaagccaacctggggagagggcttcaaggagggagtgagaaatactgacatggagtagcttcccaggtagaacaggaaaagtggagagcttgaggcggagggtttcagcctgtggcccgtcttcctgcttcccctggcactcggttacttgaaaatatttatttttgctattagatagtattatgcattggaaaaaaaaataggaggaggccaacatatctgtggtctggagttcctagggagtcagcagggtggctactgttggtgggccttcgcctcctcaggagaagggagcgggtggagagcatttgggatgaatggagaacatctgaagtaccagagtaattaacgttgaaatgtggctgcgtggcacgtggcatttgctgtcattagagatcttttccaagtctggccgtctccctggcttcaacaacgcacggtctccaggcaggttttgcgggatcatttaactccgtggactcccttagcgtcctcggaagatggctttatgtacatagaccacagtttcagaagttaatagcagaagacacttttcagttactttggggactttaagatctttctaaatcagttttcatcattaaagtacaatgtaggtgtattcacgtgacagtgataatctctgcacattgtttaacttgaaagataaattacttggcagtcgacttgcattttcagcgttaccttagaaataactgtagggtggagaaccacttctgtttttttcattgactgttctactttctgtcttggagttaattttttaaagtgatgacttttgatagatggcttccttattttcttcctggagtttctatctgaaatacagaaaaatttgagcacaatgatcatgaaacattttgaagcctcctcttttatttctcttcttaataaaagcactctaattggggatgttaggttaatggtttcaatagcaaccacagaagtaaaatgtgtggggagctaactgcatgtcaggaaggtggcagcgtgccctcctatagtagctgtcctgggctcccgcgctgccccagaacttacaggaatgaggagtcctggtggcctgtaactgagtgatttagcagttaagagctttcacataaaaactaattgttacagttagccttgttccaggaggctgctgggctcctagcccccaggtgaaggtaagggcatggctttgaaaaccaaacgaagtgaggccattaactcctgcaggagctgggtgctcccgcccccagccagcctccctgcaggcagcagcagcggggctggcggaggatcacacccaacccagccttctttatgcagcggctggagtcccttagcaggaataaaaaagtcagatgcaagagactttcatactctgaaatgattttttttttctaggtgttcgctctgtgggtggggctcagagtggcggggcaggtgagaggtggggcttggttgtctttcacttgtaattaccctgctcccgttctctcatccctgtgccttatcaatgggattaaagcttcttcacaaggattccaggtctatttctagagcagattgatcacttcccctaccgatgagcaattggttggagtgtggggaccgtgtcttcaacttggttaaggcttttgtgtctgtttccccttgatcttgctattcagcactggaaaggtgttgaagtgtgagagtgtagggttattcctggtttttggggttgactgggagctacattttgaagccccaggggagcactgagtaagtctgccggcatagacgtttctccgtctccacaccttgcttctccctaacgtacccaccttacattcttagtgtggggtgaaggtgggggatgggggacactcacctggagagacacatgggccctgcaggtcctggaactccccagagccttctcttgtgttcgccatctaccgcagcgggggctgctggccagtaaacactagcagtaaagcttgggagaaggcaatgaaggaagtcagcatctctagatcaatttatggtgcatgcaaagcgtgttttcaaatacttacagagtctccgagggaattacatcactgtttataactgttttgattgttttttatgactcagggcccagtagagccaagcagtgtaactcctgagaggctctgagcagaacgcctcatgcctcccgggaggagagtccaggcataatgggaaaagcgctccccgtaataagccaagcaccggtcgtgtggtggggagttattaatgtgctgctgggcggcggtgggtctgcactgaagaatgccatgtttcttcagctgcagatcactggggtgggtcgggggctgagttcaaagaggcatgaaccctaatggcctggaattggcaggatggtccagcctggacacagaaacagccttggggtacagattttggatctgcttggtctggggagtctgcttggtctggggagtgtgtcagaaaattctagcaggaaggagtcttgaatgattgaggctttgtttttaccctcagactccatcccatatggtaaagctgccctgagtttgtaaagggaaccatcgtccatttccatgacagggcaggaaagtgaggggaccctgctttctgcaggagatttgggagcacacaagcttggcaccctcgatcagcatgagagggcagcctccgaactccgagctgtgtccttgactgtgggtccacgcgagcttccattcgaggcagcgaggcctggaggcggaggcagtgaggcctggaggcagaggcgtgggctctggggccccaaatcccagctcctccccgcattagctacaccttgggtacagtccttaatttccctctggattaaatgggttaatccttggaaattctcaggccagtgccttatgctcagtgcacagtcagcttgggaaatgtttgctgattgctgttatttagcattgtgacttctattttcaatgctagtcttcggaacaaagtagtgggattttttatttgtttgtttgttaaaacatttaattatttttatatatttagggggtccaaggacaggtttcttacatgcacatattgcagtgtggtgaggtctggccttttagtgtacctgtcaccatggaggtcatactagggcaactgagaaacgagctggccaaatgccaccgaggagaagccgccttctggtcaccaaagggagcccatccctggggacattcacccaagtctgcccaagaacccatcttttattttattttatttttgagttggagccttgctctgtctcccaggctggagtgcagtggtgcgacctcggctcgctgcaacctccacctcctgggttcaagagattctcctgcctcaggctcccgagtagctgggattacagacacccgccaccatgcccagctaatttttgtatttttagtagacagggtttcaccgtattggccaggctggtctcaaactcctgaccttgtgatctgccctccccctccccccactttgtataagacaaaataattgactcagcagcaatgcaaggcagacagggccatcgtccagaggaatggggcctgtgctgtgcaccccacagcactgcccagcagcctggtctctccactgtaggcaagttggagcggtggcagcaggcggtgcctcggcctcccaaagagctgggatcagaggcgtgagccacagtgcccagccgaaccatctttcaaatctctgtaagcaaattccagaggcataaacgtcttcaggacaggtgataaagttcacagtggagcatccacgtgaggcagtcagaggctgctgcggctccccggggcccgcagggccctgaggctgcagtggggatagagtggacgggcgctggagctcctggctgtgtgggtgagacttcatgcttccggtgccaagtgctgagccctcccttctcccccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggtaaggcgaggcaggcgtggggatggggtctgggctcactgagattgaccctgcacaagagcttctgtccagtcttgggcccacagtgtctctgcaaggccctctggcgttggggactcccactggttctgctggcagcttcctttctcttggagacccttgcatgtaggccccaaaaaccttaaaagttgctccctgaaaccttgccttccaaaaggtcctggaaaactttccttttcagagagaagtgacaaaagagttgttgtttcgttttttgttgtttagcggagggatttgtggaattctggctatgccttctttgcttagaagtgcattaaaggtcatttaatcctattcagttggcttttgaatcgagcatgtgtaccacagggagcactgtttgtccccccaccagctctcccacccagtcgtgggctgccctgcagaacctgcaccagcaggggcctgtcccgggaatacagacaggctcgggtggtatgtggggaaggtgctcccaggctgctctctgccaacttctcttgcgctcaggggctgggaattccaaagcttcgcacatggttttttgggaggctatggagtcatttctttaacaaacttagaaacaaggggaaatacattgatgcaaatatatgacttacaggtaattagaatgaaggtgtttatgggaacttaagaggggccagggtattctggtaccttctgtctctttctagctaagaggtagagagagtaaagaaatttcatggacaaatcagcatttccagcttctctcaaaaaccaggactggcactgtgcccacatcatctgcaggaagccccccaggaccaggcctgctctgtcttctggggtgtggtccccttgcccactctgggcccacttgactcctttggtgacctgcctgaggctgtggcccttgtgtaggctatagggagctgcagagattcagaaacaggggctagcgaaggctctcagatggaaccaggcagaagttgggggttgccctttgcttaacccttcccctccccaccactttgtatgagacagggtaattgactcagcagcaatgcaaggtagacagggccattgtccagaggattggggcctgtgctgtgccccccacagcactgcccagcagcctggtctctctgcagcaggcaagctggagcggtggcagcaggtggcgggcccggcaccagctttgtcctcggtgcactggaatcaaccctgaggcagaccctggcaccaagctcagcccatcccacattctcctttcatagcacgagtgtcacaggggcacctctccctcctgccgggaggcccggccgtgctgtgcctctgcctgtgggaggtctcacacgggcacgagcagttcggtgtcagcggacgagctgcagcttttgatgctatgttgctccccgtggtgttttttattttatttttttaaccttaaagattttaaaagtcctcatttctggcatttcttggaaagttggaagctgtctgacaccagccccgtgttcctgcgtgcactgggccggagctgagcaggtgggcgagtgtgtgtccatgtgctccatgttttccgtgctggcagccctgaggccagcaacgggctctccgttcactccagccgcacacctagtggcacccaggtttgtgacccctgactcagagccagagctgggtgcaggcccaggtgatggcccaggttgacggagagcctgtggtgaggctgagaggctggggcagcaggtagcaggcaggcgggtggcagtgaccctggagagttggcccacaccctgctcttccactcctggctgggctcccaggagccagtccctttgcctctctttattcctcatctctgaaaatgccacttcacttatctgtaaacattaggactgttataagacttgagtgtgataatatatgtatccctggcacaggggcctggttgccctacgtgtcctgcttacgtccggctacctgacccacaagaaccttccgctgccccagcctcccctctcccgctcccctggggccctgtttcccttccctggaaactttcctcctcctgctgctgcccagtgttgtgcccttgggataatagagggcaggtcctgccaggcctattgggagccaccccttggctgggtagtgctgtccttgcgccatcaggcattttaaaaactaccctagcccaggaagggtggctcacacctgtagtcccagcactttgaggggccaaggtgggtggatcacctgaggtcaggagttcgagaccaacctggccaactcttgtctctactaaaaatacaaaaattagctgggcgtggtggcacgcacctgtgatcccagctacttgggaggctgaggcaagagaatcacttgaacccaggaggcggaggttgcagtgagctgaggtcacgcctctgcactccagcctgggtgacagaaagagagtctgtctcaaaaacaaaaaacaaacaaacaaaaactaccctgaggctactccagctgtcatctgagtcttgggactttggtttttttccaaggcagattttgtgattgtatcaagaatttgtgttttaggatcaatgacctcctatcctactgcacatcttacttaatttagcagctttatcagtttgccaggttcttcactaagaagccattgatgtgcctcagcacctcagcccttaaaagacagtttgtccttgttctgtccccagtgtgttgggttcagcttggcatcgagtgtgaaaatcagccttgacctttgccatttcttagaagaaagcacaggatgcttccccctcactcttctccattgcaaagaatgttccctagataaacattttcctacattgagtgttcagagaacccccagattggaaattgaatcttacatcattcaaaacttatgtatttcaatttctgatgaacaataaagatgcctatgttaaaaaaaatgtttattccaaaatcgagatagaaaattagactgtgaagaaagaataagaggaaaaaacctggaattgattccagtacagaaagagtcacttctgaggatggcactgggtgcaggaagagattggatgttgattagttgcttcctgtttctgcctgaaccaagtgtgaggcagaaggcccaggggctcaagggtacagttgggaaagaccttcgagttgggaagggtaaagggaggctcatcaggacttgcaaggagggtactgctgggggtgggggagctgtctcctccccccgctctccacgggcccctcccattcccactgaaaagcaaccaaccctgccattgtcatctccctcaaatgcccctgttgagactggatcagccctgcaggtgaagggacagaactttccccacaagcttgagtagctgctcctctttccttatttgtgtctcccagagaacagtgcacacagctggcttgaaatcaaacatggaagtttcattcttgcacaaacaagcactttcaaaaggcgtccttagtgagcactctctgggcttcggtgaaggtaccccagggggacccccgcccctgtctgctttcgtgcatccgggcactggagttatggtctctgtaagattgttgctgggtgggaaggagccagccaccttctgcaggaaattgtcgggactgggggcttctgttggtgagagcttgtaaacatctttcactgggttatatgaaacctgcctgcctgcctgccttcctctcagaatgttaaggaggttcaaggaggtgatggaggagagagtctgtgtaagagcttaaagacgatcacatttcactgtgccctttgccctcgggttggctggggccagacccccgctaccctgggggtacggtccagccaggtcatacagtcccccgagagccctgcttgtgccagcccctccgcccagccactcagtaccagcaccttcatttctgacaccacacctccaattgcaggttgctggatctttccaatgaagggtttacaaactgggaattcatgactgtccactgctggggagaaaaggctgaagggcagtggaccttggaaatccaagatctgccatcccaggtccgcaacccggagaagcaaggtcagtggctcttgggaatctcatgacagcttttgtatctcaagcctctttttacctctgggccttatttaactacggagtctctgataattctttgttttgtgttttagaggtagaattcccataacagaaaattcaccattttaattatttttaagtggacagttcagtggcttttagtacatccacgatgtcatgtaaacgtcagcactatctaattccagaatgttttcatccccacaaaaagaaaccccatacccatgaagcagccactccccattccctcctcccctcccagctcctggcaacctctaatccacttaccatttctttggatttgcctctcctggacatttcatatagatgaaataatacaacacctggccttttgtgtctggcttctttcacttagcatgatgttttcaaagtttttcaatattgtcgtatgcatcaaaacgtcattactcgtatggctaaacgatattccattgtacggattgatcacattttgtttattcattcacctgtgatggacatttgggttgtttctaccttttagctgttacaaatagtacagctatgaggattcatgtacaagtttttatgtggacctatgtttttgtttctcgtgggcgtatacctaagattggaattgtcaggtcatatggtaactctatgttgaacgttttgaggaacagccaaactgtcttccacattggctgcacccttttacattccggccagcaatatatgagaggtccagctccttcacattctcgttaacacttaatattctctgctttttaaaaaattataagcgttctagtaggtgtgaagtggtatctgtggttcttcaattgcctgatgatgcaccttgatgcacaaaagttttaaattatgatgaaattcaatttattttttcttctgttgcttgtgctcttggtgtcatacctgagaaaccattgcctaacccaaagtcacagagatttactcctgtgtttccttttaagagtgttatagctcttacatgtaggactttgatccattttgaattatttttgtatatggtgtgaggtaggggtccaaactcattcttttgtacccatttgttccagcaccacttgctgaaaaatgcattctttacccattaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcctccaacttggtggttctttctcaagattgttttggctattttgggtcccgtgtaattccatgtgaatttgaagataagcttgtacatttcttttttaaaaggtagttggaattctggtagagattggatatgtagatcattttggggaatatttccacattaacaatattaagtcttccagtccataaacttgggatagttttctgtttatttagctcttctttaattttgtttagcagtgttttttgtagtgttgagtatataagtctttcgcctccttggtgaaagttgttcctaagtattttattatttttatgctattgcaaatggaatggttttcttaatttttcttttggattgtttatttctctggtaattcttgtacctttttaatcccttttacttaatgatcaatcatttatttaactagtctttattaagtaccaaactctgatctaggtaatggggttacaaccaggaaagaaaactggaataatcagcacatcttattttgtagttacccacaaaggtctataaacgcctgtctttgttctctgggtcgaatgcatagtaacgtttacagaatgtgctgggatcttgcttttctatgggcgagtttcctcaaggtttgctttcactgttccgtcgttccctgtgcccttttctgtgaagatgcagtctgcttcttggtcaccctgggagtgcgtgagaaccttcccctgccctggttcttttccagttctccataaacaatccaaaagcaaaattaaaaaaaccattccatttggaatagcacagttttaggagaaaagaagagtgttgacttgccttacgtggaaaattgactttaagtcatcaagtcatctacagggatctgggacctcccccagttgtattctttctggttttaaaatagtaaataactattttaagaaagcgttggctgggcgcggtggctcatgcctgtaatcccagcactttgggaggccgaggcgggtggatcacgaagtcaggagatcgagaccatcctggctaacacggtgaaaccccatctctactaaaaatccaaaaaaaaaaaaaaattagccaggcaaggtggcaggcacctgtagtcccagctcttagggaggctgaggcaggagaatggcttgaacccgggaggcggagcttacagtgagccgagatcgcaccactgcactccagcctgggtgacagagcgagactccgtctcaaaaaaaaaaaaagtgttataacaaatcctaaaagtacaaaaatgtaaaattttaaatgacctgaaatttacacattttaatagtggaagctcctaaattctttcttttaaaagccccaaagtgtattggccgagtattaaaagtcaaggtttactcctcatgccagctgcatcctcaagcattcactgcttcgtgggcacaaggcagagttctcatgccagcctgcatggcctgcttgcctgggaggctggtgctgtatgcaggagagcacatggaggctggggctactgctcttgtgtcctcatggcatagccctggaaaccgggcacaccattcaacactctagacctgtgatctttactctgtatcatgagccgaatacaacgagccctacccatgtcccagggcagctttgaggggacagtcaatcccccatggaactgtgcctctgcaggcagcctttctcatgcatctcacgcattcttctctttccccttcctattaggccaacatgcgtgcactgatgcctctcccctgagtccacatcccctccagccaccacccacttctctgctcccctttatggcaaagccggcagaacaagctgcctgccatggccatcactggctcactcccagcccactcccatccactgcacaaaataccggggctcgtcagggtcccccaccgtttccacattgcccaagcctatggtcccatctctgtcctccccaggttgttaaagccagggtctatggttctaacaaactaagcaccctctctggggaccacagggtgcagtggttaagactgggggctcaggagcccttctacctgggggtagatgctggctctaactcttacaaatacctgtgaccttggcaagtcacttagcttttctaggccttggtcttcttatctagaaaatggggatagtacgcaagttactgggttgcggtgggatgaaatcaggtaagacaggctggataccgagagcagggcccggcacacagcgacgttggcagctcaccccctctagaagtgccctcttgcacagctgcagtgatgccacacctgggggccctctccacctcacaggctgccccttgtgcatctcgttggctgatcctctcgcacatacccctgcacgcactcctgggtcctctgctctttgttcccatccagggatctcatccagccccgtgacactgagcaccttgtacctgctggtggtgcccaaagctgcctctccctgccctcttgcacccagacctgctctgcagcagcctcctgcttctgggcatgggtctaactggctctgagcttgtgcaccttagacaaactcccaaactgcctctttcttgctttccacattaatgtaaatagctttgggctgggcatggtggctcatgcctgtaattccagcactttgggaggccgaggcgggtgaatcacaaggtcaggagatcgagaccatcctggccaacatggtgaaaccccatctctactaacaatacaaaaagttaaccaggcatggtggcgggcacctgtagtcccagctacttgggaggctgagggaagagaatggtgtgaacctgggaggtggagcttgcagtgagctgagattgcgccactgcactccagcctggatgatagagcaagactccaactcaaaaaaaaaaaaaaaaaagcttcaccttgcactccattgcttggccaaatcccaggagtgaacctttaattcttctttgtctccttcaccatctgcttccagaatatatctcagtctgcccactgcctcagttcagtcccctatagtgtcttacctcctcattccactggcccccctgcctcaacccctactggctagagccactctccacccagcatccaatgatccttttaaaatataattcagaaaatgatgcacccctgctaactttaatgacctcccacagctcttagagcaaaacccaaatctcttagcctgacctgcacatcctgctagcacctctccaccgtgaatcatttcctgcgcctcatcattgacctccgttctgttcccctaacatgcctggtcttacctccatggggccttggcacgtgctgctccctccttggggacagctgtccctagggcttcccatggctgcagctcagacctggcctcatggaggggtcttatctgaatgcctgtggtggatgtcctacccactctcccaccttacactcctacagaaacataaaggcaggggatgagaatggggaggaataaaaatttgctgagattctgattccacatttagtgggaggggtgatggattatgtcttactcttagcactgatagagacatataaactcaaatatcttcctataatagagagataatcaagatttaaaacaggatgccaaccttccagatcactagagggaaataagagtgaagagaaattgatcaatatgccaaaaaaaaaaaaaaaagagagagaaagaactataggcaaatttgaatagggatacggaagtcttaaataaaacattaggaagtggaattcatcagtttattcaaagaatactcccctccaagaacacagccttcactcaacagatacttattgagcatttaccaagttctaagcactggggatgcactggtgaacaaaacagatgctaagcttacattctggaaggcagaggaggccgtgaaacaagattaccaggcaggaagctgttgtccattagatgatgagaagctctaaggagaaaaatgaagcagggcagggtgacaagggcatttcagggtgtaccgggaaggcctcagggaagggacatttgagtaaagctcaaagaagatgagggggtgagctctgcagacatctgggaaaagggcattccaagcaaagcgttcaggggatgctgaggcccccgggcaggagtgtgcctggtgtgttccaggggatgctaaggcccccgggcaggagtgtgcctggtgtgttccaggggatgctaaggcccctgggcaggagtgtgcctggtgtgttccaggggatgctaaggcccccgggcaggagtgtgcctggtgtgttccaggggatgctaaggcccccgggcaggagtgtgtctggtgtgttccaggggatgctaaggcccccgggcaggagtgtgtctggtgtgttccaggcacagcagagaggcccccgaggctgcagggggcagtgggaagaggagcagaataggacaggaccaggcattgagagcatagggaccagatcgcactgggctttgtcagccctcacagggacttggttggaagtcactgagagattttaggcagaggacagaggtgatctgaacttctgtgttaataggctgacagctggtcagaatagacggaagtgagggtgggagaggaacaaaggcggggaagccagttagaaggtcattgcaatatcaggtgaaggtgactccgacggggcagcatcagtggagtgtatgaagcagtcagattctgaaagcagggtcgagagatgtgtagatggatcagatgtgggctgtgagaggagagagggggcatggatgacttcagagtttttgtcctgcacagtagaagaatggagtcctagtttcctagatctggaacattgcagggggggaagatgctggagagaagatcaggagcttggatttgggtgggttaaatcaaagatacttacacaagtccaggcagagatatgtacctggaggtgagagggaagactgagctagaaatccaaattcggattaggtatattaagtatcgtcagcctttcaagctgtatgagcaatggaaggagatctgtttatataacagtgattcacacgtttggagcctgttgcgtgtgggtgctgagcgagctttaggcttgcagtggtgcacagcacggaaccgcatgccctgcacacctgtgcacctgccacactgcttcctgcccagccagatgctgccatatcagctccctgcttgctgcctgcatggcactcagcagctctggccttggccttagcactgatgggcttgccatctgcagccttccttccttccggtcctgctgtgccctgagagcctcctgctgcatggtgtatgataggtgcccaataggtgttggcggattaattagtccagttggaaccctctgtaaccaccacatgaccagatgctctgtgtgctacagaggacacaggattagtggatacaagaaatacttcctgagggtagccccaaatgaagtcttgacacaggtcgatctccacccctcagcgtgggtagaaactggatctttgctttcagaaggttgagacgggtgcagaataaacaccttgtggtaccttccagctctgaccttctagggcctactggaatttggggggcggggacacattctccagtgtcatcacagagagtatgcacattcctgcaagggcgtctggagtcagttcattccatgcaagctttaccctgtagacaactgccactcctgaatgtggtccagaaacagcaagtacaggcatgcgtcctgccacagctgacgcacggcaagccctccctgctgtgtgtggggaggacgggcgccttcctgtcacccacaggctctgtgcatcctccccaagcacagtgagagctagcctgggagcctgggtcccaccagcatctctccacagtggaaatccatgtggccctcacatgggacactgcagttgcaactgagtctccccaacctgccctgctcacttcattccagggccagcctctgagcttgttgttcagcatggcggctggatcctcccagggtgagggaagggagtgatggagtgaagccaaaaggggtcagaggggctcaaacaaaggccaagcggccctttccaggttggcgtatgggcccagtgcttttgaggttgatccaggataagccctcttcagcctccagatgaatggtacctcttccggctgttcctgaaatgtcaaaatgggaggtctgcgtatcctaacagacatgtctccgatgcattttgcagaggtcctgccatgtgccagatgctatgccagtgctcgggcacagagaggctccaagacacagttcctgcccctgaggagcccacaggctagttgggaacatttcggatttcaggaaccaatagtaccatgcacaagggcccaagggccaccagtgacccagaggagtgccccaagttcagtggagcaaacagggatttccggctgaaagaaacaaggaagggcttgtgaggaagggtctgcctaaggccagattctcaggagttccccagtgtcactttgtttttttttatcttagtagcatagaaaatacaggccattaggagatggcgactgccccaagggtacggctgtccttttgtagaatgaagtgccaggcattgcccacatatgacctgccttactccgcctacccccaggggtgagacttctcagggctggccttgctccccaggccctgggagggaccacagaggggctcagcagtgacgagccaggcttccccacccgatccactgggcaagcgacggggatgtcaggccgagacagtcctcagcgatgacctgccctaactcccctccttccaggggcaggtctgggcccttccatgagtgcagagcagaggtgggagcttcctggccaggccgacataaggaaagggcctgctgcctctgggaggatgctctggtgcccacagaaggcgtcagtgtggatgggggcctgcagtggacgggcattgaggtgtggaggagagtctgagaagatctctatcaaccaccagagagccaggaagcaccccctaggaggaagggtgaaaatccgtgtctacccagagctcaccaaggcactggttatgctgtgcccaaagacccgggacccaacgtaggcattgttcgcaataagacctacccccagagcatgcctgtgaggccacgccaggtgggcaggacggccgctggccgaggcttctcatcagtgcatgggtggagagggaagcccagcctgcctgcacgctatgacgctattgtgtacacagggaggcaggaccagccccagcactgaatgttcaggtcaagctgatagtgcctgttggggacctcagcctgggaaggtgacagagaagacctaggttgccctctagctccaggattcagagctctagaggccgggaaaatgcagggctggtcagccaggaaaatgcaggtctggtcagcatcgtcagcatcgagtcagctgcctgtcagcctcgtcgatgccgaggtatgaactgatctcaaatgggcaggatcttccactccctggttgtctggtgagggtggcctgtgagtgcacagtcaccaccagcctcagtgccaggcacagtgcagcacacacacacgcgtagaccagaaaagcaggcagtcctcacttctctacaggcattccaagaacctgtgcttggggcagggtgcttcgtttctgtggtgttcatttcaatctcctgcaaatctctgcaagttaattgctttaaaagaaaatgaaaagaaaaaaactgctccaatggtgttctgtgtaaaagtgctttaaaatctatgctaagacccaggatttatgaagtaattaagtgatctgactgatgcgctagctccaataatacctcctgtcagattgaacgtggcttaggtaattagttttaaagccatttttaaaggttgagtagcacatcagtcatccattttcctcttcagttcccaggccaaggatctgggtcctcccaggatcactctcttccaggaggcaatttaggaatggaatcgagtgtgaatcctgctttgcagtcttgcagcatttgcagatactaacagctcttcatttattcctgcacacctatattatttatttatttatttatttatttatttatttatttatttattttgagacagtctcgctctgttgcccaggctggagtgcaacggcgcaatctcggctcactgcaacctctgcctcccaggtttaagcgattcttctgcctcagcctcccaagtagctgggattacaggcatctgccaccacatctggctaatttttttttttttttttttttttttgtagttttagtagagacagggttttgccatgttggccgggctggtcttgaactcctgacctcaggtgatctgcccacctcggcctccgaaagtgctgcaattacagggtgagccactgcacccagcccagcacacctttattgaactctacttagctccagatttgggaacactaggaccttgcccctgcagtgcacagtgtgggtgtggaagagggggcagcttccaccgtgggtgagcttgctactccagccgttacgcacagagcctgcaaggctacgaacggagctggcaacggtgcaggcagagctggggcgatggctcgtcctgcagaacatctgtcggagaagtttggctgcatttaagagagttgccatccaaaatgcccgagattttaagtttggacccagaatgcagaaagtgtctattctctgagaaacatgtatgcttcattctcccacgtcagacatcagacaggcctggggttggatcctcctgcctccgcttttcctgtctctctggcctctgcgctgggtctcctctcctgtaagatagggctgtgcagaagtgagacccagaccaagtcactgaagagaggagccttcccagcccgcccttcttgcctcggagcctacgttggtggttgcacctgaacgacaaggcagagcctgtgcacctgccaaggtcaggccagcctccccacccagggccacatcccgctcggcaccctcaggtgcaggaaggtccctgcacctcctcatgacctggggcccccatgggcatgccggatgcatgcaaagtgctctgcaggaatcgagcttggctttgtcagcactaaggggcatctgcatggtgttctcctgttcatgcagcacacacttaccttgtctgcacacctgccccatgccgggtctgctgggtaggcatgggtgtgaggggtgtttccttgttcttcacttcttccaccccaagagcccagctgagtgtgccctgcaggcagtttgaccagggctatgtacagggcccaaactttactgagttggcctagccctccctttgtaaccaggagcctacctaaggtgctggggcacctcccacagtcttcccctgccagggagaattgtgagacatcaatgtctaaatagaaaaaataatcaggcatgctttccaatcttctctctataattgacaccatgtatcttatttcatggttccaaagggttttacgtacttggtattcacatagtaataaatagactgtctgagacaattgatggcactttaaaaaatcctgtgtcactcttgaactctgagaattcactttctccctgattaaaatttcttttttctctgatctttcatctgtttccaaaagagcagcaacccacatgtgctgtgtttttccagattatttcaacagcattatttccagattcccaccaatctaggaaagaagtccaatttatcaaaagaacgagagaggaataggatgatgattagcacctacgtgttctccagcaggcactgggtgctattttatctcgctgttacaaatcagtatagaatcagggtagatgataataaggaattaaagtttcaggaaaagttattcttgctagtgatgcatatcatggtatttacaaatgaagacatgaccacgatgcctatgatttgtgctttaaactattccagagggtgggggtgaggagtgggagagtaggaagagggtgggcgaaaccagattgagaaaaggttggggattcttgggactgtgtgatggggcacggggactcattgtactgttttctccattttatgtttatttgagaatttccattacgtgaagagtttttaaaagcacatgtatgggaaacatttcttccgaagaggtcagaatgcaagactgtctgagagatttacatggcacaagtaaatttaacgatgtaaagatttcattgctttacagcaaatacacttcagttcttcacttgtgaggagtaaatgctcaatgtgccgtgggacacgtagagacagggattttacactttgtttaaagtgtaaaaagacacgtagtttcttttacgtttgactgaaggtgctctagacagttactggacgtgtgtatgggagtgtgtgcttgggtgtatatatgtgtgcatgtgtgagggagagtattgtgtataagtatgtatgtgtgtatgtgggcttgtatgtatctgtgtgtccatgtgcatgtctatgtggatatgtatgtgtgtatatgtgggcattaggtatatgtgtatacttgtacatgtatctgtgtgtgtgtgcatgtggatatgtgggtgtgtgtatgtgtgtggtgcatattggcttatgcttccttttcaagacccagtgtaacacaaggctgagctctagagcggcctgcttctcagatccatcttccaccactggtcattgcggacctcggcaggccatttccatgctccgagcctccaacctgtcctctgcccagggatggtgggaggattaaacgaaacagtgcccgagaagtgctgagccttaccagcatgaacatgattctcttattgtgagtgtttagattctccttttgtggaagagggagctgagtccaagctcctccacccagagcctgactgagctcacctgcctggaaggggcagagcctggtgtcagggccgtcttccaagctcagggccaccctcacctcaacccaacctggtgaggtctccacgcctctccaaggcagtacaggcagcccatagttgatctgatctctttagccctgtggccagtggttttcatgtgtctggcttcaggatatttctggttggatttttttgtttaaagtgttgtaattagaagataaaaattaaatgaaatattaaaagctgggagcctctgctgggtgccagccagggtcggggtgttgaggaatgttgctgctgagaggctgcctcacttggctgaaatccaagagagcagcaggccttctgagaacttgctttgaccagtccacaagagcaggggtccccatcccacctaccggtccatggtccatggactgttagggactagactacacagcaggaggtgagcggccagcaaacacttcatgtgtgtttacagctgctccctgtcactcccacttctgcctgaactctacctcctgtcacatcggcaaaggcactagattctcataggagtgcgaaccccattgtgaactgcacgtgccagggatctaggttgcacgctccttatgagaatctaatgcctgatgatctgtcactgtctcccatcacccccagacgggaccgtctagtcgcagggaaagaagctcagggctcccactgattctacattatgatgagttgtatagttatttccttatgttttacaatgtaataatgatagaaataaagtacacaatgattgtcatgtgcttgaatcaccccgaaaccatccccactgctccccaccggatccccagctgtggaagaattgtcttccaataaactgattccttgtgccaaaaaggttgggaaccactgcagtagaacatttgaaatgcaataggtacttggaatagatgcttggttttaagggtttttcctatagactatgttcctgaatgggaggattcagtatcactgagatatctcttcttcacaaagaagggttagccgtcactttaacacagtcctcatcaacatcgcaacaaaattaaaggaatgcaaggaaaacctattctgaaagaatgggcacagataatagctagagaaattctgaaaaaatgaatgcaggtgtttaactgtgttttttaactataataaaatgatctggcactggtgctggaatagaccgatcaagggaacagtacggatagtccgttaataaagccacagagatatgctaaggatagcgttttaaactggtgggaaaagactgaagtgttgaataagagttattgataattggccaaccatttggaaagaaaataattatcttgatgcatacacataaaattagaaatttctgtctggcagaaaacatcataaaattagaaaaatattcctgtaatctcagcactttgggaggccaaggcaggtggatcacgaggtcaggagatccaagaccatcctggctaacacggtgaaaccccgtctctactaaaaatacaaaaaattagccgggcgcagtggcggccacctgtagtcccagctactcaggaggctgaggcaggagaatggcatgaacccgggaggcagagcttgcagtgagctgagattgcaccactgcactccagcctgggcgacagagtgagaccccgtctgtaaaaaaaaaaaaaaaaaaaaaaaaaaattagaaaaatatttataaaatattttggacaaactcaagtgattcacagatggccttttcacttctgtctagcccatgggttggaaaactttttctgtaaagggtcagatagtaaatgtttgaggttttctggtctctgagacaactactcaactctcccattatagtgtaaaacagccatggaaattatgtaaatgagaggccgtgctgtgttctgacctcactttataaaataggcggtaggtcctggccttagtttgctgtccccactctgccctgtttacatgttcagttgaattgagtcttctgtttcatggtagttaagagggctgtttatttggctgttatatgaggcatcccatcctgtccccattttcccaccacccatgaagttatattgtcctgcttgctggtaaatatttaacaactagtgctctgggggaaattatttatagatattgacatatcacataagttcattataaattttactgatataaaggatgttagccaacaatttacaaataataaaatatacattgcttgtattataaattccatttagccagttgattctcagagactgctttcattgatttttgccgaattctggttccataaccagccgatggctgccatgcatgaacagttgtctttccagcgtaaatattgggtaatatttttgccacagaaacaacaaagacatatgtcagaacttcattcactcaccagggatgggaacaacttccttgctaaattggaaaataattttcaaatactgaaagaatatctcttcagttttgtaagctgttcacagtgtaatacctacagacatgaaacatttttaagttatacctgcagtattaatgctttctccatcactttcttaagcccagaaaatcaacagtaaacccagcccttgtttgtagcatttgtcgatttccatatgggaatatcccgccatggccaatttcaagcttttcacgtgacgtcactgaagacgggttggtaaaagaggggtccagtagccaccatgagatagtgcttcccctgtgtagatagaacagatgtgagtaaccctgaagcacagataatgacaaaatatagtgagatcatgaggaaggggcaatttgtgaatattcattacctttgtttttagtataatttattcaattgtaagcttctataatttaatgtttaataaagactgtgtttaacaaccagctcacaaaggttctgaaaatgttcacaatcagttccgttaagccagtgctggtcggctgcagcgcaccactgcatattgggaattgaacgggtagagggttgtctttctcttgggacaagcacactttaaggggagcgtattcattgcaggaccaaggctcaacgtgcactgctccccacccgtcccagctcctctttatgcttgcgggggccagccactctccagtcctccccaggaatatacgtcgcaaccaggcattcttttttcattggcctcattcttcccagggccggctcagaggccccccggtctaattgccattggtttaactgctgtttaataaatcaaactatttttctgactaaatcttgctaatcagtaaatagtgatcatctgaattctccatatgctaaaaagtcatttttccaaggggtaaaattaaagtaatatttggcataaaaaaattctaatacacaggcagacacctttatgtctaatatctcaactgtagaggttagataatcacagagtgctatactgtgttatagccttaaaatgtagagtgcttacagatcactaagaaatatttaaataatatcactaaataggccaaaatcctgaaaagcaattcgtaaagaaaacatacaaataaccagtaaacacaagatagtcaacatttgtagtatccaaataaaatataaactaaaggccaggtgcgttgtctcacgcctataatcccagcactttgagaggccaaggcaggtggatcacgaggtcaggagttggagaccagtctggccaacgtggtgaaaccctatctctataaaaatacaaaaattagccgggcatggtggcgtgcacctgtagtctcagctactcgggaggctgaggcaggagaattgcttgaaccagggaggtggaggttgcagtgagccgagattgtgccactgcactccagcctgggcaacagagactccgtctcagaaaaaataaaaataaaaaaaataaacgaaaacacaagaaggcaaaatcatgatagaaagccaacaagcagcagttgcagagatggtagaacaaatgtgtgaaacgaatctgtatggcactctgcactcggggccacagagtgatgtgatttaaagaacgggaatgcaggggcagaggagcctgggtcccacgctggctgcaccggtgacgggctgggagacctgggactgatgactccctcatcagcgtcttaccagcacctggtggacatgaaatttctcacgcagcctgtgtaggttgtcacagaagcccaggctcctctcccctctccctacctgccactgcaagtgtgtgttttaccacagcctttaggaattggtccatttgctctctgggaaaattccagcctggagaagctggtagagacctgcctccatgcctctgaggaaaatcaaattggctgcgacctctacagaacccaggaatttggaattcactgaatccagggttgctgcgctggaggcaaagctgggctgctattgggttggctggccctaagggaaaactcttctgacttttgaactcagcaggtacatttctattcttcctttcttcttcttaagcaacacttttcccgagaaaaacaaacaaaactttgctaaccaaaagctttgtgttgaaactgccaggaggagatgataagccaagcattgccttggctcctcaggacttttgcaggcccccggggcagagccattcaggaagttcccacagggcttggctttctttggagctcagcccagtgcacctgactctaccctgtgcttctgtggaatcccagctttggttctgtccttcccagaaacctgaaagttgaagccaagacaggatcaaggaaggtctagtcagaactgtggtgcttttgccaaaacttgcagaataagctatcggggcacagatcagttacgaaaaccaaatctgacccgttatccaggcgacttgagtgagaggagcaggagggtggcgggaggagaccaggctgccgcagacactggagctcctgaacgggatttggacctcagggtggtgtttagggagagcccagagcagagcagctggcaggcgtggtctgagttcagctggccgcttcctggcctggtcacggaatctctcagtctctgtttctgcacgtgtgtgatgggaataatagtgtctacttcaacgggcctggggagattcaaatggaggaaggtttcatatgaacaaatcctttatgaggagtttcaaaggtttcaggattacaatctttgtccatagtgcctataacatcagaaacaccaagaagtgtttcttgatattgagcttccttgaagccaattacacatgtcagttacatatcgaattctgtgttctgccttgtgctgtgacggtgtctcacgaaggtgctgctatacctttggaagactccagaaagcccagggaagcaggttcttttcaaacatgatagttcacacttcatacctcgaagcatgtattttgatgacgttttactccgcaaatgtcacactggccccactgcgtgtctccccagactggcccagccctgctgtcgtcaggccttgcctgttgcccagtaaagagatctagccctcacttccttgcctcggctcccccagcctcccccacggtgaagcctgggcgttggaatggctgctgacgttcccaccggggaggagcagcggaggcgcaggggccggtccgacccagcgggaccccgggggggcgggggttgtggcttttccctccacttccaggtgaggcttggtatcaggcctccccagcatctggctgcctggagggggcaggtaacacaacccagaaggaaggtttacccaaggaaagacaggacataaagtgtatgcccttcctgtctgagggcacattggtctcacaaggcctgtttggaagacttcccccagctaagcaaccaccccgtttctttgtggagctgcagccagcttgaaacacagctccttccatttgtcaaccccgggcgcttcctcctgctgccctccactcctgttgccctgggattgcacctcccaataaagcttcagcccatgggcttcacttcagtcccttgttttccagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattgatgaaaatgaaaatgacagatctgaggaagagggagagctctcttgaaacccctttcccagatttgccctcagttttaggaatgaggtacgcttgggcattcctgttgcctgcatggttcggcattctggcagccaggttcgccccagaatagataagtgtgtttgattttcgaacatttgactttattacctatttccagaaacacttcgtgttcaaactacgtctctacaggcatttctacttggtctttttctcccctgacatttcacagagtcctaactgtgctgcatgtataacttgttctttctttttgttacttgcatagcaagcatgtttctatgtcattaaatatcctttgtaagcagcattttatagatttttataatacttcaccaacagaagcaccataatttatttaagcatctctctattgttggacatgtagattgctttccattttttcctattatgagcggacagcttagtacaaaaagccttctcctgaatttaaaattatttctttgggattattcaccagaagtaaaattactgggataaataagaggtggaaaccacaaatatgcctgcctttgatacatattgccaatttgcttttcgaaatagttgaactgatttgtagtcttaccaggagtgggcagttctggaggaggtagatgatacccttccttaacttacattgtgatcattactaacaaaggtgaaccttttttcaaatgtttgtgcactgtgttttttcttttgaaaattgccctttctggcgtggtggctcacgcttgtaatcccagcactttgggaggccgaggcaggcggatcacctgaggtcaggagtttgagaccagcctggccaacagggtgaaaccccgcctctaccaaaaatacaaaaattagccggtcatggtggtgggtgcctataatcccagctactcaggaggctgaggcaggagaatcacttgaacccgggaggcggaggttgcagtgagccgagattttgccacctcactccagcctggatgacagaacgagactccgtctcaaaaaaaagaaaaaagaaaattcccttttgtctttcgcgagagcgctcagtgttgctatcaagctgataagtatgtagtctgtgtaaaatattggtaaaatattggtgtaataaccctgtgtgtgtcgtaattcatataaattttttttctggcctgctgtttcacttttgactttttaaaaataattttaaatttcccctccagagttttgataattatttccttttttaaaaaagtcccaatttgtttgattttattttcttcataatctgtttgcctttttttcagtctaaatattagtgtctctaaaaaataaataaaagatatataaaactttttctaagttgctaacaaattactccaaaacaaagtcaagatcaaaatgttaaaagatgtcgtggacttttatttccaacaacagagaagacaagtgtcttgaaatctccctcccacagaaaagaattttaaatgttggttgaaatgttcacagccaaagaggtgaacagaatcatggtccggcttttgcttgaaggcatctgcttcatctgtggagcccacctagcagaccacataacactgggacctcaggggcacccaaggaaaggagacacagacaaagctgtgtaactagaacccacaaaacaagtgcttacaaacaagtccaataacttcagtagtttcactaaaggcatacagactcgttgctccccttgagagacaaaaattgtcatattggatttttttaaaaaatgtatttaaaaatgtatttgggaggctgaggtgggcggatcacttgaagtcaggcattcaagagcagcctggcctacatggtgaaacctcgtctctactaaaaatacaaaaattagccgcatgtggtggtgtgtgcctaatagtagtcccagctactcaagaggctgaggcaggaggatcactggaacctagaaggcagaggttggaatgagccaagttcatgccagtgccctccagcctgggcgacagtgagactccatctcaaaaaatacaaattaaaaaaaagtattttctgtagtgccaggtatatttcatttacccaccagatccattctccactcctccaccccacagactcccttgcctgtggcttatagttgagttcagccaaggggaaactccagcaggagaggagggagggaggagatatttatttatgagttagtgattctccagtccttcatcagccaaacagaaatgttatggcaaaaagcgttattggagcttcatatgtagctctgtgtatgtatcaatatgtagagggtctatacatattggtaaaaggtttagttcagttctaaaagttccacctctaatcttttatgcaatttataacacagccttaaaatacatatagagcaaaaacttgttaaaactacaaagagaaaatgacaaactcacacaggagggagagatttagcatacctcggatatatttgatagataaaacagcaaaaattcataataatagaagatgcaaatatctcaattgacaatttaggtcaaatggacatattggaacactgtgccaaacaacagaataatacaccaaattttttatttatttatttttttttttgagacagaatcttgttctgtcgcacaggctggagtgcagtgacgcaatctcggctcactgcaacctccgcctcccacatacaagtgattctcctgcctcagcctcctgagtagctgggactacaggtgtgtgcctatattttgtatttttagtagagacagggtttcaccgtgttggccaggctggtctcgaactcctgatccgtgatctgcccgccttggcctcccaaagtgctgggattacaggcatgagccaccgcgcccggccaatacacccacttttcaaacacgaatggaagatttatgaaaattggccacatgtcgagccatttggcaagcttcgatggatttccaaggattggtagcatataaaccctattctctgacattacacttaagttagaaatcaaaatcaaaaagataattagaaagtttccatacatttgaaaattgaaaaatacttctaaataatttatgtgttaaaagaaaaaaacataatttatattagaaaatacttaaaactggatgataataaaaatactacatattcaaataaggaagatacagctaaagctgtagttagacaactttatggctgtaattgcatatatcagaaaagagaaaatcctgaaaattaatgtgctaagcatccaacttaagatgatagaaaaaaaccaacaacataaagaatgaagaaagaaggaatttttaaaatagcagaaattaacaaaatagaaaacaaacatatgtagagaaaattaaaatgccataagctggttcttgaaagaaactaataaaattgataaacttgtaagtagaccaaggaaaaagctgaaactatatgatttcaggaaagaaaaacgcatgattatagatcctatatacattaaaattatgtgacaaaggaattctaagtgaaatgaacaaattccaagaaaaaatacaacttaacaaaattgacacgtttacataaaattaaaattgtcctattaaagaaattgattctataatttaaaagaaaactcaaggccagagcaatttaccagcaaattctgccaaacatttaaatggaagaaataatgtcagtgttctgtaaattcttctagatagtagaaaaatagggaaacagtccccactttgttgaatgaagccagagtttggttttttttttttttgagacggagtctcactctgttgcccaggctggagtgcagtggtgcaatctcagcccactgtaacttctgcctcccagattcaaacgattctcctgccttagtctcccaagtagctgggattacaggcatgcgccaccacacccagctaatttgtgtacttttagcagagacagggttttgccatgttggccaggctggtctccaactcccaacctcagatgatccacccgcctcagcctcccaaagtgctgggattacaggcgtgagccaccgtgcccagctgaagccagtgtattcttgataccaaatcccaagagcacatatgagaatggagaattttcagccaatctcactcaagaacataaatacaaaaattctaagcccaatatcaagaaaactaaatccaacagtattaaaaagatgaaatactctgttcctcttttcctgccttgttttagattaatcaaatatttgtcagcattccactttatctcctctattggctttttagctgtactttgagtggtgctctagggattacaatatgcatccttaatttattacactttacttagaattaatattgaacagctttacacttctcagataaaaggatctaataacagtgtaattccatccccctccacttcctcatttgtgctgtaatggtgttgtatattttacttctgtatttgttacaaactccttcttaaaacagtgatattactttttgctttaagcaatcttcttttttttttttttttttttttttgagacagggtcttactctgtttcccaggctggagtacagtggcacaatgtcagctcactgcaacctccacctcccaggttcaagcaattctcctgcttcagcctcccaagtagctgggattacaggcatgcaccaccgcgcccggctaatttttgtattttcagtagagacaggttttcgccatgttggccggactggtcttgaactcctgacctcaagtgacccatacaccttggcctcccaaaatgctgggattataagggtgttgtcttttaaataaattaagggaaacagctactcttcagtgtgtttactgacatgcttaccatttctagtgctctttattctttcctgtagatctgaattttcatctgctatcatttcccttagcctgaaacacatcctttaccatttcttatcaaactgggcttctggcaaggactttgctcagctttgttttctttgaaaatgtctttacttcaacccatttttgaatggtattttcactggatatagaattctgggttgggagtatttattccagcactttaaaaataccaaatttttaggccgggcatggggactcatgcctgtaatcccagcactttgggaggccaaggtggccagatcacctgaggtgaggagttcaagaccagtgtggccaacatggtaaaacctcatctctactaaaaatacaaaaattagccaggcgtggtggcaggcgcctgtaatcccaactactaatcctaactacttgggaggctgaggcaggaggatcacttgaatccaggaggcagaggttgcagtgagccgagattgcaccactgcactccagcctggataacagagcaagactttgtcaagaaaaaaaaaaaaaaaaaccccacacttttggccaggcgcggtgcggctcacacctgtaatcctagcactttgggaggctgagacaggtggatcacctgaggttcggagttcaagaccagcctggccaacatggtgaaaccctgtctctactaaaaatacaaaatttagctgggtgtggtggtggcatctgtaatcccagctactcgggaggctgaggcaggagaatcgcttgatcctgggaggcggaggttgcagtgagctgagattgcaccactacactccagcctgggtgactctgtctcaaaaaaaaaaaaaaaaaatttgggagaagcacataaatgccttaaaattaaaaatataagtcaaaaattcaaaattcaatagatatgttagaagataaacttgaggaaatctcccagaaaatgaaagggtggtgggggaaagacaataaatattggacccagtaagaaattttgttagaacattgggaggtgggggcgggagagggatcatgtgagtatgtggaagatagtgtaagagaactgaattctcagcttcctaggtgagacatcactggacaatgtctaacatcaagaaaccaggacatagcatatgagtatttttgtctagcaatgtaagggcaaatgccagaaaaataactcaaagtgttaaaaagaggtggggagtcagggggactccaagaggtagaatggagtgaaggaggactgctttctttgttataaaccttgtaagagtttttgactttccagacatttaatttattactttggaaaagctggagcatcttaaaagatagaatgaccttatagatgccattaagaaaagtgctgtgttgtccattgtacacacaggtgatcattctttcccgaaaggatatttgtttaggattcttcgatccttttcctggcatttaaaataccatctttcagggtttttgtggctataggagcacagggaagccttgtatctcccctttcttagcctgggtctgagagttcatgtgtgtatgtgtgtgtgctcaggtaagtacgtgagtgtgggtgtgcatgttatgggtgccttgtgcacacatgtccatgtgcatccatggacgtgtgtgtacatggggagcacacatatatgtactctttttcttatcctcctttccaagccattcctaaattcctttttacctttctcttacttgccataatgtgaacttaaagtgtattttaataatgtgtttattgagtaaaggttgatatttctgtttgtgtgtgtatacatatacatacaatatacacaaaaaattactgtgtgtatgtgtaattttatatatatatatatatatatattgagaaagggtcttgctctgtcacccaggctggaatgtagtgtgcaatcacggctcactgcagcctccaactcttgggctctagcaatcctcccaactcagcctcctgaatggataggactacaaggacacaccaccacgcctggctaatttttctattttattttttgtagaaacggagtctcactatgttgccaggctggtctcgaactcctggcctcaagagatcctcccacatcagcctcccaaagctctgcgatcacaagcgtgagctactgtgcctggcccctacacggtatttttaataatagctttattgagatataattcacatactgtgaaattcaccccttttaaggagtaaattataggagtattcagtatgtgaattataggggtgtttttgtatatttttataaatggatggaagtaagcttttttattccttccgcccaaacctctgcattaacctttgtaacttgaacatagccatgggtggctggttcaccaaatctcagaaggaagaaacttccactggtgttttaaactgaaacatatttacgtgatttttctagggctctcttacttcactgtgtttcaattaaggaatttcttcctgcatattttaagtatggggacatagggggagaattaattaaactctatattgttaataacttctcctatagccaggaaaacccaggaatccaaaagtattagctcagagtccttaatctaatagaactttcccccacccctacttgctttgtctccaattgtaaatttccttcacaaggattttaatgcttaactcaaaatgccaggcataggaaagcttcattattgctggtactttcctgttggcaaattcaaccatagtctccccttaattctggttctttctttgcataatgggaataatcctgtttgttcattatgaatttaattcattgaggggaaatactgcattgaagatagtgaatgatgataaatccatttactggcagcctcagttggcactagctgtggattatcctctgcctctcacaatgacattccctggccttcattgttgacatctggaggcagcctgctggcagtgctggcccaagtgtttaaacaggtggatttgtgattcttctacaggctcaggaatctgatggcaaaaaatttgattgggcatcttttaagaccccctccttttagaaactaaggaactcatggtgctagttgggtatgtacaacagtaaacttgaacaggcttgtagagtatcttgaatagtaaataacacattcttgctaagtggtttgccgaaagcagggtcaacattctaaaatctgactgcctctgggtggcagttctgttgagtgtagaccctggtctggcctgggttgtccctggacacatctgcctgttcttcctccttgcttctcctgcacccatgtggcttaccttcccaaagagaatgtggcctcttgggggtgactgagtgtggaggggccggcctggggagcctgtcctggcacaagtgctgctgctgtggggggccgacactgtggacgcaatgagaggaggtggatgcctcctgaaaactaaagcctccaagaagctcattcctgtgtgtctctgccttagtctgttatcctaagtcacccataagcatctgactctcctgcctcagttaagcttgggctgtggtttggagaagggactgtgtagagggggtgattcttatcaagtaactgatttgcccaggtggcctgtggtccctcgcctgggtattttgcagtcaagcctcatgggacaccaaacactgtggcgggatcatgtggcattgccgttcatgatagacataagtttacagttcaagataagacattaacgtgttgtatcacctgacccagtggttccactttcgggactctattgggaaaaagtaatccagactgcatcaagtaatatttctgtcagatttatgtatttcaaaaaagggaactggactaaacgttctgtcataacctatcataagaggttgttaaacaaatggtcacgttcacagggtgaagtattttgctgtaaaaaaaaatgttttaacagattcattcattcagcaaacatttattgagtacctactgtgtgcccaaaagttgctacacactgaagctaatgcaccaaacaagagagacatgttccctgcccccgtgatgcctctaggctgaaggaagagaaaacagtgaacaagaaaataaataacgtcgaatgcgattaacatgatataatgctaagtggaaaaagaaagagaaaacagggtgctgtgtgttttcaactatgcaagaaatacacatgcataggaaagagcccaggaggaaatatgccaaaagagttataggtgatttatttttatttttctttaaatatctcaacatttaataatttttattctaactagggaaaaagtaattttaaaaaagaatcactcttcaaatttatgccatacactttatgccataggtatggaattctcatttttacgtcttccaaaggcaggaaaaccaaagtgactcccttggttgagaaagtgaaaaaagcatttaagtactagaaaggggagataggccaggtgcagtggctcatgcctgtaatcccagcactttgggaggcacgcggatcacaaggtcaagagaccaagaccatcctggcaaacattctgaaaccccatctctactaaaaatacaaaaattagccgggcatggtggcgggcgcctgtagtcccagctactcaggaggctgaggcaggagaatggcgtgaacccaggaggcggagcttgcagtgagctgagatggtgccactgcactccagccgggcaacagagcgagacaccatctaaaaaaaaaaaaagagagagagagataaatgtctcccagattaccattgtctaaacctaaccttaggtcaagtgtcacaaatcgcacctattagaaaaggaaaggtctcttttggaggcacatgcaggaaggggttgctttggtcccactgcttcttccctgctggcgtttttggagctcccagctctcagctccgcaggttgttagctcagtcagtgcctggcccctcataggctgtcatgagtatcttgcagatcgagagaaagaacaaaaatacaaaccatgtgtgagcaaaacaccatttcattccactggcccttgttacaaatgcagctaagatctgcttctatgcatcttagacgtctcatcccttgttcctagcaaatatctttggtaaatttacaagtttataaattgcttttaattttatcaaatcagaaatttgtcttgctcttaattatatgaaaaggatgctccgtttctcatataatgagagaaatgcgacgttaacctttctgagttatcggattggcaatgtaagccatagctgcaggctgcaagggagcccgttccttttgacgtgtgacatgtgacgtgtgacgagttttacgtctagtaatgtagcctacaggtacacatgcacacagctgaaatgacgtgtgcagtaggtttcccttaatggacagctcctgcgtgccagtctctattctaagtgctttaccatcatgaagtcatttaatctccaaagcaaccctgtgaggtagacattcggagacgttattattatccccacgttacaaatgaggaaactaaggaacagagatgaagtaatttgctagcaggggcaaagccaggttccagaccctgttgttccagggcccttgctctgctcacctcaagtagttgctccctatgtgaccaaggatagagcactatttgtgtagtcgtgtgctgcaaaatgacatttccatcagtagcagaccccatattcaatagtcattgcataagattctaatgtcgtattttgactgtaccctttttatgtttaggtgtgtttaggtacacaaacacttatcattgtgttacagttgcctacagtattccatacagcaccatcctgcacaggtttgtggcctgggagccgcaggctgtaccctatagcctaggtgtggagtaggggtaccatctaggtttgtgtaagcacactctatggtattcacaaaacaacaaaatcacctgcatttctcaggaggtatccccatagttaagctacacatgactataattgccaaagtttataaacaacctaaacgtccatgagtaggggattgtttaagtaaacaacactacatctctcctgtgcagccatggaaggatcataaggatacactgttaatggaaaactcaaggtgcagaaagtgctagcaggtgtgttaccaaaaaggatggggaaacatatgttcatatttgcttgaataagaataaaatgcttcagaaatgatacacaagaaacggggaaccaacattgcccatggggagggagacttcgtcatatgcacttttatacttttgcatttctgagccatccttgtatattacttattcagagacaaaaatcaaaaccccgagtactactgctttttaatggggttttttgaccatacaaccactttattcatagattttaaacattaaacttttaaaaagttttaatgtttatatatgaacaggtaacatatgttgtggttttaacaaaaagtcaaacaggctgggcgcgtggctcacaccagtaaatcctacactttgggaggccaacgtgggaggatcgcttgagctcaggagtttgagaccagcctgagaaacatagtgaaactctatctctaccaaaaatacaaaaagtagccgggcgtggtggtgcacacctgtagtcctagccacttgggatgctgaggtgggaggatggcttgagcctgggaagttggggctgcagtgagccatgatcgtaccactgtactccagcctaggcaacagagtgagaccctgtctaaatacacacatacacacatacacacacacacacataaagtcaaacagagagtgtaataataatgaagtctctcttccattccagtccagcctcctcccatgaggctgcctgtctgctgggtccctgggaattcttcctgctctctttttccacacagtgcacaccactgaccctgagtgtggagcagcccctcttgtttgtcccaccaaaactatatctgaaaataaaaatccagttttggtgaccaggccttttgtgggtgtttttggagacatcctctataattgaaataaacttcaactcaaatgatagcctctagagcccttggtccctgtcctaccatcatcacaaccccagccaatctcagtgcaccacttggtggttaaagtgctcggattcctttgtggtcggaatgtggctgtaactggaccctaaggagctgaggagagtcagaggttcctcaccaggcttgttttctgcacctgcagtggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcactgctgcagcggtgagaacaacttcctgtgtcgctgtcaccacacacgtaggctgggttaggaactgtgtcagggagggggagctgctgtggggcttaatgaaccgagccctgtggaagaccgtgtgctagaaatgctatgctggggatgctgtttcatgtaggagggccttgcttacctcttccggccctgtccaggctaagggaggcttgggcagtacagaatctgacttgggacagtgtgcaggctccagccttttgcaacctagtacttagccagttgaggctgtggttaaaatgaaacagggctgccacatgccacattgtgtaaatgggtcagtgtcgaatgccatttcgaatcgcaccagtggggccagtcccgcctgtctttcacctgcccgcccacccacccaggatggtgtggattacagcctatgggcttatggtatgaggatgagcaggagctcctgttctggaatttagaaacgctaagagatttccagaattggaacaaaaagtaaagttgtactggcagaggggcctgcattgcagaaacagtgcataggcaggtatgtaaagacagacaggctgccatttagagccagcgggtggagtagcgagcatgggcagaggtaagtgttgagaaaacacagtcaacagcaaagaatcagagcagtattcttcctccccgaaaccattctgattgccaagaaaccccatggcaggaaaggaagaggaagcagggatttttcagccaacagagacattgagccagcaatggccctgtccccagcttgggtcgcaggagacagtcatgagggcccactgagggggttcacagctgaacatgtgtgtgcatgtgtttcctattgagccaatccaattagaaacaaacattgaaaggctggggcgtccgggagccccgtcagcatgagcagctgtccttgggcaggtcacactggcccctggccccctcaactatgtggggtgatgaccttctaaacagtaaccctgctctgaattctggggatgccgtggttaaaaaaaagaagaagaagaagcttaaaccagtggccagcagcagagtcggcctgcagataggcgttaattaattgcatagatgctctttgacttacaaattgcaagttgacttatttcgatgatattttcaacttatggtggattcatcccaacatagccccatcattaagtctaggagtgtactgaatgcatctggcttccacaccattgtaaagtcaaaaaattgtaagtcaaactgtcataaattggggactgtttataatgtgttttataacatcaggaattcacctggaaattgctaccaggattttcactttgcttgatacctgagaacagacagctgcatgggccatcgctccctgtggagctgtcggtggggcgggaccccagctgcccccatgttggctgggagctctcccatcagcactgtctttcctgtgtctgtctgtctctgatgtcccccatggagcctggtgtctgtctactcatccccctgctttcaaagatgttcttcctccacccagcttctgcagacatttgggtttttaccagcactgctatcccccagaacatccctcactgtcctgggctagctgtggaggagagagcccaagactgagtcttcccatgatctaggatcaaggatccaaacagcaggactcctccatgcaacccagttatcacacttggatgctgtagggcaagactcacagccaggcctggcaccagatttacccaccggatatcccaagacgggaaggtggctgctgctaggcatcggggaggcagcatcgagggaggctgcagtgagatcagcagggcagaggacagcctccaggacagtggagagtccagcccggctgacctccatcccagcagggacaggaagcggagggcagctcgatagaacaggaataaaagggcactggcttgcaggaatgagacactgggggaaagcagcatgtggcctgggcaataggtgcacagctggccagcaggtaaccaggaagtgaaggtagcaggccagagcccagctatcaggggaggagccaggcagcatctggcttatttctgtgagtgacagaggtcttggcacaggcaggtaactctgtgggtttggtgccttccagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtaatgagcctgaagtaagaggagacggccagcttccacgagctttgattgtccagagtagctcttaaaatgtagggctgctcctggcaaaggtggggctgatggttgtgtgtctctcttgcctgggagtcataataatcatggcaatttgcactcacacagctcaatccaccccaggctctgctaatattttacagaccagtaagtatgcttcaaaccagtaagtattttccaaccttcccagctgggagagcagggtctatatgcccaaccagaatggggtcttgccccctggtaagttagccacttctaggagcaccccctttccaaaggcccccatctcacagctcagcctcctgactccctcaagtacatccactttcagtccttgaggtcaggatgtgggaaggacacagttactcccaaggatccaggaaggttgggttcaaggagcacagctgggaaaggacttcgtggcagagatcctgaccagcctggaggcctagggttaaagacccagagaggatctcaagagatgatgtcagcagatactgatgcttcacagatgccttgaaaatcttacagcatctaaaaaggccctgcatgaatcgtttttctccaatcatcccattgccaaggtgggccctggtttggggccgccagttcactccacaaggcggccaaaaccacagctgcccagagaagctccagccactgagctggacatggcttttattcgtttgttagactagaagctgttcttctccctctgagccctcctgtagcaatttgtgtgagaagaggtatttctggttggacatattttccttagctaaatactacggctaaatgataaatgatgggtgatatctaagaacactgatgctttaagttatctaatatcttctgtgaaaaacaaataacaaatggaaaattccaccaacacatatcaagtataaattacggtcaattccattttaaatttcttctactattcctttaaaatagagcattgaattatgtatggactaatctgctctgtttccccctgtgatttataaactgtggcaagattcagtaattattaataaggaactgatttttttcttaaaatctgctactgacttcagccttgcacaatggaacctcactgtgataccattctgcagtccagcagtctactgagcagggattaggtggagagagggggtctccatgggaaggagatgcattcctggctctcagagaagccccctcaagtctcaggggtgagtgggatgggcagaccagagacagcaggagagcctattcagagaccaggacagagtgacagaggaggtgagaaccagacggtgccagagtatggaagccaaaggaggaggacgagccacgttagagtccaatgcaaggtcaggtggatatgagacggggtgtgcggagccggccatggtcatggtgcatcaggagtgacgggcccaggccagtggaggctgcacctggactctttgggcaagagagcagttgccaagaaatagaggaagtgagcgagggggacgagggaagcctagggagtacttgcaaatggccagggtcccaggacagcagcaggcaagatggtccctggagaggaaggttgaggaccagagcatctggctgggagaaagggcagcagctgcagtgggcagcgtggggcacaaggaagatgtcagtgctgtggttctgaaggtggacaactttgtggtgacagccaacctgctaggccagagccgtctggtggccaaagtgcaggtggaggccaccccagggactccgcagggtgctgagttgagagcagaccctgggctgtccccccgcccagagactgggattcagcaggtgtgggacgcctgggggtctgcacctgtagcaaccactcttaggtgcctgcaggcaccgtgggcttagggagctggcagataatgaaaccagcgaggatgggggcaggaggcagggaagagcttgggttcctgcaagagagtggctgggaggccaggacattactggcatggaaacacagggaagcctgggcctcaggaaagaagccatggttgagcaaaggaagctgagtgggctgagatcagctcaggacactgtggtcatccacacaggactgcaagggaagccaagaacccacgtggcatcgtctggaagacggagttccagggcagctccaccggtacaggagacagttcacaggatgagggtgatgtctggagcaggaccatgtgtgctcacaggctcagcacatccgtgcttactcgacaggctcaagcagaggcccagaagcctcaggtcgcttgctcagggcacagcagtcaggaaggaaaccagacttgttctcagtgtactcttattctcgtgggcacctcttgtctgcaattaatcggcccaagtcttgcatgcctctcgggtccgatactgctccagtgaggttctggtgtgctgttcttggatggcgtgaacggtggagaagatggtgataccaaactctcctgtccatcggcagttggtctgagcgcgcaacggcaaagcacatggagaactcccaagttgcttctaacatttatttgtttgtgtatttttttaaatcctggatttcctccacaaaggattgaaggtggagttttcaaataaacccgtgtcagtttaagcccatctagagaggcatcagccgctagccaggctgttcagcacgtgaacggagccccccttgtatgaagagacccctgctaggagttacgggaagtgacacaagaaggcagtggggcttggaggaactgtcacgctaattgaggcaaagggaaaagcagacctaagtacaaattgcaacacaaacatcatggttgcccagagaatgagctgcagctggaccagaacacgctcaggcggtggagtgattgggaccacgtggacagcaaggtggatttaatttaagaacgcttcatgggcgagaggaacctggatatttggcttttaaacacaattcaagtggacagccatactggggaggtttgtttacagatattcatctaggcatctccacccttggatgggcatcgtcttaacctgaccggtgggtgacctcagtgcagtgtgggggccctgcagctctgttgaatagcccccaaccttgcactgggctccttgcaaaattatgaataagctttccactgcagagagacccaggaacaggggtggggggtgtgaagtccatacacccggaccagcagctgggagcactgcttcaggaccctccccaaggctgtcctcctccgaggacatcctagaacattctgtctggagatggtgaggacatctgcactttccctgttcctagccaccctcctctcatccgctcagcaaatagtgattgagcacctgctctgtgcctaatgccaggaatctagcagtgaacacaccgaaccaagccctgcccgcccgtctcccattccgtgtctagaaagagtgaaaagattggtctgccgcctccctgtcgcactcctgccctcatcttcttaagatgaaggaaattgttcactttatcaagcaagacagacctgctgcctcctcagggagaagacgctgcaggaaaaggcaggagagaagtcctcaagtcaccacgacagccccgcgttcgctgggccagctgcgagggtgggaaggcgagagcccagtggctgagctggagttttgggctcaatgggtaatttaaagcaatggtgcgagaaatgaggattttggaggctgtcctcatagatgacccaggatgaggtgggcaaagaatccaatcagatgggaattgatccaaaatattatagtaaaccctctggagctggggggaggagtttagtaatgagttttagaaatggtgagtggcatctggaacccaggataccagcaccgcccaggaacagcatctagagtgtcctcgtggatacacacagctctgaaaggggttcacagtgggaaccgggacacgcaaagcccccccagtgaaaactagggaaataacaccagagagccttcggggagggaagccagcctcactgggtctaacactggcaaggtctggagacttcaagacgagtgaagagggctttgcgtgccccagcaaaaccccactgtgggcagcagagaatgaggacttttgtcttttcctcaagtccccaccaaatgaaggtggccagcaactcactagtctttactcttgagctcactccccatcccctctcataactcacacctcggaggaggaggtttttcttccagtaactcaaaagccttcacatgccccacttagtccctgtgtgtcagagctgtcggggtcccctgggccgtttcccagcgtaggagggacaggtgggcagtaggcaggagtccaccccagctgtagcttcaggcgtcactcctgccgaccagcgtggggaggacccctgcagcgtgccccgcccccgcctgacgggtagacctttaacactggcttcatctctgggatacctgggaaggacctagagggtgaggtttgctggcgtctactcagctcgcctgcagttctcagttgtttttccaacaacacaccagcctccggagtgagaagctggggacccctgggaacttgagggaagacacagctgccgtcccaccaagggctccaaggaaagcctaaaggggatgttctgaaaggggctcagccctcagcacagaaaacagcagccccccaaccctaggacagcactgtctagctgtgtccctgccccaccctagacctggccagcaacagccccaccaggcggtcctgagcatgcggagatccatccccattcccaccacagcgagttgcgggggggctacctaattcctcctggctcatcagcttgccagcagctcccctgacactcagcaccccctcttgtgttgctctgtcctccacgtggaagtcaaaggtgctggctggtcccagcatgatgactggtgcaagtgagtgaatgaaacagctgttccagcctctccctccccgctacccctccaggctctcacaagtcccatctcctccctgctccgggtggcgtacccaccctggatgtttcactccttctcatgccatccctgtctagagtgctcagactgacactggagcccagcgaggctcagctgtgcctgttacccgcagggacggctgctcccgccttgtcgtctggccgtccagccccagcggggcctgggagcgtctcccaaccctgccaagctgcgatatcctgacacagggatccgcgggactgcagtagatggagaaggcgtctctctggatgaaaggcaatgcttgtttctttaaggtgtgtgccatccggagtgtggtgacaaaggctgtgatggccccaatgcagaccagtgcttgaactgcgtccacttcagcctggggagtgtcaagaccagcaggtaatgcatgtcccgcagccctgtggctcaccactcagtgactttccagttgtatccttagcccctccatgtcctgatgccccagttaggaagtaacgtagcacccccaaacaatcatcacactgaagttaactgctttggagtttttaaatttttagtaacttggcattcctatcatgcaagtcatacatgtccattacggagaaattagaagctgttgcacgttggcgtccgtgcttataaagccttttctatctgtgttgttaaagagaagtgggtcatgttgggcgtgccaaggctgccccagagggcctggagacggatgcgattcaaggccctggtgctgtcctcacaggccagctcaggggacatggctcttggacaggctgaagcctgttgatggtctttctttcagtgtctctggactctggctgggtgtggggctttcacagaagctctcctggcacctccccagagagcccatgaggctgagtttaccccaagggaggatatcaggagctctgacctgggaccccacgtatatggccagttgcccggttcaggctgacccttctgtgatgagtgtgccctcctgtgtggcctctgcagtcaggccctgggctctgtccacggagctgctccagctcctggcatcaccactttctcagattctcttccctgccagtcctgcagctgccctgttgtccattctcatttcacaaacttccctgagcacccattatgccccgcatgtgccaggcctcagaggccacgatgacaggacactgctaggctccccaaaggcctgggtgacagatgcacccaccaaccactggtgcacacccatgagggctcaggcacgggtgcggccgtgcaaggtcaagccgggtgcccatgtggctctcgtggcgtcctcgagctcccagccacagcgcactcactggccaaagtgcaaaggctgtcaccctgctggcctcactcactgcccacaagactcactccctgagggcgcccgagagagggttttgccagagccgacagttccaaaagtcaaatacgaacctcacgatgcccttgggaaaccatgcgcaccctcaggaccttccagcagggccagctttgaaaagaaaggattcccaggttctatgcaaggcctccagcctctccacctgtgtacgtaggaacctcagaactgcactcaccaagacaaagggcatcatgtttgacattcactcctgaagccttcgtttcctcagaggaaacaaaggggcaggcctggggctggggctgggttggcaaggccctcaccctcctgcctttgctcctacaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtaagtggcttgtttgtgggtacaagaactgatgagccagccccaactttctgggcccgtgtcctctctccagggagaatttcccagccttctgcttccgtgtattttgttgttctgagtaaggactttgaacagggaaggaggcagagatgatgaaatcaaagcacccagacctgttagttaatagcacttccccacagacctggccaggagaagttccaagtgatgctgagagacatcctggctgtccagggaatttcacccacctgcaacagagtcaacgtccactactgagcaagggcagagaggtggctagggccagccactcttgaactcagtctgatttcaggtatcagaagaggaggtcctgctgtctgtgctgtaatttctcctccaggaaagactatgccatcggcttctctgtaacacaggatgtgtgcgctgggcgtgggtcagggtacatgggattggtggtcagagctgggggagagccctcctcggcagagctgcggagatgaaattgggagtcagatgtgggcggaaggtttgcagacctccagacatgaaaaggagctgctgaccaacgtcagttgggctcggaagggatgggtttgtctttgccgggcatttcacaggtggcaaccgcacccctgaacactagacaggcagtgttttcctcgtcctacagatggggaatcaaagctgagcaggggcaaaggccacaactagtcatgatggaggtgggactcggactcagagccgcaaggccaggtgtcttgctgtcccaggagggtgggggctggacaggagttgtaggcccaagaccccatgccatgttttcgtaattcgcctcgccctgggagacacaaaagcagggcttgggttaaattgacaggggatagttctcaaacacattaaagaagctaccgtttggcactcgtggtcttccaggtagcaggcctccccacggccctcctctctgggcccttactgctcaggatgggtcattgatccggcctgtcatggcactgccgttacccctgtggacaagacccagcaaatcttaaaagacgtataaagccatcaaataacaagacaccccctttttttttttttttcgagatggagtctcactgtctcccaggctggagtgcagtggcatgatctcagctcactgcaccctctgccccttgggttcaaggaattctcctaccacagcctcccgagtagctgggcttacaggcatgcgccatcacgcccggctaatttttttgtatttttagtagagatggggtttcaccatgttggtcaggctggtctgaaactcctgacctcaaatgatccatctgccttggcctcccaaagtgctgggattacaggtgtgagccacctcacccgtcccagactccctttagcggggaaacaaaaagtcatgcaagacacatttcacagcctttgcaaacgcttgccctgggctgccagccagacctttgcaaaggacggaggcgccttcatccccacccccttcccaagggcacagttggccgcccttcttcaccccgacatcctcactcagcacctgctttatggcgtatgatgccacctgtgggggccctgagggggacacgtgcaggtgtggcaagcagctgttagctcccaggcccagagcaccccagccacttaggagtggtgcatggtggtgtttcatgaggcgccaacccagataataagttatgacattgcaggtgggagttggggtgacccaaaacttccccaagaggcacgatgactcgccgtaggttcctgtctcaccatctagagcagccagatcttcatacataggtttccctgagaaagcaccgtggtgggcaagcggcagcctcaggctctccaccccccacctgcccacacccggccactttcatgaagatttccacctcgttaaactctactcagcccaccaggaattggcctccatccctgttgaaataagcagaaccacctcagaggcctggtggttgtctgaggaccgtttttacctcagaaaggggaggtgagaattctgtgaccccacaccaggtacaagcggcctctggctgctttatttccacccattccggaggtggactcggggaacagcccacccgcacccccgctttgaaatgccgggggcctgcttgcccagatttcattcctgtcagtgtcgtcccttctcttttcttatctcgctatttttctccaggtcagaaaaattgccttaaatgccacccaagctgtaaaaagtgcgtggatgaacctgagaaatgtactgtctgtaaagaaggattcaggtaaaaccccctcgaaacctgaggaatgtcagggcggtggcgctgcttggagtgtgttatggatttaccacgttggtgcatttctcctaaaagctgaactgtcagaggcccaaagccattgagggtaaagattccgagtcctggaaatcgtgtgtccacttaggatggaaagggagaggatgggcggaatctctacattttacacaacatgggcgaattgggcaaagcagcacttgatcacatcacgtacagcacagggctgtgcccagatccgcctcctttcgctccagcacctccacctgctccagttcccctcgctgtctgggccggggatgggctgtagcggctcacccaccctctctcctctgcatccctcggtcttctctttttctcccagctcctgacatcttcacggcttcctgagggtgctctttacgttcctggttctccctgttcatcaggctcagccccataaagctcagcatgcattttctttaaaatcattctactgggttaatgattgttcttggaatattttgaaatgtttcttcagcccatttaatgcaaccaaactgcatttaatgcaatcaaatatacattacctgttcctccgaattgctgtctaaaatcttagaacattctgttcaaaattttttgggggacactcccatagtagggagactagcaccatggtccgcactggaaggatcacctcatgtccagatgcaggttctgatgcagcaggtctgggcagagcccacgactctgcatttccgcaggctggcagtggtgaggatgctgcggtccaggcagggagctgcttttgcagggtgaggcggtggagggctgcaacacacccccagccccgtctcccttctcaaatgctgtgaggactggaattctccatagaagaagtttcttttttggagtaaagaacaaaggaagaaaacttactgagcatatcttctcttattccaggggcttgcaccagtgttgcctcatttaatctttgcagcaacctgtgaagtagacataattcttactcgcattttacaaacaggggagatgaagtttccccaggaggcactatgctactgccttcatttccttcagcctgcctctttcttccagatcagagtactggggagaagaggaccccaagcagctaggagtccaggagagggaaggcaaagcaaggctcccaaagtcatgcatcacatctgctgtcatttaaacctgttggctggacaaggcaggattaggagtgaaaggatgaactggcccaggaaagggatcccccaaagataaaagagttggaagaggaaggaggcattccgctggcggcctgggagaggccagctttgatgtcccaggctctgcaggtcaggcagcccaggagtggatcctcaacccaggctggtagctgggggcatcaggaagaggaggctctgtgttcccagctccctggaacctgcctgtttcccagcagagaagtgctgaggggtccccgggaatgcatttatgcatcccgtcccatcctgtaggagagggaaatcggatactcaatgtaggaatggtgtgctaaagagaaaacgcctcctgtcggtagccccgccacatagaggcagtgcttccgtcactgacgagctttcagagaggcgtgcaaactccagacgcatcgccagccgtcagccacagagagcttccgtttattgcccaatatcctcttaagctgtgacttctaatcactgcagtcatgttaaagcagcaagagagcagccgagccgccgcctctggccctccatctcttcagggggatcaacacaggaaaggtttgcaggggagtgtcagttataaagacatgatttaactgccattcgcagtgggcatggcaccatgaagaggaagggcgccgggtgggtgtccgccatctatgcagaggagcttgccaacatacagacgtcttcctgctaaatgcaggtgtaagagataggaaaaaccagtgttttctcctactctcacacacaaaatacaacacacttcacctctggtagccaaaacgtgtgggtttttccccacacaccaagcagttctccagtgaaccgtaagatatacgtaataaatatatagctcaggctgaacgcagtggctcacgcctgtaatcccagcactttgggaggccgaggcaggcagatcacttgaggctaggagttcgaaaccagcctggccaacatggcgaaaccctgtctctactaaaaataaaaaaaatagccagacatggtggtgcacgcctgtaatctcagctactcgggaggctgaggcaggagaatcgcttgaacctgggaggcggaggttgcagtgagctgagatcgtgccactgcactcccacctgggtgacagaatgagatcctgtctcaaaaataaataaataataaataaataaatagctcaattctgacgctactagatgtgtcagatcctacaaattgagggctcagcccaagactgccccactttgatgtcaatcacgagtcccacatggtagcctgtgcttctgagtgaccagccataaatcggacttgccatgacccctccttgggttcgattaattggctaaagcagctcacagggaaagactttacttacatgtgcccatttattacaaaggatatggcacacagccagatgaagagatgcggagggtgaggtttggaagggttgagcgctggaccttccatccctatggggctgggctgggctaccctcccaggatgtggttgtgttcttgttcaccaccccagagctctccaaaccctgaccttttgggtttttatggaggttttgttacatagccatgattgattacatcattggccattggtgatcaattcagccttcagcccctctcacctcccaggagggaagtcagagtagtagggctaaaaattccaaagctctgatcaatggttggttccctggcagccagcccctgtctagaggctgcccaggaacccccagctatcagttattaaagacatttagcactttgataattccaagggttttaggagctgtgtgccaggacaaagaccgaacatatatttccttttttttttctttttctcttcacatatttcttattataaatcccagtgtcatagcaggagtctccgggtctgacagatgcaccccagagcccttgctcagtatggcaaacccatctagaacatgtacgtcacagactgtacacagtataatctcaggaactaaagagataatagtaggtgatattgattcacactgctgtgtgccagacactgaaatgtttatgggtattagctcattgagtcctccaagcaactttatgatgtagaaaccaattaacaggaagggaaacagatgtagaggggctggctggcttgcttggggtcgaacactgggaaggtggcagaagccatccacgtgggtggtctagctcagcatctgtgtctctgtccagcactcggctggctggagtgaagtgagggcacaaatggggcgaaagaggaaggtaggggctgcatctgacaggcctgctggggctccagagggcgtcttatttcaagttcattgcgaagctgcagaaggttccaaggtttcaagcaagagaggcaagagcgggttggggttcagggccagccttgtagccgacagccccgtcacacgccataaatgccaacacttcaagagggacttgacactgagactgagctagcgtgccaccagtgatgacccacacagctccacttctcttcatggggtttggattcgagttggagaaatgacagtaagaaaaagctatcactgggtcaaggacggagcctggcgcctgctgcctggtgatgggagctttgcttcccagggccttgtaccccttcctgctgggcccccagcggactgcgggatggctttcccgactttccttagctgagaactttcggtgacacaaagaactgtgcctcagccacttacatctcctcttgggaaaggtgctagagggcaagtcataattagacttttggaatggatgtggaaatctgcctctttcttttcaacagccttgcacggggcagctgcattcctgactgtgagccaggcacctactttgactcagagctgatcagatgtggggaatgccatcacacctgcggaacctgcgtgggtgagttcaccgcctgcggaggcctcgggccagcgtcacccaagcgtaggctagctgccttgaacccgagaaagccctaggacttcgtgggcttctgcatttattgcagcattaaaatgcaagggcaaaacaaggtacaaaggccctaccagggactgggggccgggagagtggggatttaatgtttaatggttacagagtctcaacttgagaaatgacaattgttctaaggatagatgctggcaatggttacataacagtgtgaatgtacttaatgctgctgaactgtgtacttaaaaatggctgagatggtagattttatgtacattgcagtggctcatgcctataaccccagcacttagagaggcagagatgggaggacagctcgagcccaggaactcaggaccagcctgggcagcaaagctgtgagaccccgttctccacaaaaggaaaacgttttgttggaaattttttttaaaaccatgtttttaaatttgaaacaaaatcccaaaacaatgcaaaggcccactttgaacacgcagcctgaggttctcattagaaacccagccaggcagtggcttatttcagatggggaaagggataagagatgctcaccactcataagccatcttgtctcagagctcagctcttgctgtggaacggcgcggacagaaacacaacaccataaacattgagagggctttgggagaggcgggaatggatccaggtggggatggggatgttttcaaacatagccttagttctttgtgcctatcttcacttattttgaacattttttcaaagaggaaaagaattctataaacaattttacatgtattataattgcccacaaagatgatggcacagatgtctcccaggcacagtttttatgcagaatagcagagaattcattcattttattggattttgttttgcagagctatttgcacagtaagttgaagtgcaccatcagtctgtgggctcggatatgttttgggttaagttttctcctctctccttcctgtccttggtactttggtcctttctaagaaactcacatcatatgagctttttctgcagtaatactttaagaattaagtctctactggccgggcacagtggttcatgcctgtaatcccggcactttgggaggccaaggcgggtggatcacctgaggtcaggagttcaagaccagcctggccaacatggtgaaaccccatctctactaaaaatacaaaaattagccaggtttggtggcaggcgcctgtaatcccagctactggggaggttgagacatgaaaattgcttgaaaccgggaggtggaggttgcaaggagctgagatcacacccctacatacttcagcctgggcgacagagtaagactctgtcaaaaaaaaaaaaaaaaaaacagaattaagtctctgctaaaccagtttccatgatactactgtgcctcagaaatcctgcagaatgggcacacccctccccacgtggccggccatgagcaccccatgcagctccctgccgtatgtcctggaatagacaggcctgatgaacaaggctgtggccaaggccagtgtcctcctatgattgccaggctgacctcagaccacccaggggagacatgtcctcctcagttccctcctggggcagccctcaaggccacagtgctcagcatctggatgggttccacccgctggcagctcagcagatttccccagcagtttgcctgtcgcctttttgtctattatttttattatttctttgacttatttagcccagatggattaggcagcatcactgatgttgcttatttaaatttcgtagtcacttgaatccataacattcaggcatacagttttgcaactctttgatttcaataattcacttttctttctttgagtccccagattgcctgatggcaaaaagctttatagagtcccttggaattctcatctcaaaccagtgacttctccatcacttcagctattaaattcattggtgagcaggtccacagctctgggggtctcccctgcgccccatgccctctggcctggggttctttctaagctcctgggaacgtgtacatctatcccctggcagcctcttgggagagagacctcattttcctcctctgagtcactggaggcttcttgttccatgtcaggtgtggacctcattggaggcagctgttctcagctgcctacttcctgtgccctggagacccaggcccacctggcattcccctccctgttcccattcagtgaccactgctgtccaccacccacccaggggcctgggcacagtcgtggggagggtcggagtcaggcatgagtgcttggggtagggcatggcggaatctgtccccacccttggctcacagtgccccagtgcacttggcaggcaactcgatcgagatgagcctctcatcctcctgagtccaggtgccccgtgtgtcctggcatggaggttgtaatccttcggggctgctggcacagctgggttaatgcagtggccccgtgggacgcgacttacccacctggggcatggcatgtggattagcagctgacagcctgcagggcacacacataccaagttgcggggcagtgccccaagcacctgtgacggtcagccctcaagcatgagcgtcctgtgcctgagacggcactacttgaaacagcaaatgagaaacaccacaacagaccaagagagattcaaaagaaaggaaaacgctttctgttttagtccctgtcgtggcacattcttccagctttctgaacaaaggctccatgttttcactttatactgggccccgcaaacaacatagcaggtcctgtataagcacagcccgttctgctcttattgctatgattgtgggtgcttttaaagtgttcaaagtctatagagacttgcgacttaatggaatccttaaaagactttcactgagttatgaaattcatattttttagtagttgagaaaataggtcgcttagaaaatcaacccactttaacagcttttttattgcggtaaaatacacatcacataaaatgtaccatcttgactatttttaggcatacagttcggtggcattaagtgaatttacatttgtgtgccaccatcgccaccacctccaaataaatgtgttttaacaactttgaagcttaatacattgagcatgaaacttaagtacaaacaagaatgagctttctttcccacttgggaggctccacaggtgttaaggaccctggtgctggaggaaggatagtggggaagacgggttcagcaggtgaggcgtgagaggtacaacggcaggccctgaacagctcccaaaccccactcagagtggcaccccgcctggtgtatgagacccacccaccagatgctcccagagaccagtgatggggaggggcggcattggccaaagcatacgagcagcctctgctccagaacaacataaaccagacagagtcccgcccccggggcacagctcttccaccgcacctcaggaagagagggagacacctgccatgaagacggtggtcctcaagaggccccttgaggtccctacatctgcctcctgctcaaaaccctgtggccttctcggcttcactcttcctgactctccaaggaggagcttctcctgcaggagctcagaattccctcccaggcttacggctgtggttctgaggtgtgaagccagccccagagcccagggccttgtgcttgagccctccaggctccggaacctctgcaaagggattttcccttgatgcagcgagaggccccatctgagtccagagcagactgcaaggcctcgatctgcgaccacaatcgaactgaagcagctgtgaggaggtttacctgggcattgtgattatcatagagcccctgagataatctcctccctgcctgtaaccctctccgctgtcagtcagtgactacttcactgcccctctctgacgtcccatcagttgctccctggagacacctggcccagaggaggtgctatctagtcaactagtccaacatctgacccaggtcgacaggtcctcctcggaccctgagccaacctgaaggttttcctccatgactcgtggccctttgctcagaactgttgtgtcttcgagtctctcctccctgccctataaacccttagtcttaggcatttgtttctctgttgttgaaaacgccctggctgtacacaccaaacacctgtcaacaccattcccaaagatctcttctttcatcttcccccgtcatcttctacagcgttctgtgcaatggaagggccacaaacgcaagccacgggtgcaatttgaagttgcctagtaaccatatcttaaacagtcaaatgaaacaggcaaaaataattttagtaacatatcctattcaacctaatgtgtctaaaatattgccatttcaacatgtatccatacaaaaaataaatgagctgttttatattttttatatgaagactttggcactggatttccaagtgttcagggagcagaggtgggcctaggcctgttggaaacagggcccatcatcgtggcacggccagtgggcaggtgtgctccctctgagatcatctcatgcctcgatgtccccgtctgtgaaatggtgatggcgatgcccacctcctgggagtgggtgaggacggcccagctcacagaacctgggaaatggcagctgtggtggtggcctgggggctcctgaatggtacccctgatctcacaaggccctgaagcaggcctggggcatggtcttctgccagccatccctgatacctgcttcttttcctgtgtctctcagggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcagctgtgtccagcaaaggagtgcctggagggcagagtctggcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaaaaaatttttttggagacacactctcactctgtcgcccaggctggagtgcactggtgtgacctcagctcactgcaacctctgcctctgggattcaagcaactctcatgcctcagcctcccgagtagctgggactacaggcgtgcaccacaatgcccagctaatttttgtttttgttttcgttttttttgagatggagtctcgcctgtcgcccaggctggagcgcagtgggcgatctcggctcattgcaagctccgcctcccagattcacaccattctcctgcctcaacctgccgagtagctgggactacaggcacccgccaccactccccactaattgtttgtatttttaatagagaccgggtttcaccacgttggccaggctggtctcgaactcctggcctcaagtgatccacccacctcagcctcccaaagtgctgggattacgggtgtgagccaccacacctggcctaaaatattttttttagttagatacttagagaaattaaaaagatcctgacaatttcctcattctaaagctgttctctgcacagtccacgcacatctattttcaccctccatatcctcctcttgtgcttcctcccatgtgtccctccacagagtcaccattcttatttgatggccctggacccttctgttgttggacatgagctgttaaaggaggagctgtttgctctggtctcctcttttctggctgaatattgccctatgttgggagatcatgaactcaggacccagaacagggcagggcaacctgtcttattcagggtgggagcaacattgaggagtttgaagggacctgtgagggtgtgacgatggggtgagctgtgaggggtgacgatggggtgggctgtgaggggtgacgatggggtgggctgtgaggggtgacgatggggtgggctgtgagggtgtgacgatggggtgggctgtgaggggtgacgatggggtgggctgtgaggggtgacgatggggtgggctgtgaggggtgacgatggggtgggctgtgaggggtgacgatggggtgggctgtgagggtgtgacgatggggtgggctgtgagggtgtgacgatggggtgggctgtgaggggtgacgatggggtgggctgtgaggggtgacgatggggtgggctgtgaggggtgacgatggggtgggctgtgaggggtgaccatggggtgggctgtgaggggtgacgatggggtgggctgtgaggggtgacgatggggtgggctgtgaggggtgacgatggggtgggctgtgaggggtgacgatggggtgggctgtgaggggtgacgatggggtgggctgtgaggggtgacgatggggtgggctgtgaggggtgacgatggggtgagctgtgagggaagtaccaggcgttagcctgctttcacagtgctaaaaagaaatacctgaggttgggtgatttataaagaaaagaggttgaattggctcacagttctgtaggcttcataggaaacatggcgccagcatctgcccagcgtcttcactcctgatggcaggtgaagcaagggcagcacatcacatggcaatagcaggagcaagagagggaaggaggccgggcacggtggctcacgcctgtaatcccagcactttgggaggccaaggtgggcggatcacctgaggccaggagttcaagaccagcctggccaacatggcaaaaccccttctctactaaaaaaaaaaaaaaaaaaaaatgcaaaaattagttggacgtggtagtgtgtgcctgtaatcccagtcttacaggaggctgaggcaggagaatcgcttgaaccaaggaggcggaggttgcagtgagctatgatcgcaccatgcactccagcatgagcgacagagcaagactccatctcaaaagaaaaaaaaaagtcaggagttgccacacacctttaaacaagcagctctcacatgaactcactcatcaccaaggggatggtgtgaggccatttatgagggatccaccccatgatccaaacacctcccaccaggccccacctccaacactggggatcacatctcatcatgacacttggaggggacaaatgttcaaaccatatcggggggcttccgtctgaaaaagactgaaaatgagggagccctcaaaggcttgtgtcagagcaggggaggggtgcccatggctggctgccagctgggtaccgattcaccacacagtggggtctgcctcccaggctgtgtgtaagaaccactgtgggttgtaacctattcccctagaaacaaagccctacagtgagcccatgagggaccaccaagcccttgcacttgtctgacccacagcagagggacctggtggcggttacgtatctcggcaagcatcagccccttctactgcgttgctgtaatggaggaaacttgccacccgcttgcaaggtgcagccttgctgagtcctgcacggggccctgggcacagttgtctgaagttaaacccttcatggtaaccagtcagctggttctcagataattaaatatagcaatccagggagaacttggaattaaacagtgataatcactttcatttgtcaaatgccctggatttcagggcatgctgatcatgcccacagctgtgcaactggacccctgcaggcagccccaccgcaaacctctctttgcccctcaggaggcagcaggcgggcagccccaccgcaaacctctctttgggcagtggaggacaggagtttcctgggtacttgttcccaggtgaggggcagctttcggccctgcagaggctgacagtgctggggctgacacaccgggtcttggagaagcaccccccaggaagagcgtcagtgtggacgcctcccaaaggaagcaaggccttggtccgattggttctgcggggtctctccccacttggacagcctgagctgagaaccacaggcatcctccaggccccagaatgctggtggacgccgtggccgtccgctgctgctgtgccaggcagctccgagggagcatgtggccagacgggctgcgttggaacatgcaggtcaggacgcaggcctgctgggttggcaactgcaggtggaagccgaggcccgacgctgagaacaatgcctgataagttccctaagagaggggccgaggcccgacgctgagaacaatgcacgataagttccctaagagaggggccggacaccctcaagacctagtgagaggacccagcaagagccagcctggacaacttggaagaaaaacaggcctctgtggagtgcttgccagcgggggaggcaaactcctcatgccctggccctgcctccacttgcccccaggctcagcgggggcagagactcccaggggcacagcttgaaggggcacgccttctgccaatgcgcatgctgcgtccaggctggagcatgaaagcgtcagtcttctgcatcccactcctgaacaggcaggaggctgatgggagtggcctctgcaagggagcagggacagagggctgcatccggcatccctgtccttccagaatgtggcagggcaaagcggccatggtgtttgggggaaaagtaggtaccatagatggttgcagaaccagaagcatcttaaaagccaccctgcccaaagctggtgctgcccacgaggacccgctgctgggcacggtaatcctgacggaaagcaggagctacacagggtctcccagggagagccgtctgcactggcctaacggggacgggagcatcacccatctccctgagcagcatggtgatggattatttccccagacctccagaggagagcccagcctggccaccaccttgccctgaacctcgtgagaccctaggtggagagcccagctgcacctgcctggacttctgcctgcatagcggggagccgctgagtgggtgttattttcagctgctgagtgtgtggcaacctggttagagcaatggaaaaccgaggcccctgccatcctgctgagctgggtgaggttgtatttgaagaagcaagcaagccgtaacctcctggctgtccaccgcagcgcgctcctcaccacagttcttcactgatgaagcagccctcagccgtggcctgggggcactgggcccctgggtcctccagaccactgacatctctttaaatgactcagctcggccctggttctcgtctcaccagtggcattgtctgtaagagaaaccagagggtctgtggggaaagtcataacctgtactggggcatcagggtttggtggctgggccaccagaatgtgcaagggcaggtgtggggagggggcagcatgatgggggcagacccatggggcttcccacaagtgcacaaccccctctggcaagtcctctaaccccatcctttcctctggggcggcctggatgggaatattagaaaggctcgtgggtgtgagtttgcctgtggggtttacacatttacaattacagaccaagggcttgagctctaggctcagcatcctcagacacactaggaataaaacccacctcccacccaggctgaagcgatgctgcacctggggctccagagcagcggagtccgtggtgagaccagaccccatcagagggctgctctgcaaagagccccacgaggaggcctggtgtctgagcgtgggaaggcttcacacagcagggaggggacatctgtataaagcaaagaactgccccccagggaggcccaggcatgagcacaacaaagctccaagccctgcctatggggcctgttccacccttaactggcaacaatggggaggtgggcagctgatgcaagcactgtggagaccgagtcaccgggctctggactcaggacaggcagcagcatagccggggtgcactcacggccccaggatgggaaacgtgctccttcaagcactcggcccgcatcggcaagtgctttctgtagagggcacaatggtcagtcgttcaggcttttggggccacactgcctctgtcacagctactcagctcagccactgctacacaaaagattgtcaatgaatgagtgtgactgtggtccaggataaatgctggatgtggcccttgggctgtagtgcaccaaccgtcccctgaggtcacgtttaccctgcattagaaatagccctggctggtgtccatctctgcgcaggctgggccaggaccgtccgagaggggcaggaattgtggggcatctctcccactccccgagggtaagcaggcatggccacatataggtgacagcagccttctggtcagctcgagtcaggtgtgtcacatccctgggtggagtctggcctggaccccaagcctacagccatcgcagcccggcagccgctggagagagaagactgacacagctctgggagccgtgtggtggggtgggggctgggtgccagggcccaggagggtgtccaggtgagctgcgggaagcctcggaggcctggcccctgatcctgggcttgctcctgccaactggccatggctgtctctgccctcccagggcaatagtgaggtcagacaggagaaaagacatgcagacactcagcccctgtgtcagggaatggtgggcgacacagcctctccacagaggaccgaggctgagggggtgggaaggaggtgcagggaggtgagggttctgggaagggagcccggagtggtggagcctcttccccagacttcagcaggaacggtatcttcccacaggtgtgacgagaactgcttgagctgtgcaggctccagcaggaactgtagcaggtgtaagacgggcttcacacagctggggacctcctgcatcaccaaccacacgtgcagcaacggtgagcagcagctgggttaccctggggctgcctgtggaggagctcagctggccagctcgtgctccaaagagaaaagcaaagccacataggcatggcggctccacagacaggcgttcgtgcccctgatccgattgactgtctgggattcctctagctgatatggaagacagctgccctgtctcccagcttccctctaggcctctcacatcgatcagagaggcatcccagccactgctgatctgtttattgagtgactcctaaaaatgattttgtccttgtactggtcccactgccatgccataggccgccggtggcccggatgtgacgacataccataaaagaagcctgacctggggggtcaaagccaggaagcctggagggtctctgctcaggacgagggggacagagcccagagtagagcacacgctcagcagcagcaatcccagctctgcagggatccagcatggacctgcatctgtgctgcaggagagccctggctctgccataggatgggggacaaggacaagttgtaaaaacagaaacttaaaagggcaccaaagctaagtgcccagtttgggaattccaggcaccaaggagggttggcaggactcgggcctggaggtgcagtgcaggagtcattgtagacacacgggcagggaagggggctctggcccagcaagcagcagggtggagccacattctgacagccaggagaggaaggctctctgctccagtgtccagggtcagggcaggtggtccttgggtatgaagctggcactggccctgtccaggcagagcatggagcttgtggagggccctgggatgcctccttgccttgttactggttattatttttggggggtggcgggagggttgtctaattatgtcccttcaaaggcccagaaactacttctttgggaagtcacctgcccaggttatgtatctagcccaaaaaagtgtggttgccactggagggcctcccaggtccacggatgatgcatcctcaaaggcctcttccccttgctgcagcggtgtcctcagcaagtcctgtccacggcggctcccttccccccatccccactcctccctgtccgccccctccaccctggaagcagcttccattccctcctgcctccaggcccgtcctccggcctcccctacagtcttcctcctaagctccactgccagcagttgtccagaaagacaggtgcacatgtgccccacaggcccaggctgggtgttctcctgagatccctcccacaccacccccacatcctgctcatgaatccccttgtcactgagactcagcaagagccccatataccagtgccctcccgccacacagggctcccagagtcaagtgcattgcaggagaggggcttcaagggctgccatcctgctgcccacctctgtctgtgtccctcttgcccagggcaccactgatgcccagcatatgtggaatgattgaaacaatatttatttatgtatttatttatttatttttgagacggagttttgttcttcttgcccaggctggagtgcagtggcatgatctcagctcactgcaacctctgcctcctgggttcaggtggttctcctgctttagcctcccgagtagcttggattacaggtgcccaccaccatgcccagctaatttttatattattagtagagacggggtttcaccatgttggttagactggtctcaagctcctgacctcaggtgatccacccacctcggcctcccaaagtgctgggattacaggcatgaggcaccgcgcccggccttgaaacaatcttcacaggcaccgaagactgacctttccctcttttgcctttcctgatgcggggccccagctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggc

SEQ ID NO: 36916 - DNA, 21592 bp, Homo sapiens
gatacttctggcgagcgccggttgctgtttcttctcaggctcagggaccggccgcggccccgtaggggtgagttccgactgggcggaccaggtgtgggagcgcgacgagaactgcgcaccgaggtctttcttccgagcaggcctcggagcggggcggacccgggcccgggggcgagcgacaccctcgcttccgcggacagtctcatcccgcacggaactttgggtggtggaggcggcgggtccaaacgctgtctggagccaacgtctgccaggctgaacctcaagtgtgcgggactgaacccgaggaaatagcccagtgcccgggtcaggtggccttgttcgcgagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcacgtaggtgttgttattctggttgtacggaagactgaactgaggtgaattacgttacccaagaccatacaagaatgacagaaacgagacttgatttcaagcggtcatttttcagaacccatcactcttttttgtcgcccatgctgcagcgcagtggctgttcacaagcgcacttcagcctggaactcctgggctcaatcggtctcccatctcagcttgcagagtatatgggactacaggcgctcgccaccttgcctggcttacaacttatcattcttgtttttttttttttttttttttttttttttttttttgagacggggtcttgctggagtgcagtgacgcgacctcggctcaccggaacctccgcctttcggattcaagcgattctgctgcctcggcctcccgagtagctgggattacaggcacccgccaccacgcccagctaagttttgtatttttagtggagacagggttttcgccgtgttggccaggctggtcttgacctcccgaccttgtgatccacccgcctcagcctagagcttacctttttttttttttttttttaaccaagtcttactttgttatctaggctggagtgcagtggcgcagtcttggctcattgcagccttgacctctctgattcaagtgatcctcctgcctctagcagcctccttcctgtagctaggaatacaggcacgcgccaccacactgggctaacttttgtattttttgtagagacgaggttttgccatgttgcccgggctggtgttgaactccggaactccagcgatctgctcgcctcggcctcccaaagtgctagggttaccgtcttgagccactgcgccgggcacaacttcttattcttaatgaggatttattctgaatccctcaaaagtgactaggttcaagtgttcagcaccatagcttgctgtgtcctgatgtaggctgaattatttttctttttgcagtgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatatttttttaagtaagtggttttcttaaaggagatttaatttctttgccctcatttttccattagaacaacgcttcttcggtgaagttcttttgtacttccaaatgtcgcaggtgagcccaaaatgtattctaatattcagttgacattaaaggcagatttaacacactaaagctgtgtctagattgagcatacatggagaataaaatacgttgaatgttaagtcattagcaaaactggactaatttttctcggttcattattagtatattcataatactatctctaagtatttttaatatagtgggaacttgccttgaaattaatataaatattttacgtctttcttggtttgcatggtaatgtactcaggaaacctttttagtaatttggtaagaggcattggcaaagtacctcttttgctaagatttgtagcatcatttgggatgttagtgagtacaggcataccttgcacttcactttattatgcttcacagatattgaaatttttccaaattaaaggtttgtagcaactctgctttgagtatttttccaatagcatgtgctcactttgttagctttttttttgtttttgagacggaatctcgcactgtcgcccagggccaggttcacaccattctcctacctcagcttcctgagtagctgggactacaggggctcaccaacatgccaagctaattttttgtatttttagtagagatggggtctctccgtgttagccaggatggtcttaatgtcctgacctcgtgatccacccgcctcggcctcccaaagtgctgggattaacaagcgtgagccactgcacctggccaaaaattctttatattttataacactggctcattcagagtacatgtgaaagtttgttttgggatgttgcccaggtttgattatcattaaaaatacttttatctatgaagaaaaaaaaacttataaagaaaatgattaactttctctttgcttcttagtctgatgaccgggattccaagcgggattcccttgaggagggggagctgagagatcactgcatggagatcacaataaggaactccccgtatagaagagaagactcaatggaagacaggtgagcggatgtacagatgtgcaagacccaactgtacacagccctggcctggccagtccttcctagggtcactgtgacaactgtgtgctattgtaactattaaggtttactctttcctagagttaccgtgacagggcgtgttgtagctgttgtactactgagattactctttcctaaggttaccgtgacagggtgtgctgttgtaactattgaggtttactctttcctagggctactgtgacggggtgtgctgttttaactattgaggtttactcttccctagggttacgtgacggggtgtgctattgtaactattaaggtttactctttcctagggttactgtgacagtgtgctcagtgtgctgttgtaaatactgaagtgtactctttttttttttgagacggtgtctcaagagtcttgctcacccaggctggagtgcagtggcgccatctcggctcactgcaagctccgcctccctggttcacaccattctcctgcctcagcctcctggctaacacggtgaaaccccgtctctactaaaaatacaaaaaattagccaggatggtctcgatcttctgacctggtgatccgtccacctcggcctcccaaaatgctgggattacaggtgcgagccacgacctaggattactgtgacagggcatgctgttacaactattgaggtttactctttcctagggttactggtgaaagcctgtctctactacaaatacaaaaattagcctggcatggtggtgtacacctgtagtcccagctactcaggaggctgaggcaggagaattgcttgaatgtgggaggcaaaggttgcagtgagccaagattgtgcctctgtattctaccctgggggacatagcaagattctgtctgaaaaaaataataagtccgggtgcgatggctcatgcctgtaatcccagcactttgggaggctgaggcgggtggatcatgaggtcatgagtttcagatcagcctgaccaatatggtgaaaccccgtctctactaaaaatataaaaattagctgggtgtggtagcgcacgcctgtactcccagctactccggaggctgaggcaggagaattgctcgaacctgggacaggaggcagaggttgcagtgagccaagattgcgccgctggactccagcctgggcaacagagcgagactccatctcaaaaaaataaatacaggccgggcgtggcggctcacacctgtaatcccagcactttgggaggctgaggcgggcagatcacaaggtcaggagatcgagaccaccctggctaacacagtgaaactccgtctctactaaaaaatacaaaaaaaattagccgggcgtggtggtgggcgcctgtagtcccagttacttggaaggctgaggcaggagaatggcatgaacccaggaggtagagcttgtagtgagccgagagtctcgccactgccctccagcctgggcgacagagcaagactccaatctcaaataaaataaataaataaataaaattaaattaaataaataagatgtgatgtatttttacatgcccctgaaactgtcaccacagtcaagctaatgaacctgcccctcaccccctgcaggtcctctgagaggcatttcgttccatctgcacaaaacattgatttcttacatttttcatctgaatcttaagactcctaggccgggcgcggtggctcacgcctgtaatcccagcactttgggaagccgaggcaggcagatcaccaggttaggagattgagaccatcttggctaacacagtgaaaccccgtctctactaaaaatacaaaaattagctgggtgtggtggcgggtgcctgtagtcccagctactccggaggctgaggcaggagaatggtgtgaacccggaaaggtggaggttgcagtgatccgagatcgcgtgtctacactccagcctgggtgacagagcgagactccgtctaaaaaaaaaaaaaaaaaaagatgcctgaagttggagaattaatgtaattttttaaatgatgtttcagcttcgttcctatctgaatcatgcatttttctgggttgaaaaaacctcataatagcctgatgcttttccgcactttctcaagcatgacgcagtgctgttgtgttttatttcagaggagaagaagatgattctttggccatcaaaccaccccagcaaatgtctcggaaagaaaaagttcatcacagaaaagatgaaaagagaaaagaaaaatgtaggcatcatagccattcagcagaagggggtacagaagcatttactttctttgacatcatgttcaagtgtggtttctttcctgttcctactcttctgccttccccagagcaccactgaaaaaccagagaaagcaaactgtagctgaaagcataatggtgtcacagaccgttcagaagggctatagagagaatagctgaaagcatgcatgtgtcacagaccattcagaggggctatagagagcaaactctagctgaaagcatgtgtgcgtcacagaccgaaaaccagagagagcaaactagctgaaagcatgcgtgtgtcacaggccattcagaagggctatagagagagcaaactctagctgaaagcatgcgtgtgtcacagaccattcagaagggctatagagagaatactctagctgaaggccgggcgtggtggctcaagcctgtaatcccagcactttgggaggctgaggcgggtggatcacaaggtcaggagatcaagaccatcctggctaacacggtgaaacccagtctctactaaaaatacaaaaaattagccgggcgtggtggcgggcacctgtagtcccagctgctctggaggctgaggcaggagaatggcatgaacctgggaggcggagcttgcagtgagccgctatcgcaccactgcacactctagcctgggcgacagagcaagactccgtctcaaaaaaaaaaaaaagaatactctagctgaaagcatacgtgcgtcacagaccgttcagaatggctatagagagaatactctagctgaaagcgtgcgtgtgtcacagaccgaaaaccagagagagcaaactctagctgaaagcgtgcgtgtatcacagaccgaaaaccagagagagcaaactctagctgaaagcgtgcgtgtgtcacagaccattcagaagggctatggagagcaaactctagctaaaagcctgcgtgtgtcacagaccgaaaaccagagagagcaaactccagctgaaagcatgcgtgtgtcacagaccgttcagaggggctatagagagaatactctagctgaaagcatgcgtgtgtcacagaccgaaaaccagagagagcaaactccacctgaaagcatgcgtgtgtcacagaccattcagaagggctatagagagaataccctagctgaaagcatgcgtgtgtcacagaccgaaaaccagagagagcaaactctagctgaaagcatgcgtgtgtcacagaccgaaaaccagaaagagcaaactctagctgaaagcgtgcgtgtgtcacagaccattcagaagggctatagagagcaaactagctaaaagcatgcgtgtgtcacagaccgaaaaccagacagagcaaactccagctgaaagcatgcgtgtgtcacagaccattcagaagggctatagagagaatactctagctgaaagcatgcatgtgtcacagactgaaaaccagagagagcaaactctagctgaaagcatgcgtgtgtcacagaccgttcagaggggctatagagaggatactctagctgaaagcgtgcgtgtgtcacagaccgaaaaccagagagagcaaactctagctgaaagcatgcgtgtgtcacagaccgttcagaggggctatagagaggatactccagctgaaagtgtgcgtgtgtcacagaccgaaaaccagagagagcaaactctagctgaaagcatgcgtgtgtcacagaccgaaaaccagagagagcaaactctagctgaaagcgtgcgtgtgtcacagaccattcagaatggctagtccatttttcctctggggttttctctcccccattatattgtttgggagcagtttgtttacatttaaaatgacctgaattcaacaagtataggagaaaaacacaccccaaaatgggtatttgctcaagtccaaagaatgggttaggcttgagcagtttgatctcgtaccaacatcaggagattcttacgggtgttaggaaaattggacctggagcccgattgaaatctcattattataaatacgcttgattaattaatgtggcttcattgcacagtggagaagcccactgatagcaaagctttgttctgtagtctttgtgaagagtggtttttgtattataaaactgataattatagtttattcagtatagaaaatttttaaaagatgaatattacaattctcttctgtgatagcagaattgtttttcttttttcttctttcttcataattagacgcttactgcagatagttttctattttcaaagttttttatttaacataaaatcatgattattcgactgggtgcagtggcccaggcctgtaatcccagcactttgggaggacaaggatggaggatcacttgagcccaggagttcaagaccagcttggccaatatagtgagaccctgtctcttcaaaaaaaaaaaaaaaaagattaggattacttaacatcattatttaaatatttaatgttcttgatttaatttcattttcatgtgattttttttttttttttttttttttttttttttttttttgagatggagtctcactttttcgcccaggctggagtgcagtggcacgatctcggctcaccgcaacctccacctcccaggttcaagtgattctacagcctcagcctcccttagtacctgggattacaggtgcctgccaccacgcccagctaatttttgtatttttagtagagacggggtttcaccatgttggccaggctggttttgaactcctgacctcaggtgatccacccgcctcggcctcccaaagtgctgggattacaggcgtaagccaccgtgcccggcctcgtgaaatttttgaagtgaggtttctttgcatgacactttatttctcattagggaagcatgctagagtgaaagaaagagagcacgaacgtcggaaacgacatcgagaagaacaggataaagctcgccgggaatgggaaagacagaagagaagggaaatggcaagggagcattccaggagagaaaggtgagtgggctgggtcagttgaggactttatgaaagggccgtggtagtgtgtcctgtcacagcaatgaagaagaatttggcaatagaagtcacatttgttgcagaagtggtagacatggaaacagcacagtgaacgctggacgaggctgaccaagagaactgtcctgagggagtgagttttcactgcatctggaagtaagaacgggtgtgatttgattgagggaagacaatgaagggatcagaaatctgcacgtcccgccgggcgcagtggctcacgctagaattccagcacttacgaggctgaggtggttggatcccttgagcctgggaggtcaaggctgcagtaagctatgaccatgctactgcactccagcctggttgacagagtgagactgtctcaaaaaaaggagaagggagatcccaaaaaccttgaaacagtctggaaatcgggacactggactcctaggactcctggccattagtctgtatattcgttcccctttatgagccagattcccaagaaagaacatcggtgtagccccagatctgttctgtgaaccaggaaaaaggctgtaggccaggtgcgagcaggcccatctccgccttcagagtgagtccacagaaagcttgcaagctgctccaggaagagaggagtctgaagcggaagggcgtgtgcagcgatgtttgccagcagccagggctgggtacacagcatgtaaagatgatgagagggcgctggttcttgttgatgccgaagggtgtgggagacactgaggcccaggggtcaaggtccgagaccgctgctgggtgagcaaggtttcagttggcctagttcctgttagtgtgtgaaacattcatgtatgccacgccctgtgccagacattgagtgtgtcttgtcccacgagagtagagcttgggatagaagtggaggttggtagatgaaatttgggctgtcatattgatttcccagaaggtaaagacaggagagtgaatgaacaaaaattgttgggggcagacttctgggtagggccgattcagatcagccaatccagaactgggtgtggtagcatatgctacgtgggaggctaaggccagaggaccgcatgacgccagcctgggcaacgtagagagaccttgtctctgacaaaaaggaaactgataaggataatctgagaagcactgatgcttggaaaactgctgagctgtgggtaaaagcagtaagaatctgaccttctggcctgagagctgctccctttactgcttccactctgcacttggaagcacggaggttccactgggacagggcagctgcaggacctgcagtttccttgctgccttggaaggggttactccgtttagagcagtgggcagtggccttgcccaccagcatcctcagtggagggaggaaaaggccaagaggtctgctagaatgaagtacagtgtggttgggagcagctgtgatcccgccaaagacgtgcagcagagactggagagagctcgagccgccacccacttgtgaccagccctgaggatgcagctgcgtgaaaggacctagcagaaaatagaagccgccacagatgcgaatgacgcctgaacgttcagtgtgctccctgtccacacacagccgtgggccaaggaagccttactgtgctcgaggtatttgagcccagcctttttccagtgctggctaattgctaagctgtgcagccatggtggtgacccctaggaagccaaggttgaaaattaaaataggcatgtgggaaggaacggggtggccatgagctatgagggagatggatttcacggacaaccagacaggccttggtggtaacaacgaaagggaaaacttagaatccagaattgctacaaatgtattatctaaaatacaaagaagtatgacagtgtgacccgtactgaggaagaacatcatcagtagaaactgtcttgagtgtccagatgttgaatttagtaaaggcttggaaacaacttgtggatggagcagtagaaattatccattctgaagaacagagagaaaaaaacaagaaaaatgcacagagcctcagaaacccgtggtacaacatctgctgtaccaaagcacgtcgaatgggggttccaggagagaggaaagatatttgttacaataatggttaaaaactttccaaattttaattaaaaaatatgcacattcaagagcacaggaagtttgaactagaataaatgcaaagtcacatcatagtcaaactggcaaaggccaaagagaaaatgttgaaagggctcagagaagaatgacccatcccatgaaaggggagcttcaataccgccagccactgacttcttagaaacaatggaggccagaaggcagtggagtggcatactcaagctgcttagagagaagaaccatcagccaggaatcaaaactgttctacacaagtgaaagggaacgaacgacattccctgagaagcagagactggtgggattcattgttggcgaaacctgccttaaaggaaatactaaaggaagaccttcaagttgaatagaaatgacaccagacggtaacttgaatcctcaggaaggaaggacaggcactgcagatagcaagtgtaggttgacgtcaatatcctgtaaatatctctcctcacatcttaggttttactggaactacgattgtgtaaaataattacactgttgtcgtggtatgtggcataaatggactgcacaaagaagacagggaatgaagctgtgttacaacagttttatattgtactggacttgagctagtatcatgaggcatatggtgatccctagagcaaccactaagaaagttgttttcttagtgttctaaaaagtacaaataaattaaaatggtatgctaaacgtatgtaatttaaaatcaaaaagggaagaataaaaaagacacaacaaagcaaggaaagtaaatccaactgtacgtgtaattatatgacatgtgaaaggtctctgtgccccaaacagacagggcagattatcagatagaaaaacaagatctaactgtatgctgtctgctagagaacaggaaaagacgcagcgtacaaacatcagctgtcataggagagcttgaatggctgtactcataccagacaaaacagatgttaagaaatattagaaaccagcctggccaacatggtgaaaccctgtctctagtaaaaatacaaaaatcacctgggtgtggtggtgcacacctgtaatcccagctactcgggaggctcaggtatgagaatcacttgaactcgtgagatggaggttgcagtgagccgagattgcgccactgcactccagcctgggtgacaaaccaagaccctgtctcaaaaaaaaaaaaaaagctagaaacaagaaggagcaaggacttcacagccagaaacaggccaatacagcaggaagatacagcaatgatacatgtgaatgcatctaaccacagagcccaaaatccatgaagcaaacaccgatcgaatggaaagaaatggatcatttattaattagaattggaaatggcagctgggcacggtggctcgggcctgtaaacccagcactttgaaaagcggaggcaggcggatcacgaggtcaggagattgagaccatcctggctaacatggtgaaaccctcgtctctactaaaaatacaaaaattagctgggagtacagggcgcacgcctgtaatcccagctactcgggaggctgaggcaggagaatcgctcgaacccgggaggcggaggttgcagtgagccgagatcgcgccaccgcactccagcctgggggacagatgaagactccgtctcaaagaaaataaaataaaaaaatgaaaaaaaaacttcacggattgaattacgtagaaagccagcttacaaatgtggacaaaaacgcgataagcaagcttctgtttagggggaatgatggcgtgtgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaaggtaggcggcgcggtgggcagctgtgctcggcgggacgcgtgtctgctgccccctggtgctgggcacttgctgtcacaggcgggcgcttggttccggtgcttgcttttcgcccctgcctttttttttttttttggaggcagagttttgctcttgtcccccaggctggagtgcggtggcgcgatctcggctcactgcaccctctgccccccgggttcaagtgatcctcctgcctcagcctccggagtagcagggattacaggcacccgccaccatgttcagctatttttttatatttttagtagagacagggtttcaccgtgttagccagaatagtctcttgatctcttggcctcgtgatccacccacctcggcctcccacagtgctgcgattacaggcgtgagccaccgcggccggccagtacgagcttttatagtcacccacgtcctcaccttaatggagatctttatttcttcacccagcttccggtttctgtctcgcgtcctttccttacaccccacacaactccctggagcttattcttcaaggcaggtctaggtctagtagtaatgaactccctctgcttttgtttatctgagaatatcctcatttctccctcatctttgaaggaaagtttgctggatacgtggttcttggttgacaattttgttgttgttgttttgagacagagtcttcttctgttgcccaggctggagtgcagtggagcgatcatagctcactgcaacctcgaactcctgggcacaagtgatcttcccacctcagcctcccgcgtagctgggacctacaggcgtagcgtgtgccaccacacctggctcatttttcagtagaaacaaggtgtccctgtattgcccaggctggtcttgaattcctgggctcaaggaaccctcatgcctagctgacagtttttccttttcacttggactatttcagcccattgtcttctggcctccaaagtttctgatgagaaatctgatgatcttatagaggatcccttggatgctttaatctgatgacctaattgaggatcccttggatgctttgaagattctctttgccttaggctttcaactgtttaataatgggttttcctgtgggcctcttgacttcattctacctggagttcactgagcctctctaatgtttatatttacggttttcatccaatgtgggggttttgaggaattcttcagataccctctctgctcctctcctccctcctgggctcccacagatctgttggggtccccgaggccgctcagcactgctcccttttcttcagtctcttctgctttcttttcctcagacgatgtgattttattgtcttcaggctcaccgattatttcttctgcctgctcacatctgcctgtgagtttctgttgtgaatatttactttttagtgtctattgtgagcatgtacttattagctctggaatttctctctggtttcttgttggatcttctgtctctgttgatatttccgtcgtgttcacgcgtcattttcttgactttctccacatcttcctttcgttctctgaggaactgaaggtttaagacagttccctaaaatctttgtctgggacatctaccgtcaggtgattttcaggaaccgtgtctgttggcttctttttttcccctctgaatgggacatactgtcctgtttctttgtttctcttgtgtttttcttagtcaaaaaaatggacatttgattctcatgatgtgattcttcctggtccccactcaagggtgtgcacttgttgttttggttgtgctgggctgtgtctgtggggtcggcctgttgtggaaactcagggtcttcacgggtcttttctgagcctgagccttttcctggtcacgtgcagccactttttaacgttcccgtcaatacagatgtttttaatgttcttgtcctgaagtgtctgcctcctaaagggggaatagagagaaatgaagggggcaacgggggacgtggtgctcatgccctggaagtaccttcagcttgggggtggccgtggctgctgcctcttcatgcctctggggtgggacacgcagtcatcacactgacctcgggtgtgtgtgtccgtctgcccacctgggtccggcgagctgcatgcaggctgctgcctgccagcggggagtgaggtgggagccactaatgtgcgaagcggtgacgttgattaatgaatcacagtttactctccaagattccccctgaagttgcaaaccttcagtagactccagagcacctcagtagttgcacaggcctgatcctgtgatgcaagtgttgtctcggtggggagactgattcccagtgcttcctactccatctttccagaatcttctcccgccccttcctttttgaccagtgaagatcagtctagaaggtccacctgggtcctcgggctcacggcctccaggttggagctttttctccctgggcttcctgggagacctctggcctctgaccccgatgctgtcagcaccctgtgcacgctgtgggtgtgtctgccaggtgcgggtgtgggagacgaggcagctgtgccgggtggggccttttgaggaaggcagtgctgctagtgccatctccctctctgccctgcgcgccagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagtgtgagtcttttctgggggatgtttggcataagtgtgtaggattcatttaaagcccagctaagtaaccgcttcagaagaaagtgagagatgtgctggctgaagtcctctcgtgtcgtgagagggaccgtgagtgtctgtgtgcggccaggacacaggacgtgtgtttatccgctgggacattcgccactggccccgttagagaagtggcttccagcgtctgtggatgagctggtttccgaccaagcaaagttaatcgttacgtgaaaggcactagttttggggtggtggtagcttgtttgtttaaaaacatttccccaaattcacctttatggtttatctcataagtaaaagaagagaaaatggaagaaagggacctgctgtccgacttacaggacatcagcgacagcgagaggaagaccagctcggccgagtcctcgtcaggtacctggaaccgcctggccaaggccttgaccactgctgcccaggaaggcccaggttcaccctctgctctgctgtctttctacagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccggtgaggcaccgcgacgactgtgtgaggtgttgtgacttcactatagtgttagaaaccgcagagaagtagctggcgggcgggggagttgaaactcccttctatctaggactctctcgggacacctccacatcgattctttttgtttgtttttttgagatggaatcttgatctgttgcccaggctggagtgcagtggcatgatctcggctcactgcaacctctgcctcccgggttcaagtgatcctcccgcctcagcctcccaagtagctgggagtacaggtgtgcgccaccacgcccggataatttttgtatttttagtcgagacggggtttcaccacgttggccaggatggtctcgaactcctgacctcaggtgatccacccgcctcggcctcccaaagcactgggattacaggcgtgagccaccgcgcccagcctccatatccattcttgggaacacttgttgcttagctgaagcggagcccgcatcctgcctgtggcagcactcgccccggtgctggtctgagcagacgcctcctttctcttgcagaagaagtaagtgaggaagaaatgagtgaagatgaagaacgagaaaatgaaaaccacctcttggttggtaagaacctccctggagacagagccccctccttgtctgtctccgagtgcagcagccctctcctaagacagccggtcctgcgcggcgtggggcacgccagggtctgggaggccgcctgattcgttggccgctccaggctgtgccggtggggcccgcattcctcagcgaggcacagtgctgaccaagggcgtcctgagtgcccagcagggccgaggagctgggaagcccaggaccagttccccacaggggaggcccgtcagatggtggctccgggcctgtccctgcagaacagaggcctggcccagcctccgacaggcagtgaggttatgtcctcagcctggtggacgtggatgtgggcttgtcccccacatgacacccgacgcctcctcccagctcagcatccgggctctgtctcagccgagcctgccagcactcttaggcctcggtgccctgtgtccaggggacgagagcccagcgccagcacctcccagcgggacacggggcagccctgccacgcgcttgatgcccccggggcaggaggaggttcatgatccttacttactcctagcttcgtaattaggttcaacttttccagttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcaggtcaggccctcccctcgccccgggccgctgtccgcattggcagtcggagttaccacaggggctgagcgaagcctggcccccgtgttggcgtctgtcgcctcacagggctgctgggcccactggggcagtgacgggcgggcacagccactggcccctcatgcttctaggtcccgcctctttctcatgctggacggaactgggtggacagggagctgcccgcaggactgctctgcggcttgaaaggcagcctgggcgtgcggccgcgctgctgtcactgctgcccgagttgcgtcctcctccgcactggagagcagtgccttccacttgacccctgcgtgggcgggttatgtaggcaccaaggccttgttaccggcatctgtgcagggcttggatgggggagcggctacgggagtcagtgtagatgtgtgaccagaagccttttgctcaggcagctatcaataaggcaggatattgttgggagtgatttggaagggacaagcctgagaaggtaccagtggcctcgggggcctgggagaccggcagggactcggccccctccttggtgcctgtgggcggagaggttctctctggcgcatgcagcaggcctctgtcgactgccctatgccttgtgagcgcctctgccccttagtgctgctgagcgtaggcgtcgggccacaggccacccagagtacgtgacatccggcctgggcaccggccccaaggtacaccgaggggtaggtgccctggcatggggcatcatgctgcgcctggcaggtagggcccgtcctcagtgtcatcctggtacaagcaggggacacatccactttgacagagagactctccggatggccttttttttggagactgggtctgtctctgtcatccaggctggagtggagtggcttaatcatagctcactggagcctccacctcccaggctcaaacaatcctcccatctcagcctcctgagtagctggaactacaggcgcaagccaccatgcctggctaatttttttattttgtagagaagagttttggccaggcacagtggctcacgcctgtaatcccagcactttgggaggccgaggcggtgggcggatcagaggtcaggagttcgagaccagcctggccaatatggtgaaatcctgtctctactaaaaatacaaaaattagcctggcgtggtggtgcgtacctatactcccagctactagggaggctgaggcaggagaatcgcctgaacccaggaggtggaggttgcagtgagccgagatctcaccattgcactccagcctgggtgacagagcgagactccatctcaaaaagaaaaaaagaaaacagagtgttgctatgttggccaggctggtcttgaactcctgggctcaagcaatcctcctgccttgccctcccaaagtgctggaattacaggcctgagcccttgcacctggctgggatggccttttgttcacactggttttgtttcataataaagtgtcagatggttttgcaaggaaagagactttgaaagaactgagctgctcccagctccacccccggcccagtcccaaggctctgccctgcacctgccccgtgctgggtgtgccgtgcctgtggacgcagccgccctccctccagctggcatggccactgagacctcacacaggcgcttccttcccagggctgccggagcgtcgaggagttccagtgcctgaacaggatcgaggagggcacctatggagtggtctacagagcaaaagacaagaaaacaggtgggtggggtcccctcaccccacaaaggcaggggaagtggggcaggggctggctgcccgagagctgcgactgcacctgggcccgcttcacctgagcagctactggaggttggacccctcagcacctctagaagccagaggtcagcctggccctggggctttgccactcccttgcagtagcaggcggcctgccccacagggccgaggcccagcgcgtggagtggtctgtgccggggctggtgtgcaggtttgcgttcccagcgtcccacccaagcaggtgtgtgagccgggaactctgttgggagtcggccactgggatcccaggtgaggccggctctgttggggaagtcgatgtggagtcggcgtggccgctgggatcccaggtggctgtaggtggctgtgagtgtctgtggtgtgttgagtgggaagccgtgggtgttgccgagacctcagctggggcgttctcctggtgcccacgtgcccccacctagaacgagacccccctccgtgaaatgctggcgctttgggcactgcctgcggtcctcactgaacgagtccactgttggtaccgtgactttgagaatgcctctcagtgccgtctgtattttcttcacagatgaaattgtggctctaaagcggctgaagatggagaaggagaaggagggcttcccgatcacgtccctgagggagatcaacaccatcctcaaggcccagcatcccaacattgtcaccgttagagtgagcatggccccaccacgcctggccccgggtggaaggcttttccgacagggccccgtgctgtcctggggccgggtgcttcctacactctcctgcacttagtggagcccttcacagaccacacagaagcaagtatttgcctcccgggtggcaccggaggtccttactgtccctcagcatctgcgcccgggtgcaggggtgggtgggggcctggaggtgcccagcacccacagagccgtgccctgcaggagattgtggtgggcagcaacatggacaagatctacatcgtgatgaactacgtggagcacgacctcaagagcctgatggagaccatgaaacagcccttcctgccaggtacagccgcgccccggggtcctgtctgcgtacaagtgggggcagtgtcctggtcacccccgcggtgacagtgctgcagggagggccagctgcatccacagggaaagccctgagaagcctctgttgctgccgaggcgagcgggccaccctgagtgccctgggcttggggcggccgggtccacatgggagcctccctccctcccaggggaggtgaagaccctgatgatccagctgctgcggggggtgaaacacctgcacgacaactggatcctgcaccgtgacctcaagacgtccaacctgctgctgagccacgccggcatcctcaaggtgagcccccctccgagtggcccatcccagggtgacccgcccaggcccacccacagccgcccatctgtcgttgcaggtgggtgattttgggctggcgcgggagtacggatcccctctgaaggcctacaccccggtcgtggtgacccagtggtaccgcgccccagagctgctgcttggtgccaaggtgagtcctgggcgtctgagtgcctcccctgtcccccatgcagcctcccacagcttcgcgggcactggccttcctgaacacctctcctggcgtcttaggaatactccacggccgtggacatgtggtcagtgggctgcatcttcggggagctgctgactcagaagcctctgttccccgggaattcggaaatcgatcagatcaacaaagtgttcaaggtgggtctggccctgccgcaggtgcgctatggatttcagaggagttgcaggaatggggctgcggggcgcacaggtgctgggttgagatggggaccagggccactgagagccctcctggtggcttgtcttctctgacgggacacaggtgccaacactgtgggccacttggtgtggctgttgaagcacctctgtctttcaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagtgagcccagtgcagccgggtggcgggaggtcccgagccatagcggtgacttcccagtcccaggcctacctgctggctcaccacgttccagaactgctctggtgcctggcgtcccatgccctgagccccgtcccaacacagcccatctttgggggacccagtggagcacacgagcacctcctgggcctctggccctctccccccaggttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctggtgaggggcctggcgggtggggcgtgcccacaggtggggctggcttgggcagggttctcacggtagccgactcgtcccagggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggagg

SEQ ID NO: 36917 - DNA, 105936 bp, Homo sapiens
ggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcggtgggttctgcgtgcggggtgctctgctcggtgatcggtgcttggtgctgcgtgctcggtgctcggtgctgggtgctgggtgccggtactgatgctgagtgtgcgggcgtccggggtttccctgcccggattcgctcctgggggtcctttcctatggctggcgctgggcgcggaaaacgctggtggggttttcccagctggctttaagcgttttcacgtccgggagtccacggcgacccccacgccctgaagcctgggaacgcggtgtgcgtggccgcaaaaagaacaccaacaacagaaaaacacaaaacaaaacacgcaaaacactaaagcaaaactcccgacagccgagccccgttcggtgccttttctttttttttttctttaatggagtgaaatctactttgctcaggaagcctgcaaatcacattttcaggccaaacgaggcagtattttagaaggggtcgctgaggcaggagtaggaaggctttccactccactcacgcattttcagtgtaggcgaatcgtaaaacggagggcagaacgaaaatgagcggatctgggagtgcaggctgcgcttcgtccacatcgataacagatgtttcctggtgaagatgtgtagggcgcagcgggtcacctggtcgggggagggcacagggcgtccctccacggggtgcctttggcgttgggcacttgtgtggtctccagcttccgggttttggaagcggagtgtcccctgcagcctgagcctcttgcaggtggtttccttgggacgaactcccagggggaggtctgagttctggggcatggtttgaagatttgggacacattttgcctgaaattccctgctggccgtttgaacccacctggacttcctgaccaggggcacggattcttaacctctggtgcaggggcctggctaggagaggtctgcacagttggacgaggtgcaaagtgacgctttgtcagtaacccggcgttgagattcctgtggtgggacgagcagctcctatggctttatcccattttaaatccaagttttcttttccttctagtcctcgggctccacccagggagctgtgcccagacagcagaagggaaggatgtcacttctgagatgaggttcagaaaggcctgggctcctgtcctggctgctctctcccactccctgatgagcttgctggatgaaagctcctgtcaggctgtggggcgtcctgtggagaaactggcaagaaactggtgggggccctttccacctatagccagcaaggaactgaacccagccagcgtccacctgagtgagctcagaggtgggcctcagccccagttgagccttcggatgaggtcacagccctggtccatggtgtgactgcagcttcaggagggaccttaagccagaggtgcctggctaagcttcccgcagattgctgccccacaggagccaacatcaaaagcatttgttgttttgaggtggtaagtgtggaatgactgttacagggcagtagagaaggagcatgcacccttcctgcttcttatttgccttttagaaattgtcctctgtgaatcgcttgaacctgggaggttgaggttgcagtgagctgagatctcaccactgcactccagcctgagcgacaggagcgaaactccttctccaaaaacataaattctctgtgaaatatgttgttttgttttgttttttttcttttctttttgagacggagtcttgctgtgtcacccaggctggagcaggcgcagtctcagctcactgcaacctccgcctcccaggttcaagtgattctgctgcctcagcctcctgcgtggctgggattacaggcacctgccaccacgcctggctaatttttgtatttttagtagagacggggtttcatcatgttggccaggctggtctcgaactcctgacctcaggtgatctgcccgccttggcctcccaaagtgctgggattacaagcatgagccaccatgccccgccaatatttttttttttttgcctgtttttctaattggtttgtaggaattctttatactttctggttattaatcctttgtcatgttgcaagtatcttttgccaggttgtggctgttcatttcactttgtggtatgtgtgtgtgtgtgtgtatatgtatatatatatatttttttttcttttttttttttgagacagagttttgctcttgttgcccaggctggagtgcaatggcacaatcttggcttaccacaacctctgcctcccctgttcaagtgattctcctgcctcagcctcctgagcagctggggttaaaggcatgtgccaccatgcctggctaattttgtatttttagtagagatggggtttctccacgttggtcagactgatctggaactctcaacctcgggtgatccgcccacctcagcctcccaaagtgctgggattacaggcgtgagacaagtctggcctttttttttcttaagacagagtctcgcgctgttgcccaggctggagtgcagcggcgcagtctgggctcactgcaacctccccgtcctgggttcaagcaattctcctgcctcagcctcccaagtagccaggattataggtgcataccaccacacctggttaatttttgtatttttagtagaaacagggtttcaccatgttggtcaggctggtctcgagctcccgacctcaagtgatccgcccaccttggcctcccaaagtgctaggattacaggcatgagccactgcgcctggcccactttgtagtgtactttggtgaaacagaattcttcatttagccaagttagtccacctgaccctttttttaatgggtcatgcttttggggtttggttagagaaattattgtcctaccccaaaaagggtcaggaagacattctcttatattttcctgagcataaagttttacacatttaagtttatcataagagcaggccgcctgggttcgaatcatgacgctgctgctgcgaagccgtgtctttccttcgtgtgtctcacgtgggtgataacagcaccttccccagagggctgttgtgcagattcaccgctgtgcagagagtgcttcggaccctccagcagcacagtcagggctgtgtcagtgttactaattgtcgctgtttgtctactgataatgagatcagaatccagtttttctttttgcctggcagcatggacaactgtcctggtatcatagactgaataaagtttccttcttcagcaattcgtggtgcctccattccgcgtacaccagacctgtttgttttttttttttttttaagacagtctcgctctgtcacccaggttggagtgcagtggtgcaatctcagcttactaaagcctccgtctcccaggttcaagcgatcctcgtgcctcagcctcctgtgtacttaggactactggcacccaccaccatgtccagctaatttttgtatttagtaggatttcgccatcttggcaaggctggtctcaaactcctgacctcaggtgatacgcccgcctctgcctcccaaagtgctgggattacaggcgtgagctactgcacctggcctacgtatgtttattctgttttgctttttttttttttttttgagagagggtcttgctcagtcgcccagggtggagtgcaagggcgcgatgttggctcactgaaagctccgcctcctgggttcacgccattctcctgtctcagcctcagcgtcccgagtagctgggactacaggtgcccgccaccacgcccagctaatttttttgtatttttggtagagacggggtttcactgtgttagccaggatggtctcaatctcctgacctcgtgatgcgcccacctcggcctcccaaagtgctgggattacaggcttgagccaccgcgcccgacctcgaggtccttattcttttgcatttgtttactcgcccagccctgcaccaaggtctcagactgaactagaagtcctcatgtcttgggaggacggctgccgccccctccctgcgcctccgtctccttgcaggacgtgtttgtcttctactcatcgtgcgtgcatagctttctctctgattcacacatgctttgtgcgtgcatagctttccctctgtgattgacatgtgcctcatagggctggatctatctcgagactacatagcctcttgtttctaagctttatttttttctgggacagagtttcgctctgccgcccaggctggagtgcaatggcgcgatctctgctcactgcagcctccacctcctgggttcaagcgattctcctggctcagcctcctgagtagctgggattacaggcacgcgccatcatgcccggctaattttttgtagtagaaatggggtttgactgtgttggccaggaggatctcgatgtcctgaccttgtgatccgcccacctcagcctcccgaagtgctgggatcacaggcgtgagtcaccatgcccagcctctttttttcatttttatttttattttttcactacaaggctgccttgaaggacttcctttcgtgtttgcatctcgcttcactcacatgatgaaatctggctctcgtcatgtacaaaatgtttatgtgtttgcccaatccagaattctaacccatgagtcagccaaaaaaaaaaagaaaagggaggctgggcacagtggctgatgcctgtaaatcccagcactttgggaagccgaggtgggcagatcacgaggtcaggagttcgagaccagcctggccaacatggcgaaaacccgtctctactaaaaatacaaaatcagcagggtttggtggcacgtgcatgtaatccccactacctgggaggctgaggcaggagaatcgcttgaacctgggaggcggaggttgtggtgagccaagatcgtgccattgcactgcagcctgggcaacaagagtgaaactccatctaaaaaatgaaataaaaatacaaaaattcactgggcatggtggcgggtgcctgtaatcccagctactcaggaggctgaggcaggagaatcacttgaacccgggaggtagaggttgcagtgagctgagattgcgccattgcactccagcctgggcgacagagactctgtctcaaaaaaataaaagaccaggcacggaggctcacgcctgtaatcccagcactttgggagtccaaggaggtcggatcatgaggtcaggagatcgagatcatcctggctagcactgtgaaaccccgtctctactaaaaatacaaaaaattagccgggcgtggtgacgggcacctgtagtcccagctactcaggagcctgaggcaggagaatggcgagaacccgcgaggcggagcttgcagtgagccgagatcgcgccactgtacttcaggctaggcgacacagcgagactcccgtctcaaaaaaaaagaaagtagcatggaattagtcctgggcacccggcagcggcagccacaaagcccatcgagaaggtgcagctgccaggcagggcgtgaaggacccacagccccaggtctgccaggacgacagtcaagtgtgccaggagaccgtctctcaagagcaaggatccgccaacacgtgcagagaaaaacgggattcaattgctaaaaatctttggacagtgaacgattgtattttctttttttcttttcttgagacagagtctcactctgtcactgaggctggagtgcagtggtatcatgtcggctcactgcaacctccatctcctgggttcaagcaattcttctgcctcagcctcccgagtagctgggattacaggcgccggccaccatgccctgctagtttttatatttttagtagagatggggtttcgtcatgttggccagggtggtctcaaactcctgacctaaggtgatccacctgcctcggcctcccaaagtgctgggattacaggtgtgagccaccgtgcccggcccaattgcattttcaaagtgattttaaattggtggttgaaacctttgaggacattaaatgttcaaaacgggtgatgtgtttccttttcttaatattttagcgtctgcttctacgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctcgttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtaggcggcggctcgggcagggtggaagccggccacctgccaccccacagggagcagccagcaaccacccgggagggccgggggagcccaggtcaggatgggaggccgggggtggagcccactgcaggcacgggaggggtgattctccctcttgtcttcggccccctccctcccgcaggtgcggtgcagatgctgtccaccacggttatcgggtgtgtgaaaaccctcgttccttgctgtttatatcagcacaaggcccggctttcctacccacccaacttccttatgacgatgctgtttgtgggtctgatgaggtaaagaatctcctggttttggttgagtgtctctttttctttaaatgtaaagtccctctcgttactagagcggggactctgctggctggtgagttttcagtgcagactttataaaagcaccagggctgtccagatttcaggacaccaaatgaatgtggcttcgtggctctcactgccacgtgtgttcagtcagcttctttccgggctggtggtctcaggacagggtgcctccttgtctctgggacgttttcaaggggtggcagaagtcacttcccattggacgcagtgccgtttcctgggggctcgacctaaagcgtcacagaagcgggtccaggcaccatgttggtgatgaggaggtgggcggagaggggccgacgtgccaaccgagcgagcgagccccttggagagcctgcccggtgggtgcaggcagacagactcgttctaaggtgatggtgcttttggctcatttttaggtttgcaactgtggttttgggtttggtcagcctgaaaaatgtggcggtttcgtttgctgagacggtgaagagctccgcccccatcttcacggtgatcatgtctcggatgattctgggggagtacacaggtgaggccccccgggccccacccctccgcctgcgccccaccatcccaggcctccatccgtggtgcccgtctctgctgcctgccatggggctctgccgcgaggaccactcaagtggtgcccacactggcagtgccttcacttctctcacggtcacatgtgcgggggtgtcttggagcctggcgtctgccaggtgttctcacactggcatgcggaggtcagggcagggttgtgtctcgtggccctaactgggtggggagacaggtgggggctgggcagattcctggcaagcaagattactgcaggtgccaatcactgatccgaagaggacgggcgggggccgccttcggccagcaccatacaggcggccgtggcccctggtccgtgggccctcctgtgccagcaccccacagcctccccagcacccgccaccacaggcctgtcctgggccccagcccctgacctcagctgcaacccaggctcctgcctctcccacctcttaatgactcacaggcgatttccagtgacatgtcggccccatgtcgcgtacccagtgtggctgcatgaaaaccagcgaggagcagaggcgcccacagagcgcggcatcttgaacggagtaggggggtgcacacgtgttcgcttatttaagaaacgacaagatcttaaggccgagggaagtgtctgtctgcctttggggacgggaggaggccgagggtccaggatggggttgggcttgccccacatgcacttgagacccgcacacacgtttaggtgattataacaaaatcaaagcctaaaagtcaactctggtttttttttgttttttttcttttgttttttttatgtttttgagacagggtcttgctctgtcgcccaggctgcagtgcagtggcgaggtcacgactcactgcaacctcggcctcccaggcttaggcaatcctcccacctcagcctgttgggtagctgggacctcaggcatgtgccaccatgcccagctaatttttgtattttgtgtgtctttttgttttttcactgtgagtatacgttagtcatttttcttaacaattgaaactgggaactctggggattcagaattaacagccttggctgtgagcttcttatcgataccagaaaaagtttggaccttgcgttccacgttgttctgctgggctttgtccgaatgaacccttgtgagctgctgtgtccatttcacgcggattctcctgcccacaatttcacctgggaagaccgagtcctcgaggattgcgacgtgcgcagctgtcggagcgtggatcctgggacgcttttgcttattttttgtacaccttttttgagttggtttaggcagaattttcctctaagcaatagacgacatacttaccagtgaactttttctccaattcacgtactagccagacttggatgttctggaattatttcagtggcagaagaagaacaaagattatgataacttccttttttttttctttctttctttctttttttttttttttttgagacagagtgtcgccttgtcgcccaggctggagttcagtggctcagtattggctcactgcaacctctgcctcccaggtgcaaacgattctcctgcctcagactcccaagtagctggcactacagctgtctgccaccacacccagctaattctgttgtattttagtagagacagggtttcaccctgttggccaggctgctctcgaactcctgacctcaagtgatctgcccgccttggcctccctaagtgctgggattacagacgtgagccattgcgcctggcctttttctttttttctttttttgagacggagtcttgctctctcgcccaggctggagtgcagtggtgcgatctcggctcactgcaagctccatctcccgggttctcgccattctcctgcttcagcctcctgagtagttgggactacaggcgcccaccaccacatccggctaattttttgtatttttagtagagactgggtttcattgtgttagccaggatggtctcgatctcctgacctcgttgatccgcccgcctcagcctcccaaagtgctgggattacaggtgttagccaccacagccggccctctttttttttgagatggagtctcgctttgttgcccaggctggagtgcagtggcgcaatcttggctcactgcagcctctgcctcccgggttcaagcgattctcctgcttcggccccctgagtagctgggattacaggcacgtgccaccacacccagctaatttttgtatttttagtagagacggggtttcaccatgttggccacgctggtcttgagctcctgacctcgtgatcttcccgcctcagctccccacagtgctgggattccaggcgtgagctgctgcacctgcccatgataactttctcaccaccaccaacttcagtttccctcactgctgtaataatcagttccctgagctgggccttgaggtccgagttcatctccagctccagaagaatctgagaaggcaagaacaccagggtcaaccctcagtgcgtgtatgagcacccccagcctcatttttgtgttttctatagagatggggtctcgctgtgttgcccatgctggtcctgaactccttatctcaagtgatcctcctgcctcggcctcctaaagtgctgggattacagccatcagccgccgtgtccggctttaaaaagcaatcctaaaaatcgtaaacaaaatgacacagaggaaccttattgctcatcgagccatgcaagaaaggaaccgtttatttccagcaagtttaaaacatcgatttgacctccagccatggtcgatgagatgttagaaaaccaactctcttgctgacaacaacgagaaaatcttgataccatttagcaaaaagaagtctgtgggggaggcgttggagagtgacggaactgccacggcctgaggcacctggcttccggagcctctggcagcccagagaagtctctgtcttgtcgcccaggctggggtacagtggtgccatctcagctgactgcaacctccgcctccgggttcaagtgattgtcctgcctcagcctcctgagtagctgggattacaggcgcccaccaccatgcctggttagtttttatgtttttagtagagacgaggttttaccgtgttggccagactggccacgcccggccccgcattggggtttctgttgcattttcctgatgatggtgatgttcagcctttttcatgtgcttgttgtccatttgcatctgcatggtgaaaattaattagtgcaaaaaataataaaaacaaacaaaaaaaaaccagaaaatggatgagtgcacagttcagctgtcccctcgaggcattttcagggctgtcctcagtggcagcagctttacccagtttctgggcaggagtggcgctgggtgtttgtggtggatgattagtaaatggaaaatggaaaccaatagagtacccttttgtttgccacataggacgtcccagtgatcgggaggagtgggaagagcttcagctacaaccaggacgtggtgctgctgcttctgacagacggagtcctgttccaccttcagagcgtcacggcgtacgccctcatggggaaaatctccccggtgactttcaggtgagcagaggaacttcccaagagttgagtgtgtccaggttgtttacaaaggagaccagaaatctaggtatttttataagggacacatgtgattctcttccacggggatgactgtggctatgcagtgtaattactaggctattttatacccatgctgtttgaaatgcaaacgataggccgggcccagtggctcatgcctgtaatcccagcacttgagaggacaaggcaagtggatcacttgaggtcagtagttcaagaccagcttggccaacatggtgaaaccccatctctactaaaaatacaaaaattagccgggtgtgatgctgggcacctgtaatcccagctactcgggaggctgaggcaggagaatcacttgaacccgggagccggaggttacagtgagtcgagatctcaccactgcactccggcctgggggatgggagcgagagtccttctcaaaaaaaataaataaaacaaaaaaacaaatgagaaactgtaaaataaaccgtaaactgtgtgaaataggtatttagggaaatctccactagaagtctctgcgtttgaaggtttttgaaattgagtgctttctgtctagaatagcagggtgctgcgactagttttgtctgcaggaatggaatggtctcttctgggctgtccagtgcaggagccactggccacatacggcttctgagcccttgaaatgtggagaatataacaagaaccagattcggaattcaagctgattgctgtcagtttgaacttgaacagacacctgtggccactgcttcctgtgccatgcggtgcagctctagaaacggggaggatccttcagcttctttccacttctgtaactgggcagattgaatgaagctgcaatttatttgtttatgtattttattttattttttgagatggagtcttgctctgtcgcccaggctggagtgcagtagcgccatctcagctcactgcaagctccgtctcctgggttcacgccattctcctgcctctgcctcccgagtagctgggactacaggcgtccgccaccacgcccggctaatttttttttgtatttttagtagagactgggtttcaccgtgttagccaggatggtcttgatctcctgaccttgtgatctgcccgcctcagcctcccaaagtgctgggattacaggcgtgagccaccgcgccctgcctatgtattttatttttcccgaaacagagtcttgctctgtcacccagagctggatttctttggtttgatctcggctcactgcaacctccgcctcccgggttgaagtgattctcctgcctcagcctcccaagtagctgggattacaggcgcgtgccaccatgcccggctaatttttgtatttttagtggagacggggtttcaccatgttggccaggctggtctcaaactcctgacctcaggcgatccgcccgcctcggcctcccacagtgctgggatgacaggtgcaagccactgcacccggccaaaggtgcaatttaaagactggagactagccaggtggactggaggtcaaggcaggcagattgcctgatctcaggggttcgagaccaccctgggcaacatgggcaaccctgtctttactaaaacacaaaaaattagccaggcctggtgaaatgcacctgtagtcccagctgcgtgggaggctgaggcatcagaatcacttcagcccgggaggcgggtgttgcagtgagccgagattgtgccactgcactccagcttgggctacagagtgagactccgtctcaaaaaaaaaaaaaaaaaaaaaaagactggagactttttggtggcaaatacaaaggaatgaggttatgttaccagcaagtatcgataggagtccatgcagctggcatcagcagctggccacctcataccctgttgcggaaatcagcggaccttttttctgaaacttctgatctgtcatgaggaggtgtaattgtccccaaacatgaagtgaaaagccgacgttggggctggcggggatggtggacagtcaggtgtagctctccctcttctctgctttccgtctggtccaagtcagtgcggtaaattctcaaatacccatccgagctggtagctgtgcaccgcgcacgcagcgttccacagctgaggagctggagcttgtgcttcctctcacctgcaggtcccgcaggccctgcaccgagtcgccttgtccatggcgctgccctgccccatgcttcctgcgtcctgagtaggaggtatctccgagacaggaaaagtggctgctctctctgactttttctggaactcatggtggtctcctgggcttggtcactgtctctcaccagcatgtttctttgtgcggtcaggaattatttccaaatgctcctgaagcctagtgttttagtgaacattagtgattgttagcagtggttcaaaaaaaaaaaactttttttttttttttgagacagagtcttgctctgtgacccaggctggagtgtggtggtgccatctcagctcactgcaacctccgcctccccgctcaagtgatcctctcgcctcagcctcctgagtagctgggactacaggtgtccaccaccacgctgggctaatttttgttttttgttattttattttattttactttttttgagagatgggattttgctgtgttgtccaggctgatcttgaattcctggcctcaagtgatccacccaccttggcctcccaaagcgctaggactgcaattatgagccaccacactcagcccaattatttttcctttttttttttttttttttggagccagagtctcacgctgttgcccaggctggagtgcagtggcgcgatctcggctcactgcaaccccacctcccaggttcaagacattttcctgcctcagtctcccgagaagctgggattacaggtgcctgccaccatgcccagctaatttttgtatttttagtggagacagggtttcatcatcttggccaggctggtctcgaactcccgacctcaggtgatccgtctgccttggcctcccaaagtgctgggattacaggcgtgagccaccgcatgttgcccaattatttttcagtagtatttttttgttttatttaatttcattttataagagcagtgaattaagtacacattatggaaagtttgcaaagggtacttcctgtcaccctttttttgcacggtcctaacactgtgtacttggtacccttttcacccaacaaatgatctcaagggattgctttccctggggctacaaaggcactgtgagtgtgtgggagatgttcttgtttttttttttttttttttgagacggagtctcgctctgtcacccaaactggagtgcagtgagtggtgagatctcagctcactgcagcctcctcctcccgcgttcaagctattgtcctgcctcagccttccaagtagctgggattacaggcacccgccaccacacccagctagttatttgtatttttaacagagatgggatttcaccgtgttagccaggatggtctcgaactcctaacctcgtgatccgcctgcctcggccatccacagtgctgggattacaggcatgcgccacggcgcccggcctcctacagtgctgggattacaggctgagcccccacgcccagcttcccatagtgctgggattacaggcgtgagcccccgtgcctggcctcccacagtgctgggattccagcacccgacctcccacagtgctgggatgacaggccgagcccccgtgcccagcctcctacctgtggtggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagccggcggattcccatgcccggtgcagcctgttgccagccagcctttgagacccagagctccagggcttgtcagaggcagcatggggctccagtggtcccgagtctcatttccctgcctgctctttaggcctttggcacccatggtcacttcactggctttccatttggcttctcacctgggaaatacaaaaatagcccctcctgaagataaaatcgttcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaagtgatcctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcccgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccctgggtttccatttctttttttctgctttcctcaaaaactaatagaagaccggctgcggtagctcaggcctctaatcccagcactttgggaggctgcagatggcggatcacaaggccaggagttcgagaccagcctggccaacatgatgaaaccctgtctctaccaaaaatacaaaaattagctggttgtgatggtgggtgcctgtaatctcagctactcaggaggctgaggcaggagaattgtttgaaccccagaggcggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccgtcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaataggttgatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcggtttccagccgctggtcttcatggcattcccagcacagccgggcaccaagaggcaaaacccaaggcctggcttggccgtgttaacgattgtacagacatttttttaaataactttgtgtaatacttttctagaatagtaagttcttgttgaactgtcacagatgagcttctaggaacacaccgggtgtggttacttccactgggtgtgtccatggtcgtggtctgtgcctttgtaaacaaacagaacacttgaaccaccttccgaattgggtcatctgcttctttacattgatacttagagatttgcagctctctaactttcaaggaaacttcccctactgaatggcataaaaaggttaaaaaagaaaatccgagagtcccaattccctgtataacagcattaaaataatctgcctgcctggaaagatgagaacactgttgcacaacccaaaatgtgtttttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacgggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatggactgctttgttttcttccttgtggaactctggtgttcatgctactttgttcaccggtggggctggctgttgctagcaaagaggctcttcacagaagtggctgaacccaaagttctggttgggaaaggcctttgtggcagctcctatcaagcgcaagtgcgaggccaccccctcctcgtgggctctggggtcgattttgttagggtttgacatgagtggctgcatttgggtactcaacagatttcacaaaggaagggtaaactggagatttttggccgggcacggtggctcatgactataattccagcactttgggaggctggtgggcagatactttaggtcaggagttcaagaccagcctggccaacatggcaaaaccctgtcgctactaaaaatacaaaagttagccaggtgtggtggcgcacgcctataatcccagctactcgggaggctgaggcaggagaatcacttgtacccaggagacggaggctgcagttacccaaaattgtgccactgcactccagtctgggtgacacagcgagactttctctcaaaacagaaaaaaaaaggtgctgtggctcacgcctgtaatcccaaccctttgggaggccaaggcaggcagatcacaaggtcatgagatcaagaccatcctggctaacacagtgaaaccctcaactaaaaacacaaaaaaattacgggcgtgtgggcgcctgtagtccgagaggcaggagaatcacttgaacctggaggtggaagctgcagttacccaaaattgtgtcactgtactccagcctgggtgacacagcgagacttatttctcaaaaagaaaaaaacgtgctgtggctcacgcctgtaatcccaaccctttgggaggccaaggcaggcagatcacaaggtcatgagatcaagaccatcctggctaatacagtgaaaccccatctaaactaaaaacacaaaaaaattagccgggcgtagtggtggacgcctgtagtcccagctactcgggaggctgaggctcgcaggataatggcgttgaacccgggaggtggggcttgcagtgagccaagattgcgccactgcactccagcctgggcgacagagcaagactccgtctcaaaaaaaaataaaaataaaaaaatagggagatttccccagttaccaagaactcaggaagcaacattaagagcttgggggaggccaggcgcggtggctcacgcctgtaatcccagcactttgggaggcagaggcaggctgatcacgaggtcaggagattgagaccatcctggctaacacggtaaaaccccgtctctacccaaaataaaaaaaaaattagccgggcatggtggcaggcgcctgtagtcgcaggtactcaggagcctaatgcgggcgaatggagtggaggcgggagaatggcgtgaacccgggtggcggagcttccagtgacccgagatcgcgccactgcactccagcctgggcgacagagcgagactccgtctcaaaaaaataaaaataaaaaaagagcttgggtacacaaagcaagcagcatttcattccgggatgaaaaaaattccgatacccatcgcccttcttgggcccttgtcagtttcttgccacatctttcattttcccatttcaggcccagtaaatgcggatgtttatcttccattgtttgtttcctgagattcagatgtctaaagcatttttctgtgacttttcaagtcaagaggaaaacctgacatatggaaagggaattaattgctcgttttatcctcttctcctgcaatgctctgaatccatgggtttggagtggggccctgggagttgggggaagcaccatacccagtgagtctgcactttgaggacccactgccagtgtcagcttcaaaatcacattgtaaaaggcccggcgcggtggctcacgcctgtaatcccagcactttaggaggacgaagcaggcggatcacttgaggtcaggagttcgagaccagcctggccaatatggcgaaacctcgtctctaccaaaaatataaaaattagccgggcgtggtggcgcgggcctgtggttccagctactcgggaggctgaggcaggaaaattccttgaacccgggaggaggctgcagtgagccaagaccacgccactgcactccaacctgggcggcagagcaaggctccgactcaaaagtaaatacatgaataaataaaataaaatcacatcgtaagagctctccctgctttgtttctgagtaaggttcagagttaaattccgagatcggcctttacaagacacacagacctgaggcgcctcacgaggtaaccagcaggtaaatggagcgcgctccacccacccgccactaggggtcccagcggtcaagggggtggaatgcgggcgtccatcgcgaaggcattctgctcgcaagccttggcacaggcgcgggcttcgctaccggaaaagtcccggtaggattccggaagccggccacgcgttccgcgcaggcgcaaactgctccaaaagtcggcgtcgctctgctcggcgccccggcccgcgccgaagtcggaagtgcgctcaccgcgcagtttcttttggcgtcctggacctgagcaagcgctgttttatgcgtcatcatcccgcgcagacacaggaagtgccgcacagagcgagcccctgtcgtcttgagttctgggccagaggtcggctattatatcatcattaggcgtcaacacaggaagtgaggatacttctggcgagcgccggttgctgtttcttctcaggctcagggaccggccgcggccccgtaggggtgagttccgactgggcggaccaggtgtgggagcgcgacgagaactgcgcaccgaggtctttcttccgagcaggcctcggagcggggcggacccgggcccgggggcgagcgacaccctcgcttccgcggacagtctcatcccgcacggaactttgggtggtggaggcggcgggtccaaacgctgtctggagccaacgtctgccaggctgaacctcaagtgtgcgggactgaacccgaggaaatagcccagtgcccgggtcaggtggccttgttcgcgagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcacgtaggtgttgttattctggttgtacggaagactaaactgaggtgaattacgttacccaagaccatacaagaatgacagaaacgagacttgatttcaagcggtcatttttcagaacccatcactcttttttgtcgcccatgctgcagcgcagtggctgttcacaagcgcacttcagcctggaactcctgggctcaatcggtctcccatctcagcttgcagagtatatgggactacaggcgctcgccaccttgcctggcttacaacttatcattcttgtttttttttcttttttttttgagacggggtcttgctggagtgcagtgacgcgacctcggctcaccggaacctccgcctttcggattcaagcgattctgctgcctcggcctcccgagtagctgggattacaggcacccgccaccacgcccagctaagttttgtatttttagtggagacagggttttcgccgtgttggccaggctggtcttgacctcctgaccttgtgatccacccgcctcagcctagagcttacctttttttttttttttttttaaccaagtcttactttgttatctaggctggagtgcagtggcgcagtcttggctcattgcagccttgacctctctgattcaagtgatcctcctgcctctagcagcctccttcctgtagctaggaatacaggcacgcgccaccacactgggctaacttttgtattttttgtagagacgaggttttgccatgttgcccgggctggtgttgaactccggaactccagcgatctgctcgcctcggcctcccaaagtgctagggttaccgtcttgagccactgcgccgggcacaacttattcttaatgaggatttattctgaatccctcaaaagtgactaggttcaagtgttcagcaccatagcttgctgtgtcctgatgtaggctgaattatttttctttttgcagtgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatatttttttaagtaagtggttttcttaaaggagatttaatttctttgccctcatttttccattagaacaatacttcgatgaagttcttttgtacttctaaatgtcgcaggtgagcccaaaatctattctaaaaattaacaaaaatattcaaatattcagttgacattaaaggcagatttaacacactaaagctgtgtctagattgagcatacatggagaataaaatacgttgaatgttaagtcattagcaaaactggactaatttttctcgtttcattattagtatattcataatactatctctaagtatttttaatatagtgggaacttgccttgaaattaatataaatattttacatctttcttggtttgcatggtaatgtactcaggaaacctttttagtaatttggtaagaggcattggcaaagtacctcttttgctaagatttgtagcatcatttgggatgttagtgagtacaggcataccttgcacttcactttattatgcttcacagatattgaaatttttccaaattaaaggtttgtagcaactctgctttgagtatttttccaatagcatgtgctcactttgttagctttttttttgtttttgagacggaatctcgcactgtcgcccagggccaggttcacaccattctcctacctcagcttcctgagtagctgggactacaggggctcaccaacatgccaagctaattttttgtatttttagtagagatgggatctctccgtgttagccaggatggtcttaatgtcctgacctcgtgatccacccacctcggcctcccaaagtgctgggattacaagcgtgagccactgcacctggccaaaagttctttatattttataacactggctcattcagagtacatgtgaaagtttgttttgggatgttgcccaggtttgattatcattaaaaatacttttatctatgaagaaaaaaaaacttataaagaaaatgattaactttctctttgcttcttagtctgatgaccgggattccaagcgggattcccttgaggagggggagctgagagatcactgcatggagatcacaataaggaactccccgtatagaagagaagactcaatggaagacaggtgagcagatgtacagatgtgcaagacccagctgtacacagccctggcctggccagtccttcctagggtcactgtgacaactgtgtgctattgtaactattaaggtttactctttcctagagttaccgtgacagggcgtgttgtagctgttgtactactgagattactctttcctaaggttaccgtgacagggtgtgctgttgtaactattgaggtttactctttcctagggctactgtgacggggtgtgctgttttaactattgaggtttactcttccctagggttacgtgacggggtgtgctattgtaactattaaggtttactctttcctagggttactgtgacagtgtgctcagtgtgctgttgtaaatactgaagtgtactcttttttttttgagacggtgtctcaagagtcttgctcacccaggctggagtgcagtggcgccatctcggctcactgcaagctccgcctccctggttcacaccattctcctgcctcagcctcctggctaacacggtgaaaccccgtctctactaaaaatacaaaaaattagccaggatggtctcgatcttctgacctggtgatccgtccacctcggcctcccaaaatgctgggattacaggtgcgagccacgacctaggattactgtgacagggcatgctgttacaactattgaggtttactctttcctagggttactggtgaaagcctgtctctactacaaatacaaaaattagcctggcatggtggtgtacacctgtagtcccagctactcaggaggctgaggcaggagaattgcttgaacgtgggaggcaaaggttgcagtgagccaagattgtgcctctgtattctaccctgggggacatagcaagattctgtctgaaaaaaataataataagtccgggtgcgatggctcatgcctgtaatcccagcactttgggaggctgaggcgggtggatcatgaggtcatgagtttcagatcagcctgaccaatatggtgaaaccccgtctctactaaaaatataaaaattagctgggtgtggtagcgcacgcctgtactcccagctactctggaggctgaggcaggagaattgcttgaacctgggacaggaggcagaggtttcagtgagccgagattgcgccgctggactccagcctgggcaacagagcgagactccatctcaaaaaaataaatacaggccgggcgtggcggctcacgcctgtaatcccagcactttgggaggctgaggcgggcagatcacaaggtcaggagatcgagaccaccgtggctaacacagtgaaactctgtctctactaaaaaatacaaaaaaaattagccgggcgtggtggtgggcgcctgtagtcccagttacttggaaggctgaggcaggagaatggcatgcacccaggaagtagagcttgtagtgagccgagagtctcgccactgccctccagcctgggcgacagagcaagactccaatctcaaataaaataaataaataaataaaattaaattaaataaataagatgtgatgtatttttacatgcccctgaaactgtcaccacagtcaagctaatgaacctgcccctcaccccctgcaggtcctctgagaggcatttcgttccatctgcacaaaacattgatttcttacatttttcatctgaatcttaagactcctaggccgggcgcggtggctcacgcctgtaatcccagcactttgggaagccgaggcaggcagatcaccaggttaggagattgagaccatcctggctaacacagtgaaaccccgtctctactaaaaatacaaaaattagctgggtgtggtggcgggtgcctgtagtcccagctactccggaggctgaggcaggagaatggtgtgaacccggaaaggtggaggttgcagtgatccgagatcgcgtgtctacactccagcctgggtgacagagcgagactccagcctgggtgacagagcgagtctaaaaaaaaaaaaaaaaaaagatgcctgaagttggagaattaatgtaattttttaaatgatgtttcagcttcgttcctatctgaatcatgcatttttctgggttgaaaaaacctcataatagcctgatgcttttccgcactttctcaagcatgacgcagtgctgttgtgttttatttcagaggagaagaagatgattctttggccatcaaaccaccccagcaaatgtcttggaaagaaaaagttcatcacagaaaagatgaaaagaggaaagaaaaatgtaggcatcatagccattcagcagaagggggtacagaagcatttactttctttgacatcatgttcaagtgtggtttctttcctgttcctactcttctgccttccccagagcaccactgaaaaaccagagaaagcaaactgtagctgaaagcataatggtgtcacagaccgttcagaagggctatagagagaatagctgaaagcatgcatgtgtcacagaccattcagaggggctatagagagcaaactctagctgaaagcatgtgtgcgtcacagaccgaaaaccagagagagcaaactagctgaaagcatgcgtgtgtcacaggccattcagaagggctatagagagagcaaactctagctgaaagcatgcgtgtgtcacagaccgttcagaagggctatagagagaatactctagctgaaggccgggcgtggtggctcaagcctgtaatcccagcactttgggaggctgaggcgggtggatcacaaggtcaggagatcaagaccatcctggctaacacggtgaaacccagtatctactaaaaatacaaaaaattagccgggcgtggtggcgggcacctgtagtcccagctgctcgggaggctgaggcaggagaatggcatgaacctgggaggcggagcttgcagtgagccgctatcgcaccactgcacactctagcctgggcgacagagcaaaactccgtctcaaaaaaaaaaaaaaagaatactctagctgaaagcatacgtgcgtcacagaccgttcagaggggctatagagagaatactctagctgaaagcgtgcgtgtgtcacagaccgaaaaccagagagagcaaactctagctgaaagcgtgcgtgtatcacagaccgaaaaccagagagagcaaactctagctgaaagcgtgcgtgtgtcacagaccattcagaagggctatggagagcaaactctagctaaaagcctgcgtgtgtcacagaccgaaaaccagagagagcaaactccagctgaaagcatgcgtgtgtcacagaccgttcagaggggctatagagagcaaactctagctaaaagcatgcgtgtgtcacagaccgaaaaccagagagagcaaactccacctgaaagcatgcgtgtgtcacagaccattcagaagggctatagagagaatactctagctgaaagcatgcgtgtgtcacagaccgaaaaccagagagagcaaactctagctgaaagcatgcgtgtgtcacagaccgaaaaccagaaagagcaaactctagctgaaagcgtgcgtgtgtcacagaccattcagaagggctatagagagcaaactctagctaaaagcatgcgtgtgtcacagaccgaaaaccagacagagcaaactccagctgaaagcatgcgtgtgtcacagaccattcagaagggctatagagagaatactctagctgaaagcatgcatgtgtcacagactgaaaaccagagagagcaaactctagctgaaagcatgcgtgtgtcacagaccgttcagaggggctatagagaggatactctagctgaaagcgtgcgtgtgtcacagaccgaaaaccagagagagcaaactctagctgaaagcatgcgtgtgtcacagaccgttcagaggggctatagagaggatactccagctgaaagtgtgcgtgtgtcacagaccgaaaaccagagagagcaaactctagctgaaagcgtgcgtgtgtcacagaccattcagaatggctagtccatttttcctctggggttttctctcccccattatattgtttgggagcagtttgtttacatttgaaatgacctgaattcaacaagtataggagaaaaacacaccccaaaatgggtatttgctcaagtccaaagaatgggttaggcttgagcagtttgatctcgtaccaacatcaggagattcttacgggtgttaggaaaattggacctggagcccgattgaaatctcattattataaatacgcttgattaattaatgtggcttcattgcacagtggagaagcccactgatagcaaagctttgttctgtagtctttgtgaagagtggtttttgtattataaaactgataattatagtttattcagtatagaaaatttttaaaagattaatattacaattctcttctgtgatagcagaattgtttttcttttttcttctttcttcataattagacgcttactgcagatagttttctattttcaaagttttttatttaacataaaaatcatgattattcgactgggtgcagtggcccaggcctgtaatcccagcactttgggaggacaaggatggaggatcacttgagcccaggagttcaagaccagcctggccaatatagtgagaccctgtctcttcaaaaaaaaaaaaaaaaagattaggattacttaacattaacatcattatttaaatatttaatgttcttgatttaatttcattttcatgtgatttttttttttttttttttttttgagatggagtctcactttgtcgcccaggctggagtgcagtggcacaatctcggctcaccgcaacctccacctcccaggttcaagtgattctacagcctcagcctcccttagtacctgggattacaggtgcctgccaccacgcccagctaatttttgtatttttagtagagacggggtttcaccatgttggccaggctggttttgaactcctgacctcaggtgatccgcccgcctcggcctcccaaagtgctgggattacaggcgtaagccaccgtgcccggcctcgtgaaatttttgaagtgaggtttctttgcatgacactttatttctcattagggaagcatgctagagtgaaagaaagagagcacgaacgtcggaaacgacatcgagaagaacaggataaagctcgccgggaatgggaaagacagaagagaagggaaatggcaagggagcattccaggagagaaaggtgagtgggctgggtcagttgaggactttatgaaagggccgtggtagtgtgtcctgtcacagcaatgaagaagaatttggcaatagaagtcacatttggtgcagaagtggtagacatggaaacagcacagtgaacagctggacgaggctgaccaagagaactgtcctgagggagtgagttttcactgcatctggaagtaagaacgggtgtgatttgattgagggaagacaatgaagggatcagaaatctgcacgtccggccaggcgcagtggctcacgctagaattccagcacttacgaggctgaggtggttggatcccttgagcctgggaggtcaaggctgcagtaagctatgaccatgctactgcactccagcctggttgacagagtgagactgtctcaaaaaaaggagaagggagatcccaaaaaccttgaaacagtctggaaatcgggacactggactcctaggactcctggccattagtttatatattcgttcccctttatgaaccagattcccaagaaagaacatcggtgtagccccagatctgttctgtgaaccaggaaaaaggctgtaggccaggtgcgagcaggcccatctccgccttcagagtgagtccacagaaagcttgcaagctgctccaggaagagaggagtctgaagcggaagggcgtgtgcagcgatgtttgccagcagccagggctgggtacacagcatgtaaagatgatgagagggcgctggttcttgttgatgccgaagggtgtgggagacactgaggcccaggggtcaaggtctgagaccactgcggggtgagcaaggtttcagttggcctagttcctgttagtgtgtgaaacattcatgtatgccacgccctgtgccagacattgagtgtgtcttgtcccacgagagtagagcttgggatagaagtggaggttggtagatgaaatttgggctgtcatattgatttcccagaaggtaaagacaggagagtgaatgagcaaaaattgttgggggcagacttctgggtagggccgattcagatcagccaatccagaactgggtgtggtagcatatgctacgtgggaggctaaggccagaggaccgcatgacgccagcctgggcaacgtagggagaccttgtctctgacaaaaaggaaactgataaggataatctgagaagcactgatgcttggaaaactgctgagctgtgggtgaaagcagtaagaatctgaccttctggcctgagagctgctccctttactgcttccactctgcacttgggaagcacggaggttccactgggacagggcagctgcaggacctgcagtttccttgctgccttggaaggggttactccgtttagagcagtgggcagtggccttgcccaccagcatcctcagtggagggaggaagaaaaggccaagaggtctgctagaatgaagtacagtgtggttgggagcagctgtgatctcgccaaagacgtgcagcagagactggagagagctcgagccgccacccacttgtgaccagccctgaggatgcagctgcgtgaaaggacctggcagaaaatagaagccgccacagatgcgaatgacgcctgaacgttcagtgtgctccctgtccacacacagccgtgggccaaggaagccttactgtgctcgaggtatttgagcccagcgtttttccagtgctggctaattgctaagctgtgcagacatggtggtgacccctaggaagccaaggttgaaaattaaaataggcatgtgggaaggaacggggtggccacgagctgtgagggagatggatttcacggacaaccagacaggcctcggtggtaacaacgaaagggaaaacttagaatccagaattgctacaaatgtattatctaaaatacaaagaagtatgacagtgtgacccgtactgaggaagaacatcatcagtagaaactgtctgagtgtccagatgttgaatttagtaaaggcttggaaacaacttgtggatggagcagtagaaattatccattctgaagaacagagagaaaaaaacaagaaaaatgcacagagcctcagaaacccgtggtacaacatctgctgtaccaaagcatgtcgaatgggggttccaggagagaggaaagatatttgttacaataatggttaaaaactttccaaattttaattaaaaaatatgcacattcaagagcacaggaagtttgaactagaataaatgcaaagtcacatcatagtcaaactggcaaaggccaaagagaaaatgttgaaaggcctcagagaagaatgacccatcccatgaaaggggagcttcaataccgccagccactgacttcttagaaacaatggagaccagaaggcagtggagtggcatactcaagctgctcagagagaagaaccatcagccaggaatcaaaaccgttctacacaagtgaaagggaacgaacgacattccctgagaagcagagactggtgggattcattgttggcgaaacctgccttaaaggaaatactaaaggaagaccttcaagttgaatagaaatgacaccagacggtaacttgaatcctcaggaaggaaggacaggcactgcagatagcaagtgtaggttgacgtcaatatcctgtaaatatctctcctcacatcttaggttttactggaactacgattgtataaaataattacactgttgtcatggtatgtggcataaatggactgcacaaagaagacagggaataaagctgtgttacaacagttttatattgtactggacttgagctagtatcatgaggcatatggtgatccctagagcaaccactaagaaagttgttttcttagtgttctaaaaagtacaaataaattaaaatggtatgctaaacatatgtaatttaaaatcaaaaagggaagaataaaaaagacacaacaaagcaaggaaagtaaatccaactgtacgtgtaattatatgacatgtgaaaggtctctgtgccccaaacagacagggcagattatcagatagaaaaacaagatctaactgtatgctgtctgctagagaacaggaaaagacgcagcgtacaaacatcagctgtcataggagagcttgaatggctgtactcataccagacaaaacagatgttaagaaatattagaaaccagcctggccaacatggtgaaaccctgtctctacaaaaatcacctgggtgtggtggcgcacacctgtaatcccagctactcgggaggctcaggtatgagaatcacttgaactcgtgagatggaggttgcagtgagccgagattgcgccactgcactccagcctgggtgacaaaccaagaccctgtctcaaaaaaaagctagaaacaagaaggagcaaggacttcacagccagaaacaggccaatacagcaggaagatacagcaatgatacgtgtgaatgcatctaaccacagagcccaaaatccatgaaacaaacaccgatcgaatggaaagaaatggatcatttattaattagaattggaaatggcagctgggcacggtggctcgggcctgtaaacccagcactttgaaaagcggaggcaggcggatcacgaggtcaggagattgagaccatcctggctaacatggtgaaaccctcgtctctactaaaaatacaaaaattagctgggagtacagggcgcacgcctgtaatcccagctactcgggaggctgaggcaggagaatcgctcgaacccgggaggcggaggttgcagtgagccgagatcgcgccaccgcactccagcctgggggacagatgaagactccgtctcaaagaaaataaaataaaaaaatgaaaaaaaaacttcacggattgaattacgtagaaagccagtttacaaatgtggacaaaaacgcgataagcaagcttctgtttagggggaatgatggcgtgtgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaaggtaggcggcgcggtgggcagctgtgctcggcgggacgcgtgtctgctgccccctggtgctgggcacttgctgtcacaggcgggcgcttggttccggtgcttgcttttcgcccctgccttttttttttttttggaggcagagttttgctcttgtcccccaggctggagtgcggtggcgcgatctcggctcactgcaccctctgccccccgggttcaagtgatcctcctgcctcagcctccggagtagcagggattacaggcacccgccaccatgttcagctatttttttatatttttagtagagacagggtttcaccgtgttagccagaatagtctcttgatctcttggcctcgtgatccacccacctcggcctcccaaagtgctgcgattacaggcgtgagccaccgcggccggccagtacgagcttttatattcacccacgtcctcaccttaatggagatctttatttcttcacccagcttccggtttctgtctcgcgtcctttccttacaccccacacaactccctggagcttattcttcaaggcaggtctaggtctagtagtaatgaactccctctgcttttgtttatctgagaatatcctcatttctccctcatctttgaaggaaagtttgctggatacgtggttcttggttgacaattttgttgttgttgttttgagacagagtcttcttctgttgcccaggctggagtgcagtggagcgatcatagctcactgcaacctcgaactcctgggcacaagtgatcttcccacctcagcctcccgcgtagctgggacctacaggcgtagcgtgtgccaccacacctggctcatttttcagtagaaacaaggtgtccctgtattgcccaggctggtcttgaattcctgggctcaaggaaccctcatgcctagctgacagtttttccttttcacttggactatttcagcccattgtcttctggcctccaaagtttctgatgagaaatctgatgatcttatagaggatcccttggatgctttaatctgatgacctgattgaggatcccttggatgctttgaagattctctttgccttaggctttcaactgtttaataatgggttttcctgtgggcctcttgacttcattctacctggagttcactgagcctctctaatgtttatatttacggttttcatccaatgtgggggttttgaggaattcttcagataccctctctgctcctctcctccctcctgggctcccacagatctgttggggtccccgaggccgctcagcactgctcccttttcttcagtctcttctgctttcttttcctcagacgatgtgattttattgtcttcaggctcaccgattatttcttctgcctgctcacatctgcctgtgagtttctgttgtgaatatttactttttagtgtctattgtgagcatgtacttattagctctggaatttctctctggtttcttgttggatcttctgtctctgttgatatttccgtcgtgttcacgcgtcattttcttgactttctccacatcttcctttcgttctctgaggaactgaaggtttaagacagttccctaaaatctttgtctgggacatctaccgtcaggtgattttcaggaaccgtgtctgttggcttctttttttcccctctgaatgggacatactgtcctatttctttgtttctcttgtgtttttcttagtcaaaaaaatggacatttgattctcatgatgtgattcttcctggtccccactcaagggtgtgcacttgttgttttggttgtgctgggctgtgtctgtggggtcggcctgttgtggaaactcagggtcttcacgggtcttttctgagcctgagccttttcctggtcacgtgcagccactttttaacgttcccgtcaatacagatgtttttaatgttcttgtcctgaagtgtctgcctcctaaagggggaatagagagaaatgaagggggcaacgggggacgtggtgctcatgccctggaagtaccttcagcttgggggtggccgtggctgctgcctcttcatgcctctggggtgggacacgcagtcatcacactgacctcgggtgtgtgtgtccgtctgcccacctgggtccggcgagctgcatgcaggctgctgcctgccagcggggagtgaggtgggagccactaatgtgcgaagcggtgacgttgattaatgaatcacagtttactctccaagattccccctgaagttgcaaaccttcagtagactccagagcacctcagtagttgcacaggcctgatcctgtgatgcaagtgttgtctcggtggggagactgattcccagtgcttcctactccatctttccagaatcttctcccgccccttcctttttgaccagtgaagatcagtctagaaggtccacctgggtcctcgggctcacggcctccaggttggagctttttctccctgggcttcctgggagacctctggcctctgaccccgatgctgtcagcaccctgtgcacgctgtgggtgtgtctgccaggtgcgggtgtgggagacgaggcagctgtgccgggtggggccttttgaggaaggcagtgctgctagtgccatctccctctctgccctgcgcgccagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagtgtgagtcttttctgggggatgtttggcataagtgtgtaggattcatttaaagcccagctaagtaaccgcttcagaagaaagtgagagatgtgctggctgaagtcctctcgtgtcgtgagagggaccgtgagtgtctgtgtgcggccaggacacaggacgtgtgtttatccgctgggacattcgccactggccccgttagagaagtggcttccagcgtctctggatgagctggtttccgaccaagcaaagttaatcgttacgtgaaaggcactagttttggggtggtggtagcttgtttgtttaaaaacatttccccaaattcacctttatggtttatctcataagtaaaagaagagaaaatggaagaaagggacctgctgtccgacttacaggacatcagcgacagcgagaggaagaccagctcggccgagtcctcgtcaggtacctggaaccgcctggccaaggccttgaccactgctgcccaggaaggcccaggttcaccctctgctctgctgtctttctacagcagaatcaggctcaggttctgaggaagaagaggaggaggaggaagaggaggaggaggaagggagcaccagtgaagaatcagaggaggaggaggaagaggaagaggaggaggaggagaccggcagcaactctgaggaggcatcagagcagtctgccggtgaggcaccgcgacgactgtgtgaggtgttgtgacttcactatagtgttagaaaccgcagagaagtagctggcgggcgggggagttgaaactcccttctatctaggactctctcgggacacctccacatcgattctttttgtttgtttttttgagatggaatcttgatctgttgcccaggctggagtgcagtggcatgatctcggctcactgcaacctctgcctcccgggttcaagtgatcctcccgcctcagcctcccaagtagctgggagtacaggtgtgcgccagcacgcccggataatttttttatttttagtcgagacggggtttcaccacgttggccaggatggtctcgaactcctgacctcaggtgatccacccgcctcggcctcccaaagcactgggattacaggcgtgagccaccgcgcccggcctccatatccattcttgggaacacttgttgcttagctgaagcggagcccgcatcctgcctgtggcagcactcgccccggtgctggtctgagcagacgcctcctttctcttgcagaagaagtaagtgaggaagaaatgagtgaagatgaagaacgagaaaatgaaaaccacctcttggttggtaagaacctccctggagacagagccccctccttgtctgtctccgagtgcagcagccctctcctaagacagccggtcctgcgcggcgtggggcacgccagggtctgggaggccgcctgattcgttggccgctccaggctgtgccggtggggcccgcattcctcagcgaggcacagtgctgaccaagggcgtcctgagtgcccagcagggccgaggagctgggaagcccaggaccagttccccacaggggaggcccgtcagatggtggctccgggcctgtccctgcagaacagaggcctggcccagcctccgacaggcagtgaggttatgtcctcagcctggtggacgtggatgtgggcttgtcccccacatgacacccgacgcctcctcccagctcagcatccgggctctgtctcagccgagcctgccagcactcttaggcctcggtgccctgtgtccaggggacgagagcccagcgccagcacctcccagcgggacacggggcagccctgccacgcgcttgatgcccccggggcaggaggaggttcatgatccttgcttactcctagcttcctaattaggttcaacttttccagttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcaggtcaggccctcccctcgccccgggccgctgtccgcattggcagtcggagttaccacaggggctgagcgaagcctggcccccgtgttggcgtctgtcgcctcacagggctgctgggcccactggggcagtgacgggcgggcacagccactggcccctcatgcttctaggtcccgcctctttctcatgctggacggaactgggtggacagggagctgcccgcaggactgctctgcggcttgaaaggcagcctgggcgtgcggccgcgctgctgtcactgctgcccgagttgcgtcctcctccgcactggagagcagtgccttccacttgacccctgcgtgggcgggttatgtaggcaccaaggccttgttaccggcatctgtgcagggcttggatgggggagcggctacgggagtcagtgtagatgtgtgaccagaagccttttgctcaggcagctatcaataaggcaggatattgttgggagtgatttggaagggacaagcctgagaaggtaccagtggcctcgggggcctgggagaccggcagggactcggccccctccttggtgcctgtgggcggagaggttctctctggcgcatgcagcaggcctctgtcgactgccctatgccttgtgagcgcctctgccccttagtgctgctgagcgtaggcgtcgggccacaggccacccagagtacgtgacatccggcctgggcaccggccccaaggtacaccgaggggtaggtgccctggcatggggcatcatgctgcgcctggcaggtagggcccgtcctcagtgtcatcctggtacaagcaggggacacatccactttgacagagagactctcgggatggccttttttttggagactgggtctgtctctgtcatccaggctggagtggagtggcttaatcatagctcactggagcctccacctcccaggctcaaacaatcctcccatctcagcctcctgagtagctggaactacaggcgcaagccaccatgcctggctaatttttttattttgtagagaaggagttttggccaggcacagtggctcacgcctgtaatcccagcactttgggaggccgaggcggtgggcggatcagaggtcaggagttcgagaccagcctggccaatatggtgaaatcctgtctctactaaaaatacaaaaattagcctggcgtggtggtgcgtacctatactcccagctactagggaggctgaggcaggagaatcgcctgaacccaggaggtggaggttgcagtgagccgagatctcaccattgcactccagcctgggtgacagagcgagactccatctcaaaaagaaaaaaagaaaacagtgttgctatgttggccaggctggtcttgaactcctgggctcaagcaatcctcctgccttgccctcccaaagtgctggaattacaggcctgagcccttgcacctggctgggatggccttttgttcacactggttttgtttcataataaagtgtcagatggttttgcaaggaaagagactttgaaagaactgagctgctcccggctccacccccggcccagtcccaaggctctgccctgcacctgccccgtgccgggtgtgccgtgcctgtggacgcagccgccctccctccagctggcatggccactgagacctcacacaggcgcttccttcccagggctgccggagcgtcgaggagttccagtgcctgaacaggatcgaggagggcacctatggagtggtctacagagcaaaagacaagaaaacaggtgggtggggtcccctcaccccacaaaggcaggggaagtggggcaggggctggctgcccgagagctgcgactgcacctgggcccgcctcacctgagcagctactggaggttggacccctcagcacctctagaagccagaggtcagcctggccctggggctttgccactcccttgcagtagcaggcggcctgccccacagggccgaggcccagcgcgtggagtggtctgtgccggggctggtgtgcaggtttgcgttcccagcgtcccacccaagcaggtgtgtgagccgggaactctgttgggagtcggccactgggatcccaggtgaggccggctctgttggggaagtcgatgtggagtcggcgtggccgctgggatcccaggtggctgtaggtggctgtgagtgtctgtggtgtgttgagtgggaagccgtgggtgttgcccagacctcagctggggcgttctcctggtgcccacgtgcccccacctagaacgagacccccctccgtgaaatgctggcgctttgggcactgcctgcggtcctcactgaacgagtccactgttggtaccgtgactttgagaatgcctctcagtgccgtctgtattttcttcacagatgaaattgtggctctaaagcggctgaagatggagaaggagaaggagggcttcccgatcacgtccctgagggagatcaacaccatcctcaaggcccagcatcccaacattgtcaccgttagagtgagcatggccccaccacgcctggccccgggtggaaggcttttccgacagggccccgtgctgtcctgaggccgggtgcttcctacactctcctgcacttagtggagcccttcacagaccacacagaagcaagtatttgcctcccgggtggcaccggaggtccttactgtccctcagcatctgcgcccgggtgcaggggtgggtgggggcctggaggtgcccagcacccacagagccgtgccctgcaggagattgtggtgggcagcaacatggacaagatctacatcgtgatgaactatgtggagcacgacctcaagagcctgatggagaccatgaaacagcccttcctgccaggtacagccgcgccccggggtcctgtctgcgtacaagtgggggcagtgtcctggtcacccccgcggtgacagtgctgcagggagggccagctgcatccacagggaaagccctgagaagcctctgttgctgccgaggcgagcgggccaccctgagtgccctgggcttggggcggccgggtccacatgggagcctccctccctcccaggggaggtgaagaccctgatgatccagctgctgcgtggggtgaaacacctgcacgacaactggatcctgcaccgtgacctcaagacgtccaacctgctgctgagccacgccggcatcctcaaggtgagcccccctccgagtggcccatcccagggtgacccgcccgggcccacccacagccgcccatctgtcgttgcaggtgggtgattttgggctggcgcgggagtacggatcccctctgaaggcctacaccccggtcgtggtgacccagtggtaccgcgccccagagctgctgcttggtgccaaggtgagtcctgggcgtctgagtgcctcccctgtcccccatgcagcctcccacagcttcgcgggcactggccttcctgaacacctctcctggcgtcttaggaatactccacggccgtggacatgtggtcagtgggctgcatcttcggggagctgctgactcagaagcctctgttccccgggaattcggaaatcgatcagatcaacaaagtgttcaaggtgggtctggccctgccgcaggtgcgctatggatttcagaggagttgcaggaatggggctgcggggcgcacaggtgctgggttgagatggggaccagggccactgagagccctcctggtggcttgtcttctctgacgggacacaggtgccaacactgtgggccacttggtgtggctgttgaagcacctctgtctttcaggagctggggacccccagtgagaaaatctggcccggctacagtgagctcccagtagtcaagaagatgaccttcagcgagcacccctacaacaacctccgcaagcgcttcggggctctgctctcagaccagggcttcgacctcatgaacaagtgagcccagtgcagccgggtggcgggaggtcccgagccatagcggtgacttcccagtcccaggcctacctgctggctcaccacgttccagaactgctctggtgcctggcgtcccatgccctgagccccgtcccaacacagcccatctttgggggacccagtggagcacacgagcacctcctgggcctctggccctctccccccaggttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctggtgaggggcctggcgggtggggcgtgcccacaggtggggctggcttgggcagggttctcacggtagccgactcgtcccagggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaaagctccccgtgtcgtcctttgagtgacccgggaccatgtgtgggaggggagtcgcagaccaccgggctctaggggaagagggtggggtgggcggctgtggcctctgaccccatgtgggccagtgtcttccccaggcaggaggggagctcctacctcctggggggcctccactctggcaaggtggtcccccaccctgtgccagtcctcccagcccccacccacatctccttgcagaagatcctggaggcccatcccagccacatctttcaggaagccccctttgcctccctcccccagctctgagcaagtcctagacagaacccaggcttctggggctaccccaggtgctgctccacgtgctgcccctgtcactggggcctccgcttatcccactttcccaggggccaccttagcaaagcccgtcccgtcctgtgctgtacctgttgtccgctgtgcggggaagcaggggtgcccagccccgaggacgcccagctctcggtggaccaggggctggggtgtccacctgcccagactggctgcccgctgccctcccaagaatgagccaggagccatcagagagaaagtgctttatcagccgggctcagccccgcacacggactcgccaggagtaggtggtcagcacgcgctgctggcggcgcaccacgcaggtgtaggtgccctcattgacggcgttggcgatgatgctcaggtgcgcctcgcccagggccaggtagccggggtaggagaactccaggggctcctggtccttgtaccagctgcaggggggcggggcgtctcctgcaggcacagcccccccccgctgcctgccccgcacccctgccccaaggccgcccgcgggctgcccaccccgaggaccgcccggggcgctcactcactacactttccctttcttgtggaggatcttctggccgcagcggaaggtcacgttcctgccctcgggcaccagcctggttttggtcctggggggcggtggggtggtggccaccgtggggaaggggaattctgctccgggtgggggaaagagccccgtcagtgccccctcagccccgaccatggccaaggcccagctcccacgcagccctgtcccggccccgtgggcatcaccgtagcagaagtcgcagctgctggggcagagcctcttcatgagccgccggcgagcgtcgcagaagcccctccgcgcccaggacgcgcacacgaacagcctgtcgaggcatcctgtcgggagcgtggggagcacggcctggctcaggaccgcccggtccccgccctcccgcccgacaaagggactcaccgtagagccggtgcagcccccacagctcgtcctgggacaacgccttccagccgcgcagcgtggcgttcaggtgcatgagcgcccggccgtgttgtgagtgcatcaggcccagcgcgtggccgatctcgtgggccgccacgtgcaccaggtccgtgagccacacgcctgcgggccccgggggtcagcgcctgggagccccgggcccagccccgccgcccgtgggccagctccccgaggcccggtgtatctgctggagcgcagccgcggagccgccctcggccgcagccacggaaagataagaatgttctgggcccaggcggtgagctcggcccccaggaatgcagctccagctcccgctccagaggcgcagggggatgggaaagggagttcagggctgccgggatgggggctcccacgggctcccctccttgcctgctagactccagtggcagccaccaccccggaaggtccctcctgccgtctgccccaaagcccgaccgcggcagcccactgtgctgcagaggagaggcctccaggaggccagcctggacggtcacctttcttccagctgtagcgcgtggggcccaggacccagtactcgctgtcgtcgaagtggatgccgccgtgcggggggaagaaggcgtgggccagctcccccgtggggccgtcgaagcagtggtgcagcgcggagaccaggcagtccgtgtggttgatcgggtagaagcctggggggagcacggggctgagaggccgggcgcgcagggccgggccggggcgggggcgggcgcccacctatccggaggtcgctgggctgctcgggggccacctcgcggaagctgaagggggacacgtcgctccacatgcggaaggcggcagctagggcccgccgcgtctcccgcgggctcagcaggttccgcgggaaggagaggatcctgcagggagagtgagctcagcgggcgccggccgcgccccctcccccggggcccagccagggcgcacctgtaggtgaggttgaagtggtcccagcgcagcctggctggagtcagcgtgtagcggcgtctgcggggggccagtgggcccgggacccgggtgggggggaccgccgagaggcccagcgcagcgacgtctcccttcagggaagaaagcgtgcgtgggaggcatcggtgacggtccccaggaccaaaaactgccgcggaaaatggactggaaggaaacgggggtgggggtgcccagggctgggagcgggcgtggcgggtcctgtctgcctgtggtttcgggtctcctaacctgagcgccctgttgcacgtccctgggaacgcggcccagtggaggggaaggggctgaacagcagggcgaggcctcccacccctcccaacaactggacacaggggcgtccaaccctccgacctcgggacgcacatccggaccctcaaacaccccgcacaccccgcacaccctgcacaccccgcacacgtcctgtgggccccttttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaacagtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtttcagaatccagggatcatcgaacacagaaggtgtgaactgacctctaaagcagcgtgagatgggcaatgatctagaaaactttggatttttgaagtaaattttaatgtttcatattaatttcttgaaaatgtattaaatgtcattgaaagccttattacgcttttcagatcctttcaataaacaagacttgtagaaaataagctgggttaataacagctttcttctgacgccgtggaaccaacatagaggggtcgggcagggtcacccccattaaatcctagccccaaaatgcccatccaccgagtgtggggccggcagggcatcctccccaaggggctgggggtgccgctgcctcttccgggcaagggggcagtgccctggcgggggtaggggtagacagaagggactcaaacccgaggggtggtgtcgactcgggcaggctgtgttgctcccggaagagccactgagaccagggggagttgagtccctgcattcccggggccagcagggctggaagagcccctcttggctgcctaacaggggcagccacaagccaggtgaggacccgctggcccctgggcccagcctgggcaccgatatcggcctccctccctccactgacgtggtcctgcgccccgcaacccccccaccccgcaccgtccctgttgtcctaacaaggcccagatgaatgtggctcagggctttgccggcagccagtctgcactacacgcgtgcaagtccaggagagaccaaaacgaccaccctgtggacacctgcgcctccagcaccctgccccgttttggggacgtgaaaccctgggctgtgggccccgccctaccgacctggagcgcctctgcctccccggcctggaagaggctgtgggtcaagcctaaccttcttggctttggggagcacagaggccccaagacatcctcgggggctgccgggctcaggctctggggcatggaaaccttttcgagcctgaaacggcggcatccacggtccctgccgggccagtgccagcctgcaccctgggcacctctgtgctgggcccggcacccccaccctgcctcccacagccagggtgtctcctcaggtcaggtccaaaggggctgcagccaggcccaaagacccagcccaagtcccacggctcctgcggggtctgggtgaggcctgtcctgctgggagcccaggaggctgcgaccctgcctggagctggaagtctggttggggggtagtagggtcgggggaaagcagggtggggcaggtacagggtagagaagccagctggaggagcccagggaaggctggcggtgctggggatgtaggggacagcaggagctggtacattaccacatgtttcagctgcttccagcacatcctgccccagaaggatctcagccagggcatgggctgccttcagggtctggcaacaccaaggagccaaggcaggtggtaaaccgaggccacaacctccttaggagcctccacaaccagggcgcacagctgaaagaggaaggaggcccctgcggagagcagggtgggtaggagtgggtggccaggacaggtggtgcccagtgaccggcggtggggacccgggagccacagaggagccggctcagccacccctgtgcaggaggcacctggggcctgtactcaggcctcacccagggctgccccacgcccacatcctgctgacaagcccccaggaccagcatccccacccagctgctctgtgcagaggggacaggaggccagacaaaaagatggacaaacacccacgtagattcacacacacacaaacagacacaccacacagaaaaatatgcatggacaccactgagacacacgcaggcaccacacactcagagacacacacacagacacatcacacagaaaaatatgcatggacgccactgagacacacgctaacaccacacactcagacacaaacacaccacacacacagactcacacagatacacacacagaaaaatacacatggacgccactgagacacatacactcagagacaggcagtgcgctctgggaaacaggacggttcctccaaaccagtgaagggcccaggaaagcatgagcggccctgacatgtatggagggtccaaaggctgcgggaacttgcccgtgagtgaccttggcctggagaactccccggcctcagtttccccacctgctgatgaggacaaattgcaggggcatgagcggctgctgctcccctacctctgcgcaggtggccgagtggcctgcaggctgggtctccaggtggggacccttccctcttcctccccacccactctatccccttccggcgtcatgtggatagaaattcattaatatgcacaacaaatgactacatgcaagcaggaaaacatttgcaataatacagcaggtcgatgttctcaactagcaaaacagatgcaataatacaatgcgtggatgttctcaatacagacaaagctcatataatcgacacaaaacattcacagaaaaattgtcaaagggcagaaaccgatgactcaaggaagaatataaatagctaagaagtaaatgatcaataatcaaactagaacataatcaaagaactttaaaattaaaattattaatacactcctcccaggcaaaatagcaaagagaggggacatggtggctcacacctgtaatcccaacactttgggaggatgaggtgggaggtccttctggggagaggaagagaggaaagcacacaggcttccagacactattccaaaatcattaatacgcacaccccaggcccagcacggtgacagccacctgcagacccagctactcgggaggctgaggccagagagccctgagtttgagcccagcctgggcaaagtagcgagatcccccatctcaaaaataaaataaaatgcatggttcctcatgaaatgtaaggctttgctataaaaactttgagaggccaggcgtggtggctcacacctgtaatcccagcactttgggaggccaaggtgggtggatcatgaggtcaggagttcaagagcatcctggctaacaacggtgaaaccccatctctactaaaaatacaaaacaattagctgggcatggtggcgggtgcctgtgatcccaactcctcgggaggctgaggcagaagaatctcttgaacctgggaggtggagcttgcagtgagccgagatcgcgccactgcactccagcctgggcgacagagtgagactccgtctcaaaaaaaaataaaggccgggcgtggggtagctcacgcctgtaatcccagcactttgggaggctgaagcgggcagatcacaaggtcaggagatggagaacatcttggccaacatggcgaaaccctgtctctactaaaaatataaaaattagctgggcgtgagggcacacatctgtaatcccagctactcaggaggctgaggcaggagaatcacttgaacccgggaggcggaggttgcagtgagctgagatcgtgccactgcactccaacctgggcgatgagagcgaaattccatctcaaaaaaaaaaggagtactttttataaatctgcttttgaaatcatttggataccacagcggccctgctgaccacaacagctgagactgttgggcaaatcaccagacatttctgggtttcctggaaagtaggagaatctactttgtaaactgctctcaaatttatgaactccgtgtggatagtgaactcaggcagcaggcaggtggcactccactgcgttaatttcacttcattttataattttctttcttccttttttttttttttttttttgacggagtctcactctgtcgccaggctggagtgcagtggcccaatcttggctcactgcaagctctgcctcctgagttcaagtgattctcctgcctcagcctcccaagtagctgggattacaggcacgtgccaccatgcccggctaattttttttcgtattttttgtagagacggggtttcatcgtgttagccaggatggtctcgatctcctgacctcgtgatccgcccgcctcggccacccaaagtgctgggattacaggcgcgagccaacgcacccagccttttttttttttttttttttttttttttgtgagacaagggtctcactctgtcgcccaggctggagtgtggtgctgtgattctagctcactgcagcctcaagctcccaggctcaagccatcctcccacctcagcctcccgagtggttggaaccacagacaccatcgctgcgctctgaccggctcccgggggcgctccgtgcccctcctcctgccccactcctctggggacatccccaccaaagaccccacgggaggaaacagtcccagcctctggcccaacccggctgcgggcgccacggggaagcctggggaaggaggctgccatcagcctcctgaagctttacgaaggttcatgcaacggaaacaaaaacaagtggaagtttaacaaaacgtaaaagtaatatttatttatttatttatttatgagatgaagtctcccactgtcgcccaggtcggagagcagcggcgctatctcgcctcactgcaaccttcaactccaaggttcaagcgattctcctgcctcaacctcccgagtagcggggaccacaggtacgcgccacgagacccgggtaatttttttttgtatttttagtagagatgggggggggcgttcactatgttggccaggctggtctcgaactcctgacctcaggcgatccgcccgcctcagcctctcaaaatgctgggattacagacgtgagccacctcgcccggccaaaagtaatcttttcttttttcttttgacagggagtctcgctctgtcgccaggctggagtgcagtggcgccatctcggctcactgcaacctccgcctcccgggttcaggtgatcctccttcctcagcctccggagtagctgggattacaggcgcccgccaccacgcccggccaatttttgtatttttagtagagacgacgttttaccacgttggccataccaggctggtctcaagctcctgacctcgtgatgcgccggcctcggcctcccaaagtgttgagattacaggcgtgagccaccgggcccggcccaaaagtaatctctaaagagccctttagccgtaacttcattcctgaaaattatttgggaaagtaacgctaggaaaacgctcgacgaagctccggagccgggggtcctcggggccgcagggcgcgcccgcgggtgtctgctccggatgtcccgcggcagccccgacgccagcctggatacgaaggccccgccccggagcgcgccaccagccaatcagcgccctgaggcgagtcctcaccccgcgcggcggccccgccccccgcagctccgggcccagctgtcagagcagctttccctcaggctgggcggagcgtggccacttccgccaggaggcgcctttgtgtcttctaagttaagcctattcagtggatttcttattcctggaacccaaacctgggcagtaaaccctccggggcttagaggccgctgcctccacagcctggccgatcccgccctgaagtgccgctggtggaacagcccgggcggaaccgcccgggcggaaccaacgggctgccgcggggggtggggccacggtccccccccttctgccttcagtggaacggccccggcggaaccaacgggccacggggatgcactacgcgcaccgtcgtcctctccctctgcctgcagtggaacggcccgggcggaaccaacgtgcggccgcccggagcactcggcgcgccgtgtccctccccgtgtggctgcactgcaacggcccgggctggaccaccaggcggccgcggagaggcacttaaaagccccgtgttaccctagaccttaaaaaaaaaaaaaaaaaactgcgtgtttccacccccgtcggcctgcagtggaagggcccgagcagaaccaacgggggaggggacgctgagcgcgccgtgtttctcctcccgtctgcctggagtagaacggcccgggcggaaccaacgggcagccgcgggggcgttgtgggccgcggcgcgtttccccggctccgtggctctggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcgcctctcaggccccgcccgccagcgtccctttgttgtgaaggcgccggggcctagcgctatgcctgcggcggagactgcatcaggctctcggtgggttctgcgtgcggggtgctctgctcggtgatcggtgctgggtgctgcgtgctcggtgctcggtgctgggtgctgggtgccggtactgatgctgagtgtgcgggcgtccggggtttccctgcccggattcgctcctgggggtcctttcctatggctggcgctgtgcgcggaaaacgctggtggggttttcccagctggctttaagcgttttcacgtccgggagtccacggcgacccccacgccctgaagcctgggaacgcggtgtgcgtggccgcaaaaagaacaacaacaacagaaaaacacaaaacaaaacacgcaaaacactaaagcaaaactcccgacagccgagccccgttcggtgccttttctttttttttttctttaatggagtgaaatctactttgctcaggaagcctgcaaatcacattttcaggccaaacgaggcagtattttagaaggggtcgctgaggcaggagtaggaaggctttccactccactcacgcattttcagtgtaggcgaatcgtaaaacggagggcagaacgaaaatgagcggatctgggagtgcaggctgcgcttcgtccacatcgataacagatgtttcctggtgaagatgtgtagggcgcagcgggtcacctggtcgggggagggcacagggcgtccctccacggggtgcctttggcgttgggcacttgtgtggtctccagcttccgggttttggaagcggagtgtcccctgcagcctgagcctcttgcaggtggtttccttgggacgaactcccagggggaggtctgagttctggggcatggtttgaagatttgggacacattttgcctgaaattccctgctggccgtttgaacccacctgtacttcctgaccaggggcacggattcttaacctctggtgcaggggcctggctaggagaggtctgcacagttggacgaggtgcaaagtgacgctttgtcagtaacccggcgttgagattcctgtggtgggacgagcagctcctatggctttatcccattttaagtccaagttttcttttccttctagtcctcgggctccacccagggagctgtgcccagacagcagaagggaaggatgtcacttctgagatgaggttcagaaaggcctgggctcctgtcctggctgctctctcccactccctgatgagcttgctggatgaaagctcctgtcaggctgtggggcgtcctgtggagaagctggcaagaaactggtgggggccctttccacctatagccagcaaggaactgaacccagccagcgtccacctgagtgagctcagaggtgggcctcagccccagttgagccttcggatgaggtcacagccctggtccatggtgtgactgcagcttcaggagggaccttaagccagaggtgcctggctaagcttcccgcagattgctgccccacaggagccaacatcaaaagcatttgttgttttgaggtggtaagtgtggaatgactgttacagggcagtagagaaggagcatgcacccttcctgcttcttatttgccttttagaaattgtcctctgtgaatcgcttgaacctgggaggttgaggttgcagtgagctgagatctcaccactgcactccagcctgagcgacaggagcgaaactcctccaaaaacataaattctctctgtgaaatatgttgttttgttttttttttttcttttctttttgagacggagtcttgctgtgtcacccaggctggagcaggcgcagtctcagctcactgcaacctccgcctcccaggttcaagtgattctgctgcctcagcctcctgcgtggctgggattacaggcgcctgccaccacgcctggctaatttttgtatttttggtagagacggagtttcatcatgttggccaggctggtctcgaactcctgacctcaggtgatctgcccgccttggcctcccaaagtgctgggattacaagcatgagccaccatgccccgccaacatttttttttttttgcctgtttttctacttggtttgtaggaattctttatactttctggatattaatcctttgccatgttgcaagtattttttcccaggttgtggctgttgatttcactttatggtatgtatatatatatatattttttttttgtttcttttttttttttttgagacagagttttgttcttattgcccaggctgttgtgcaatggcgcgatcttggctcatcacaacctctgcctcccgtgttcaagtgattctcctgcctcagcctcctgagcagctggggttaaaggcatgtgccaccatgccggccaactttgtatttttagtagagatggggtttctccatgttggtcagactgatctggaactcccaacctcaggtgatccacccacctcagcctcccaaagtgctgggattacaggcgtgagccaagtctggccttttttttttttttttgagacagggtctcaccctgttgcccaggctggagtgcagcggcgcagtctgggctcactgcaacctccccgtcctgggttcaagcaattctcctgcctcaccctcccgagtagctgggattacaggtgcataccaccacacctggttaatttttgtatttttagtagaaacagggtttcaccatgttggtcaggctggtctcgagctcccgacctcaagtgatccgcccaccttggcctcccaaagtgctaggattacaggcatgagccactgcgcccggcccactttgtggtgtactttggtgaaacagaattcttcatttagccaagttagtccacctgaccctttttttaatgggtcatgcttttggggtttggttagagaaattattgtcctaccccaaaaagggtcaggaagacattctcttatattttcctgagcataaagttttacacatttaagtttatcataagagcaggccacctgggttcgaatcgtgaccctgctgctgcaaagccgtgtctttccttcgtgtgtctcacgtgggtgataacagcaccttccccagagggctattgtggggattcaccgctgtgcagagagtgcttcggaccctccagcagcacagtcagggctgtgtcagtgttactaattgtcgctgtttgtgtactgataatgagatcagaatccagtttttctttttgcctggcagcatggacaactgtcctggtatcatagactgaataaagtttccttcttcagcaactcgtggtgcctccattctgggtacaccagacctgtttgtttgtttttttttgagacagtctcgctctgtcagccaggttggagtgtagtggtgcaatctcagctcactaaagcctccgtctcccaggttcaagtgatcctcgtgcctcagcctcctgtgtagttgggactactggcacccaccaccacgtccagctaagttttttgtatttttggtagagacggggtttcactgtgttagccaggatggtctcaatctcctgacctcgtgatgcgcccacctcggcctcccaaagtgctgggattacaggcttgagccaccgcgcccgacctcgaggtccttattcttttgcatttgtttactcgcccagccctgcaccaaggtctcagactgaactagaagtcctcatgtcttgggaggacggctgccgccccctccctgcgcctccgtctccttgcaggacgtgtttgtcttctactcatcgtgcgtgcatagctttctctctgattcacacatgctttgtgcgtgcatagctttccctctgtgattgacatgtgcctcatagggctggatctatctcgagactacatagcctcttgtttctaagctttatttttttctgggacagagtttcgctctgccgcccaggctggagtgcaatggcgcgatctccgctcactgcagcctccacctcctgggttcaagcgattctcctggctcagcctcctgagtagctgggattacaggcacgcgccatcatgcccggctaattttttgtagtagaaatggggtttgactgtgttggccaggaggatctcgatgtcctgaccttgtgatccgcccacctcagcctcccaaagtgctgggatggcaggtgtgagccagcgcgcccggccgtttctaagcttttactcagtagttttagtctcttggtgactcgtcgtgattgtgatgatgatcgtgatggtggccagatggtggcttctcattctgtcactctgatgatcatggattgactttgtgctgggaagaaagacttcccctcctttgccattcgttcatcagcatggccttgtgggctgttgttttactgggggttctgatcctttactgtgttacgtactctgcctttcaagccccctgcgccctccctcggccaaccctgagttcattcctagatcacaaactttcggcgcagccaacatgaccgctcctctggtgtctttcccaccacagcccgagagtcagtcatttttcaaagaagcctggttggctttgtggagaatgatatatgttattattattttttgttttgttatgttgtgttttttagacagtctcgctctttgcccagcctgtagtacagtggtgcaatcttggttccctgcaacctccgcctccgggttcaagcgattctcatgcctcagcctcctaagtggctgggactacaggcacccgccaggattaatcttttttttttttttttgagatggagtctccctccatcacccaggctggagtgcagtggcccgatctaggctcactgcaacctccgcctcccgggttcaagagattctcctgcctcagcatgccaagtagctgggactacaggcgcctgccaccatgtctggctaattttttttgtatttttagtagagatggggtttcattatgttggccaggctggtctcctgacctcatgatctgcccgtctcggcctcccaaagtgctgggattacaggcgtgagccaccacgcccggcctaattttttgtttttttagtagagactaattttttgtatttttagtagagacagggtttcgccacattgcccaggctcgtctagaactcctgagctcgggtaatccgcctgcctcagcctcccaaagtgctaggattacaggcgtgagccattgcgcccagcccctttagtggagaatgatatttagaaaccaaggttagggcgctgggagcgcgctgtgcaggtgtgactgtctctgggcagatgtgctgtgttggggtgtgtgtgtgcgtgcgtgtcgcccgtccgcccatccgttcaagcctgtgcgctcgggcccgacagcaccctcacaggccgacaccgcgggggtcattccatccatcttctttcttctttttatttatttatttatttgtttttgagacggagtctcactctgtggcccaggctggagtgcagtggcacgatctcagctcactgcaagctccgcctcctgggttctcgcccttctcctgcctcaggctcctgagtagctgggagtacaggtgcccgtcaccacgcccggctaattttttgtatttttagtagagacaaggtttcacagtgctagccaggatgatctcgatctcctgacctcatgatccgacccccttggactcccaaagtgctgggattacaggcgtgagcctccgtgcctggcctttttatttttttgagacagagtctctgtcgcccaggctggagtgtggtggcatgatctcggctcactgcgacctccgtcttctaggttcaagtgattcttctgcctcagcctcccgagtagctgggattacaggcgcatgccactgcacccagctaacttttgtatttttactagggatggggtttcaccatgaactcctgacctcaggtgatccacccgcctcggcctcccaaagtgctgggatcacaggcgtgagtcaccgtgcccagcctctttttttcatttttatttttattttttcactacaagactgccctgaaggacttcctttcgtgtttgcatctcgcttcactcacatgatgaaatctgcctcccgtcatgtacaaaatatttatgtatttgcccaatccggaattctaacccatgagtcagcaaaaaaaaaaaaaaaaaagaaaaaaaaagaaaagggaggctgggcgcagtggctgatgcctgtaaatcccagcactttgggaggccgaggcaggcagatcacgaggtcaggagttcgagaccagcctggccaacatggtgaaaacccgtctctactaaaaatacaaaatcagcagggtttggtggcacgtgcatgtaatccccactacccgggaggctgaggcaggagaatcgcttgaacctgggaggcgaaggttgtggtgagccaagatcgtgccattgcactccagcctgggcaacaagagtgaaactccatctaaaaatgaaatgaaaatacaaaaattcactgggcgtggtggcgggtgcctgtaatcccagctactcaggaggctgaggcaggagaatcacttgaacccgggaggtagaggttgcagtgagctgagatcgcgccattgcactccagcctgggcgacagagcgagactccgtctcaagaaaagaaaagggaaaaaagcatgtttagaactcggtatttgtttggagctcctgtgtctggagctacttgtgtgtctggagcccttgtgtccatcacctgcgtacccacatccagcgtccatgcacccgagttcccagggcttgttctgcttctcccctcagggtgattgtgtcgtttgtttgatctgtggtgtggttcatgcattcgtgttcgtgttccatttcagagacccttttcccctacccttgttgatttaattatttttgctttttaagcaagcgacatattttcatggttctgaaagtcagacctggagccgcccccacctcactgcactgcactcctgcctgccctgtcactgaagagtctccttattcttgggtatatccttcctgtatttctttttccttttcttttttttttttttttttctgagaaaacgtttcactgtgtcgcccaggctggagtgcagtggtgagatcacggtcactgcaggctcatcctcccagactcaagcagtccccccacctcagctgggcacacaggcgcacaccaccgtgcccaggcctaatttttgtacttttttggtagagatgaggtttcgtcatattacccaggctggtattgaactcctgggctcaagcaatcctcctgcctcggtctcccaaagtgctaggattacaagcatgaaccaacacacctgggcaaaaaatgctccaacttttttttttttttttgagacggagtttttgctcttgttgcccaggctggagtgcaatggcgcaatcttggctcactgcaacctccacctcccaggttcaagtgattctcctgcctaagcctcccaagtagctgggactacaggcatgcgccaccacgcccggctaattttgtatttttttagtagagacagggtttcttcatgttgatcaggctggtctcgaactcccaacctcaggtgatctgcccgccttgggctcccaaagtgctgggattacaggtgggaaccactgcacccgctggctgtcctgtttttttttttttttttttttttttgagatggagtctcgctctgttgcccaggctggagtgcaatggcgcgatctcggctcactgcaagctctgtctcccaggttcacgccattcttctgcctcagcctgccaagtagctgggactgcaggcacccaccaccacgcccagctaatttttgtatttttagtggagacggggtttcaccatgtaggccaggatggtctcaatctcctgaccttgtgatccacccgcctcggcctcccacagtgctgggatgacaggcgtgagccactgtgcccagcctcctgggatgacaggcgtgagcccccgcgcccggcctcctattcttaatttccaaggcccacttgggttgtgggtggtccccacttaccatggtctgagttgtgattttctgactttatgatggtgggaaagcaaacgccttcagcagaaacgctgccctgagctcacagccgtcctctctctcacttccggtggggttgtctgaatttcacgagcggctcagcgcgcttatagccactctgcattaggcggcttagcccaaatgtcactgatgtgggtgtcagcacgcggaggtggatgaggcacattaagagccaaaggacgggctgggggctgtctgtggagatgtcagtggccttgaaaagacagtgcactggggcaagcgtctcacgactgctgagtgtctaccctgcggcccacgggtctcctgggctgtgccccagacgtgagtggacagcaagcgatcctccctcctcggccttccaaagtactggggttctaggtgtgggccaccgccgctggccaaacatgaaggtttgacttacaactttgtggtctctggtctgaacaggcacctgcacctggaggactctgagaccctgtttccaaccatgatgttttgcacttgtgctctgatatgaaatgtgtttggtctttgttcctggttcctggcacagaagctcctcgaagccttggaatttcctgagtgacaggagtggttcagatcaccccggagcttatgctgatcacacctgagcttatgctgatgaggcagggggtggggccctggagagcgggggtaggggggactggtcgccagaacaccaggtgaccccaggattggaggctgggagctttgagccccacccgccaacctcagggacgcagcgagcgaaggtggagattaaacgctgtaaaaacccgtgaatgagagatgaaagagtgggatggtcttcggattgtggtgctgggggcagggggtggcgcccagagagggcctgaaacccagcacctgcccaggccttgcctgcgcgtctctgcggccggctgctcctctgttttcttttaacgtaagtgctttctgcagttctgtagggcagtcctgtcaaactcattgatcctcaggagggtgtcgtgggaaccccgatgtatagctgccggtcagaagcacggcccacaggctgaccagcatctgaggagggggcagtcttgtgggatccagccctcgccgcaggggacctggcactctccccagggggacggcttcgggagggaattgaaccagaggacacacagctagtgtctgtggagaattgctcaacgtggaaataacctgcatctcctgtgggaagtgttgtgtgggagtgcagagaaactgtgcattcctcacaggactttatttatttgcttgtttatttatttgtttgtttttggagacagagtctcgctctgtcccccaggctggagtgcaatgtctcgatgtcggctcactgcgatttccacctccagggttcaagcaattctcctgcctcaacctcttgagtaggtgggattacaggtgcccacaaccacacctggctaatttttatatttttagtagagacggggtttcaccttgttggccagattggtctcgaactcctgacctcaagtgatccacctgcctccaaagtgctgggattacaggcgtgagccaccaagcccggcctcccccatgtaaaccttgaactctcggaactacttaggaaggaccccgggctgtgatctctcacaactacttagggaggaccccggaaccccctggctgctcagctgggttccagcacctgaaggtgctgttgctttcccctggggcccgtccccgagatgagaggagcacgtgctggaattccctctttcaggcactttcatgcttttatttctacacgtggtgcttcccgcacagctgacagcgcatggtggagccgagtcgtgcgtttctgtctgtgattcgtccctcagtcttcccccgctccggtgggtttgggcttggggtccgtccctttgacactgggactgagcccctcatttccatcgtagcttcagctccatcaataaggtgtttgtttctactgttgacaggcacgtaggttggcattcttttggtgtttgctttgtcttgttttgctactaacaaaaaatgctcattaaacacccacctccaagacttctatgagaaggtgtgaagagcccacccattttcccgggaccgtttggccctctgtgacccaagtcagcctcggcgaagtgctttattttcttgttttttgtcgctccctgtcacccgcatgacctctgaaaggttgcacccagccgggcacggtcactcatgcctgtaatcccagttctatgggaggccaaggcgggcgaatcacatgaggtcaggagattgagaccaacctgggcaacatggtgaaaccctgtctcttcttttttttttttttttttttttttttttttttttttttttttttttttttttgagacagagtgttgctctgtcgcccaggctggagtgagtgcagtggcgcgatctcggctcgctgcaagctccacctcccgggttcacaccgttctcctgcctcagcctcctgagtagctgggactacaggcgcccgccaccacgcctggctaattttttgtatttttagtagagacagaatttcacagtgttagtcaggatagtctccatctcctgacctcgggatccctctgcctcagcctcccaaagtgctgggattacaggcgtgagccaccacgcccggcctaaatcctatctcttctaaaagtacaaaaattagccaggcttggtggcgcatgcctataattccagctgcccgagaggctgaggcatgcgaatcccttgaatccaagaagtgggggctacggtgagctgagattgtgccactgcactctagcctgggcgacagagtaagagtccctctcaaaaaagaaaagaaaagaggccgggcgcggtggctcacgcctgtagtcccagcactttgggaggcctaggtgggtggatcacgaggtcaggagatcgagaccatcctgggtaacatggtgaaaccctgtctctactaaaaaaatacaaaaaaaaacaaaattagccaggcgtggtggcgggcgcctgtagtcccagctacttcagaggctgaggcaggagaatggtgtgaacccaggaggcagagcttgcagtgagccaagatcatgccattgcactccagtctggctgacagagcgagactctatctcgaaaaaaagaaaaggaaaaggaaagaaaggtctcactagacagtttcaggccggaatctgtttgcatttgtaccgtcaggaatttccagcctgggaacagtcagtgacaggaacgaaccgtgggtgcctctgcaggggtggctcctgcctggctgcccttgagttggctgaggagctgagaacttggacttcaggattctctgacttcactggtctgacgtggagctcccagtgtttgaataagaagcggctgggcgtggtggcaggcgcctgtaatcccagttactcgggaggctgaggcaggagaatcccttgaacctgggaggtggaggttgcagtgagccgagattatgccactaaactccagcctgggcgacagatcgagattccatctaaaaaaaaaaaaaaaagaataagcagccagcctcaggcatttacgcagggacaggtgtttacgtggggggaagattagatatcgcctcctcctgcggccttggagctgtggggacagggatgctgggggtgaggacggttcatggtagtgaagtcctgcagattgggaggggaatggagaccccgggaccacgtgggctcaactgcagggacgggacagtcacccacacagagccggggcagggctgtgggagcacaggtcggtgtgacgttggctggggctcagcatgcgtgtcccagggctgggcagttccactcctgcacgtagacacagacgaggatgctcctagtagcccgtcccaagtgcttcttgccagaatgggtccatttgtccagtgggctgctgtgcagtgatcggacagagaacccgcgtcccagcgcagctgcatggagaggcctttgtttgcagtcggcttcttgtttaagctcttttaattttttttaacttttttttaatttttagagtcagggtcttgctctgttgcccaggctggagttcagtggcacaatcacggctcactgcagccttgacctctcttgttcaagcaatcctcccaccccagcctcctaagtagttaggactacagacatgcaccaccatgcccggctacattaaaaaaaaattttttttttttgagacggagtttcactcttgttgcccaggctggagtacaacggtgtgatctcggctcaccgcaacctccgcctcccgggttcaagcgattctcctgcctcagcctcctgagtagctgggattacaggcatccactacgcccggctaattttgtatttttagtagagacggggtttctccacgttggtcaggctggtcttgaactcctgacctcatgatccaccctcctcggcctcccaaagtgctgggattacaggtgtgagccatcgcgcccagcattttttttttttttttttttgacgggagtctcgctctgttgctcaggctggggtgcaatggcgcgatctcagctcactgcaagctctgccttccaggttcaagtgattctcctgcctcagcctcccgagtagctgggattacaggtgccagccaccacacccggctgattttttttttgtacttttagtagagacggggttttgctgtgtttgccaggctggtcatgaactcctgagctcaggtgatccgcccaccttggcctcccaaagtgctgggattccaggtgtgagccacggcgcctggcccagaaccttaagttcttgatgtacagagaacggcagcgtcagtgaagtgtgatttctgtttttttgtttccactaattgtgagcaaacattagggtggggactgggctgcttgtgtgggtcccacaggcttcttggagcacagtgtcagcagagaaggggaatgggggtcctcattgcggggagcagttttgcctgggatgctgtgagtttctcagagggaagctaagtggacagactgttctggcaagagggagatgcttgccttttgaattccaggtttgcctcgacgtcaggtgggacgtgactggcgtcgtctgcacacgcccgagcccacgtgctgttccttgctcctggaggggtttcttgagcgtggcctccttgccatgtaaatgaatttggttttagaaactcgctggtggtggcagagcctgtgtagcgggtgctgtgacagcgtccccagccagggggcagccttcgaggtgggagggagaggtcaagggccgtgaggcctagtgaggtggggagtgagatccacgcctgccatgagctccacccctgccttgcggagccctgtcgcgagtgctctgtccttttgctctgccgcaccctttgttgttggattttcacctcaggaaagccaggtagctgctccacccccagccagggcccatcagtccgggaaactggcacaaagtctcctagctccctggctcagggcccagccagtcctagctccagggaggctgcagcccatggaggtttagctcccagcttgttgtcaccccaggctaagcagtgggactgtgctgctgaacaggaagaagggaatggtgtctttgtggagatctggcactgtcagtggcccgaggagtggatgagtcctttgttattccgaggctgtgggaactggtggaggggtcggccttctcctcactgaggcctggggtgcccttggaggcagctgtcctggtgcaccgaggggtcagggcacacatgggtggcctgggagcgtctgggtggcactgagctggcggtgtgatgggcagacggggagacctgggtgcacagacacacacagcagggggaggggaggagagagaggaaggctgcagaggccctggcattgccgccactggggagagggcagaagcgcctgttcccgggtatggggaggccaagtttcaggcacctctgagcactgctgggcaggtgagctgggggagaggccggcctgagcacccaggcgaggtcttcatgggggagggggtggcgtgcgtccctcagtgtgaacacagaatatttatgtatacatatggcacgcacgcaagtgcataaacataaacacagaaggaggtcacgaatgaggtgggaaccccagtttcccgggggagaagtgagacgaggaggggtactgggtcgggcagcacggccggcaccacacgctcccagagcgccttggtgagacaggatgggcgccccttcagatgcacagcctcccccgaagcaggaagagaaacccaggtgtgagaaacaggaaatcgggctgcctgagcgctgggattgagacctgggggaggtggggtctcggtgctgcggagtcacagtggcgtctgtgcaaagccccagctggggggatgattcccactggacctcaggaggaaacggctgttctgaccttcctggagctcgtgggaagggagggggtgtctcgccccgaagccacagtcgcctgagcgtgaagcgggtgtaagtgtggttttataccacggagtctgtctagaaagtagcatggaactttaggaggccgaggtgggcggttcacgaggtcaggagatcgagaccatcctggctaacacggtgaaaacccgtctctactaaaaaaaaaaaaattacaaaaaattagccggacgtggtggcggacgcctgtcgtcccagctactcgggagcctgaggcaggagaatggcgagaacccgggaggcggagcttgcagtgagcccagatcacgcctctgcacttcagcctgggcgacagagcaatactccgtctcaaaaaaaaaaaaaaaaaggaaaaagaaagtagcatggaattagtcctgggcacccgacagcggcagccacaaagcccatcgagaaggtgcagctgccaggcagggcgtgaaggacccacagccccaggtctgccaggacgacagtcaagtgtgccaggagaccgtctctcaagagcaaggatccgccaacacgcgcagagaaaaacgggattcaattgctaaaaatctttggacagtgaacgattgcattttctttttttcttttcttgagacagagtctcactctgtcactgaggctggagtgcagtggtatcatgtcggctcactgcaacctccgtctcctgggttcaagcaattcttctgcctcagcctcccgagtagctgggattacaggcgccggccaccatgccctgctagtttttatatttttagtagagacggggtttcgtcatgttggccagggtggtctcgaactcctgacctaaggtgatccacctgcctcggcctcccaaagtgctgggattacaggtgtgagccaccgtgcccggcccaattgcattttcaaagtgattttaaattggtggttgaaacctttgaggacattaaatgttcaaaacgggtgatgtgtttccttttcttaatattttagcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtaggcggcggctcgggcagggtggaagccggccacctgccaccccacagggagcagccagcaaccacccgggagggccgggggagcccaggtcaggatgggaggccgggggtggagcccactgcaggcatgggaggggtgattctccctcttgtcttcggccccctccctcccgcaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtaaagaatctcctggttttggttgagtgtctctttttctttaaatgtaaagtccctctcgttactagagcggggactctgctggctggtgagttttcagtgcagactttataaaagcaccagggctgtccagatttcaggacaccaaatgaatgtggcttcgtggctctcactgccacgtgtgttcagtcagcttctttccgggctggtggtctcaggacagggtgcctccttgtctctgggacgttttcaaggggtggcagaagtcacttcccattggacgcagtgccgtttcctgggggctcgacctaaagcgtcacagaagcgggtccaggcaccatgttggtgatgaggaggtgggcggagaggggccgacgtgccaaccgagcgagcgagccccttggagagcctgcccggtgggtgcaggcagacagactcgttctaaggtgatggtgcttttggctcatttttaggtttgcaactgtggttttgggtttggtcagcctgaaaaatgtggcggtttcgtttgctgagacggtgaagagctccgcccccatcttcacggtgatcatgtctcggatgattctgggggagtacacaggtgaggcccccgggccccgcccctccgcctgcgccccaccatcccaggcctccatccgtggtgcccgtctctgctgcctgccatggggctctgccgcgaggaccactcagagtggtgcccacactggcagtgccttcacttctctcacggtcacatgtgcgggggtgtcttggagcctggcgtctgccaggtattctcacactggcatgcggaggtcagggcagggttgtgtctgtggccctaactgggtggggagacaggtgggggctgggcagattcctggcaagcaagattactgcaggtgccaatcactgatccgaagaggacgggtgggggccgccttcggccagcaccacacaggcggccgtggctcctggtccgtgggccctcctgtgccagcaccccacagcctctccagcacccgccaccacaggcctgtcctgggccccagcccctgacctcagctgcaacccaggctcctgcctctcccacctcttaatgactcacaggcgatttccagcgacatgtcagccccatgtcgcgtacccagtgtggctgcatgaaaaccagcgaggagcagaggcgcccacagagcgcggcgtcttgaacggagtcggggggtgcacacgtgttcgcttatttaagaaactacaagatcttaaggccgagggaagtgtctgtctgcctttggggacgggaggaggccgagggtccaggatggggttgggcttgccccacatgcacttgagacccgcacacacgtttaggtgattataacaaaatcaaagcctaaaagtcaactctggtttttttttgtttttttttttttgttttttttatgtttttgagacagggtcttgctctgtcgcccaggctgcagtgcagtggcgaggtcacgactcactgcaacctcggcctcccaggcttaggcaatcctcccacctcagcctgttgggtagctgggacctcaggcatgtgccaccatgcccagctaatttttgtattttgtgtgtctttttgttttttcactgtgaatatacgttagtcatttttcttaacaattgaaacttggaactctggggattcagaattaacagccttggctgtgagcttatcgataccagaaaaagtttggaccttgcgttccacgttattctgctgggctttgtccgaatgaacccttgtgagctgctgtgtccatttcacgccgattctcctgcccacaatttcacctgggaagaccgagtcctcgaggattgcgacgtgcgcagctgtcggagcgtggatcctgggacgcttttgcttattttttgtacaccttttttgagttggtttaggcagaattttcctctaagcaatagacgacatacttaccagtgaactttttctccaattcacgtactagccagacttggatgttctggaattatttcagtggcagaacaggaacaaagattatgataacttccttttttttttcttttttttttttttcttttttgagaggagtcttgctctctcgcccaggctggagtgcagtggcacgatcttggctcactgcaagctccatctcccgggttctcgccattctcctgcttcagcctcctgagtagctgggactacaggcgcccaccactgcgtccgtctaattttttgtatttttagtagagactgggtttcaccgtgttagccaggatggtctcgatctcctgacctcgttgatccgcacgcctcagcctcccaaagtgctgggattacaggtgttagccaccacagccggccctcttttttttgagatggagtctcgctttgttgcccaggctggagtgcagtggcgcaatcttggctcactgcagcctctgcctcccgggttcaagtgattctcctgcttcggcctcctctgagtagctgggattacaggcatgtggccccacacccagctaatttttgtatttttagtagagatggggtttcaccatgttggccatgctggtcttgagctcctgacctcgtgatctgcccgcctcagcctcccacagtgctgggattccaggcgtgagctgctgcacctgcccataataactttctcaccaccaccaacttcagtttccctcactgctgtaatattcagctccctgagctgggccttgaggtccgagttcatctccagctccagaagaatctaagaaggcaagaacaccagggtcaaccctcagtgcgtgtatgagcacccccagcctcatttttgtgttttctatagagatggggtctcgctgtgttgcccatgctggtcctgaactccttatctcaagtgatcctcctgcctcggcctcctaaagtgctgggattacagccatcagccgccgtgtccggctttaaaaagcaatcctaaaaatcgtaaacaaaatgacacagaggaaccttattgcgcatcgagccatgcaagaaaggagccgtttatttccagcaagtttaaacatcgatttgacctccagccatggtcgatgagatgttagaaaaccaactctcttgctgacaacaatgagaaaatcttgataccatttagcaaaaagaagtctgtgggggaggcgttggagagtgacggaactgccagggcctgaggcacccggcttccggtgcctctggcagcccagagaagtgactctgtctgtcttaaggcaccaccctccccggtgcatttgctgatggtttctgagcagagcagtctcctggggctggaggggcacaagctggaatgggcgccccaccatggggacccccagatgccagaccttcaactgagataggaatctggtgctggatataggcgtctatggcaccccagctgcatgtcaacagcagcagcaagccctccttgaagggtgaaacggcattcacagtctccagttttctctacaattttcataaatgttgtccgtgattcaaccagagtttccagcagaggccgagaccaggtgacggcagacgagaggacgcccctctggctggagcctccccgcacagactcgggtccctctgctacgccagggtctcgactgggcagtatctgtgggtttcccacgttaacttgtctcaggtttctctttcttcttttgagacaaggtctcactctatcgtccaggctggagcgcagtggcatggtcacagcccactgcagcctcggcctcccccgtgcaggtgatcttcccacctcagcctccccagtagccgggacacacacccagctaatttttgtattgtttgtagaggcggggtctcacctttgctcagccctgttcttgaacccctgggctcaagtgatcctcctgcctcagcctcccaaagtgctgggattacaggtgtgagcggtgttccatagattttttaaaaatccttcacgtaaaagttttttgttacatttcagaaggaaacagaaaagcataaattcaatgtgggcatccccctcccggcccacagggcctctttctctgcagttccctggggaccatctccttcacactcaccgtttcacaggagcgttcacagaatcaggaaggtttctgtggctcacctgcccatggctggggctcagtctctgggggacgcatctcatgtagagtgaaaggcgccacctttgccgtggggacgggacttatttgcagacacggactttgatttgctttatctcacaatgtgaagaaactgacaagtattgtttttgaattgaaggaagcatccgttcctttcataagaggggatggaaacagcctggccctcgggagggagcgtccgcccggcgggtcagccactcacaggggctgtcctctcgccagggctgctggtcaacctctccctcatcccagtcatgggcgggctggcgctgtgcacggccactgagatcagcttcaatgtcctggggttctcggccgcactgtccaccaacatcatggactggtgagtcacagagaaggtgggcgtgagggggacgagacccggtgctcacctgcatctgggtgtgcagattctcaggtgagctgagaattcctcccgtgagccaaagcaggtgcgtccaatgctgccctttcctaaagagcaaaacaacaggtatccccggcaggtaagtttctcaaaaataagccgaaatttcaggatggacggtcttggtacttaaaatgctaaccatggagacacggttagctgacaaatgctgaaatacgcagatacgctcagcagtgtgtctcgctcggtgtgtcttcatgcggctgccagagcagggacagtcccccagcggcaggttctgcctgtttgggagctgcgcggcctccaggtcgggcggatcctctgcttccttgtggccatctgtgtcctggtgtcacgatggcaggaaggatgagaggccgactcccacagcgaggacagcgcgtggcaggctcccagaggagagggccctgttatttacgtctttgtcactcggtagagaagagcggtggacgctgcacttcgggggccgttcagattcacccagaattgggcgtccacctccctgccgtgctgttaatggccacactccagccccggcaaaacctgccctttgagaatgaccggcttctaggcttttcctgcttttgaggaaagaaaggaaaagacaccaccactggtgtctgagagtttatcattattactgataatcaaaacaggtttgtggtgagattttgaataatacagaagtaaaaataaaaatatgttgggcacagtggctcacgcctgtaatcccagcactttgggaggccaaggcgggtggatcacgaggtcaggagatcgagaccatcctggctaacatggtgaaaccccgtctctactaaaaatacaaaagattagtcgggcatagtggcggacgcctgtagtcccagctactggggaggccgaggaaagagagtggcgtgaacctgggaggcggagcttgcagtgagccgagattgcgccactgcactccagcctgggcgacagagccagactctgtctcaaaaaaaaaaaaaaaatctgttgggcgtggtggctcacacttgtaatcccagcactttgggaggctgaggcgggtggatcacttgaggtcaggagttggagaccagcctggccaacacggtgaaaccctatctctactaaaaataaaaaaagtaaccaggcgtggtggcgggcaccactgaggtctggtcattgtcgccatcgctccgtgtgagcgcagacaccttctccccctgatgttccgtgccgaggactagtattgatgcataacctcttttctttattctagtttgcaaaatgttttttcaaaaaagctgctcagcggggacaaatacaggttctcgtaagtattattcgtcagtgaaatctccaagtcataagacgaagaggacttcctgctcactgtaagagtcagaacaccccacaggcctgactcccttcctgtctggcttgggtggcctttacaagtaccctgtctaagctcgggagggacccgcccgtttctcagctactcccttgagcccctcagccagcctggtgtgcgtttgcgttttcatttctgggaagctgcagcaccctagtcctgtctagagagaatgaacgtcttctgggctggggtgcctgggtgttcttgctgtgagggagctgcgtgtgaactcggcctgtcccgacacggggggcccagcgtgttctgtcacccacagggccccggagctgcagttctacaccagcgccgctgcggtggccatgctcgtcccggcccgggttttctttacggtgggtttcagacacaggcgtcccgtccttacttgccgggctgccttctccggtgattcaggagcagaatgacttccgtttccaggccgtgtgctggctggttgggcccagctccgctgcgggtcctgcttagctgagttgccctgggagccactcggggtttgcagctcagatttctgtgtgaagacttttattttgtttattgtttgtttgttttgttttgattcttcatcattcaacttgagatgacttttaggttagcttaatttcttttttttattagaaaaactttttttttttatttttataaagagtctcgctctgtatcccaggctggagtgcaatggtgtgatctctgctcactgcaaagtctgcctaccaggctcaagttattctcctgcctcagcttcccaagtagctgggacctgcaatttgtagacttccctagagtcccccacacagagggttctctgtgtgagatgcagtttcaagttcttattgcggttttctggattttaatccattagctgtcaaggctgactgacttggccattctccctgcagggaagttgtggttgccggccagggccatcagttcttgtgcgtgtatacccagcagtggaagtgctggattatataataattctatatttaatttttttttttttttttggagatgatatctcactctgttgcccaggctggggtacagtggtgcgatctcagctcactgcaacctctgcctcccgggtttaagtgattgtcctgcctcagcctcccgagtagctgggattacaggcgcccaccaccacgcctggctagtttttatgtttttagcagagacgaggtttcaccgtgttggccagactggccatgcccggccccgcattggggtttctgttgcattttcctgatgatggtgacgttcagcctctttcatgtgcttgttgtccatttgcatctgcatggtgaaaattaattagtgcaaaaaataataaaaacaaacaaacaaaaaaaacagaaaatggatgagtgcacagtccagctgtccgctcgaggcattttcagggctgtcctcagtggcagcagctttacccagtttctgggcaggagtggcgctgggcgtttttggtggatgattagtaaatggaaaatggaaaccgatagagtacccttttgtttgccacataggacgtcccagtgatcgggaggagtgggaagagcttcagctacaaccaggacgtggtgctgctgcttctgacagacggagtcctgttccaccttcagagcgtcacggcgtacgccctcatggggaaaatctccccggtgactttcaggtgagcagaggaacttcccaagagttgagtgtgtccaggttgtttacaaaggagaccagaaatctaggtatttttataagggacacatgtgattctcttccacggggatgagtgtggctatgcagtgtaattactaggctattttatacccatgctgtttgaaatgcaaacgataggccgggcccagtggctcatgcctgtaatcccagcacttgagaggacaaggcaagtggatcacttgaggtcagtagttcaagaccagcctggctaacatggtgaaaccccatctctactaaaaatacaaaaattagccgggtgtgatgctgggcacctgtaatcccagctactcgggaggctgaggcaggagaatcacttgaatccaggagccggaggttacagtgagttgagatctcaccactgcactccagcctgggggatgggagcgagagtccttctcaaaaaaaaaaaaacagaaaaacaaatgagaaactgtaaaataaaccgtaaactgtgtgaaataggtatttagggaaatctccactagaagtctctgcgtttgaaggtttttgaaattgagtgcttttctgtctagaatagtcgggcgttgcgactagtcttgtctgcaggaatggaatggtctcttctgggctgtccagtgcaggagccactggccacatacagcttctgagcacttgaaatgtggagaatataacaagaaccagattaggaattcaagctgattgctgtcagtttgaacttgaacagacacctgtggccactgcttcctgtgccgtgcggtgcagctctagaaacggggaggatccttcagcttctttccacttctgtaactgggcagattgaatgaagctgcaatttatttgtttatgtattttattttatttatttatttttttgagacagagtctcactctttcacccaggctggagttcagtatcgcagtctcggctcactgcaagctccgcctcccgggttcacgccattctcctgcctccgcctcccgagtagctgggactacaggcgactgccaccacgcccggctaattttttttttttgtattttttagtagagacagggtttcaccgtgttagccaggatggtctcgatctcctgaccttgtgatctgcccgcctcagcctcccaaagtgctgggattacaggcgtgagccaccgcgccctgcctatgtattttatttttcccgaaacagagtcttgctctgtcacccagagctggatttctctggtttgatctcggctcactgcaacctccgcctcccgggttgaagtgattctcctgcctcagcctcccaagtagctgggattacaggcgtgtgccaccatgcccggctaatttttgtatttttagtggagacggggttcaccatattggccaggctggtctcaaactcctgacctcaggcgatccgcccgcctcggcctcccacagtgctgggattacaggcgtgagccacggcgcccggcctccacagtgctgggatgacaggctgagcccccgtgcccggcctcccacagtgctggggttacacacatgagcccccacgcccagcctcccacagtgctggggttacaagcatgagcccccacacccagcctcccacagtgctggggttacagacatgagcccccacgcctagcctcccacagtgctgggattccaggctaagccgctgcgcccggtgatgttcttgttctttagagagcaggctgaagtactcaggggtgagatgtcatgatacctgtaatttacttaaaaatatttcatctgggtgtggtggctcacgcctatgatcccagctctgtgggaggcccaggtgggaagatcacttgagcccaggatttgaagaccagcctgggctacatagtgagacccacctcgattggatgaagctgatgaggcggatgtcatgaattcctgcgtctagatcacaggacgtggccgttacttaggtttctcctcctctgccttttttaataatgaaaagtacccctcaaaaaagaagggacgagggagcaggcaagccccgctgaaagctcccaaacccctgggctgatctcaccaccaccgaggtcccgttgagcacccccgccccatcctggcctccagacccggggtcagccgagctgctggccgcagggctgatgtcaccgtgacgctgagtcccccaaccccacccagcctccagacccaggctcagccgagctgctggccacgggctgaggagaccatagccctgagcgcccctgctgcctccccttgcctccgcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagagaccagaccagtagctgactgtgtccgccgagcccatccccgtgtagtgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcgtgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggcgccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaaatgatcctcccacctcagcctcccatgtggctggaaccacaggcacgtgccaccatgcctggctatttttttgttgagctgggctctcgctttgttgcccaggctggtcttgaactcctcggctcaagcaatccttcctactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgtggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggtaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcggtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatggactgctttgttttcttccttgtggaactctggtgttcatgctactttgttcaccggtgtggctggctgttgctagcaaagaggctcttcacagaagtggctgaacccaaagttctggttgggaaaggcctttgtggcagctcctatcaagcgcaagtgcgaggccaccccctcctcgtgggctctggggtcgattttgttagggtttgacatgagtggctgcatttgggtactcacagatttcacaaaggaagggtaaactggagatttttggccgggcacggtggctcatgactataatttcagcactttgggaggctggtgggcagatactttaggtcaggagttcaagaccagcctggccaacatggcaaaatcctgtcgctactaaaaatacaaaagttagccaggtgtggtggcgcacgcctataatcccagctactcgggaggctgaggcaggagaatcacttgtacccaggaggcggaggctgcagttacccaaaattgtgccactgcactccagcctgggtgacacagcgagactttttctcaaaacagaaaaaaacgtgctgtggctcacgcctgtaatcccaaccctttgggaggccaaggcaggcagatcacaaggtcatgagatcaagaccatcctggctaatacagtgaaaccccatctaaactaaaaacacaaaaaaattagccgggcgtagtggtggacgcctgtagtcccagctactcgggaggctgaggctcgcaggataatggcgttgaacccgggaggtggggcttgcagtgagccaagattgcgccactgcactccagcctgggcgacagagcaagactccgtctcaaaaaaaaataaaaataaaaaaatagggagatttccccagttaccaagaactcaggaagcaacattaagagcttgggggaggccaggcgcggtggctcacgcctgtaatcccagcactttgggaggcagaggcaggctgatcacgaggtcaggagattgagaccatcctggctaacacggtaaaaccccgtctctaccgaaaataaaaaaaaaattagccgggcgtggtggcaggcgcctgtagtcacaggtactcaggagcctaatgcgggcgaatggagtggaggcgggagaatggcgtgaatccgggtggcggagcttccagtgacccgagatcgcgccactgcactccagcctgggcaacagagcgagactccgtctcaaaaaaataaaaataaaaaaagagcttgggtacacaaagcaagcagcatttcattccgggatgaaaaaaattccgatacccatcgcccttcttgggcccttgtcagtttcttgccacatctttcattttcccatttcaggcccagtaaatgcggatgtttatcttccattgtttgtttcctgagattcagatgtctaaagcatttttctgtgacttttcaagtcaagaggaaaacctgacatatggaaagggaattaattgctcgttttatcctcttctcctgcaatgctctgaatccatgggtttggagtggggccctgggagttgggggaagcaccatacccagtgagtctgcactttgaggacccactgccagtgtcagcttcaaaatcacattgtaaaaggccgggcgcggtggctcacgcctgtaatcccagcactttaggaggacgaagcgggcggatcacttgaggtcaggagttcgagaccagcctggccaatatggcgaaacctcgtctctaccaaaaatataaaaattagccgggcgtggtggcgcgggcctgtggttccagctactcgggaggctgaggcaggaaaattccttgaacccgggaggaggctgcagtgagccaagaccacgccactgcactccaacctgggcggcagagcaaggctccgactcaaaagtaaatacatgaataaataaaataaaatcacatcgtaagagctctccctgctttgtttctgagtaaggttcagagttaaattccgagatcggcctttacaagacacacagacctgaggcgcctcacgaggtaaccagcaggtaaatggagcgcgctccacccacccgccactaggggtcccagcggtcaagggggtggaatgcgggcgtccatcgcgaaggcattctgctcgcaagccttggcacaggcgcgggcttcgctaccggaaaagtcccggtaggattccggaagccggccacgcgttccgcgcaggcgcaaactgctccaaaagtgggcgtcgctcccccggagtcccgattcctgcgtcacagcccgcgccgaagtcggaagtgcgctcaccgggctgtttcttctggcgtcctggacctgagcaagcgctgttttatgcgtcatcatcccgcgcagacacaggaagtgccgcacagagcgagcccctgtccttgtctcgagttctgggccggaggtcggctattatatcatcattacgcgccaatacaggaagtgacgatacttttggcgcgcgccggttgctgtttcttctctggctccgggaccggcggcggcggcggcggcagcggcggcggcgtaggggtgagttccgactgggcggaccaggtgtgggagcgcgaggagaactgtgcaccgaggtctttcttccgagcaggcctcggagcggggcggacccgggcccgggggcgagcgacaccctcgcttccgcggacagtctcatcccgcacggaactttgggtggtggaggcggcgggtccaaacgctgtctggagccaacgtctgccaggctgaacctcaagtgtgtgggactgaacccgaggaaatagcccagtgcccgggtcaggtggccttgttcgcgagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcacgtaggtgttgttattctggttgtacggaagactaaactgaggtgaattacgttacccaagaccatacaagaatgacagaaacgagacttgatttcaagcggtcatttttcagaacccatcactcttttttgtcgcccatgctgcagcgcagtggctgttcacaagcgcacttcagcctggaactcctgggctcaatcggtctcccatctcagcttgcagagtatatgggactacaggcgctcgccaccttgcctggcttacaacttatcattcttgtttttttttctttttttttttttttttttttgagacggggtcttgctggagtgcagtgacgcgacctcggctcactggaacctccgcctttcggattcaagcgattctgctgcctcggcctcccgagtagctgggattacaggcacccgccaccacgcccagctaagttttgtatttttagtggagacagggttttcgccgtgttggccaggctggtcttgacctcctgaccttgtgatccacccgcctcagcctagagcttacctttttttttttttttttttttttaaccaagtcttactttgttatgtaggctggagtgcagtggcgcagtcttggctcattgcagccttgacctctctgattcaagtgatcctcctgcctctagcagcctccttcctgtagctaggaatacaggcacgcgccaccacactgggctaacttttgtattttttgtagagacgaggttttgccatgttgcccgggctggtgttgaactccggaactccagcgatctgctcgcctcggcctcccaaagtgctagggttaccgtcttgagccactgcgccgggcacaacttcttattcttaatgaggatttattctgaatccctcaaaagtgactaggttcaagtgttcagcaccatagcttgctgtgtcctgatgtaggctgaattatttttctttttgcagtgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatattttttaagtaagtggttttcttaaaggagatttaatttctttgccctcatttttccattagaacaacgcttcttcggtgaagttcttttgtacttccaaatgtcgcaggtgagcccaaaatctattctaaaaattaacaaaaacattcaaatattcagttgacattaaaggcagatttaacacactaaagctgtgtctagattgagcatacatggagaataaaatacgttgaatgttaagtcattagcaaaactggactaatttttctcggttcattagtatgttcataatactatctctaagtatttttaatatagtgggaacttgccttgaaattaatataaatattttacatctttcttggtttgcatggtaatgtactcaggaaacctttttagtaatttggtaagaggcattggcaaagtacctcttttgctaagatctttagcagcatcatttgggatgttagtgagtacaggcataccttgttgtattgcacttcactttattatgcttcacagatattgaaatttttccaaattaaaggtttgtagcaactctgcattgagcatttttccaatagcatgtgctcactttgttagctttttttttgtttttgagacggagtctcgcactgtcgcccagggccgggttcacgccattctcctgcctcagcctcccaagtagctgggactacaggggcccaccaacatgccaagctaattttttgtattttttagtagagatggggtctcacggtgtcagccaggatgatcttaatctcctgacctcatgatccacccacctcggcctcccaaagtgctgggattacaacaggcatgagcctccgcgcccggccttttttgtttgtttttgagacagtcttgctccattgcccaggctggagtgcagtggcatgatctcagctaactgccacctctgcctcctgtgttcaagcagttctcctgtctcagcctcctgagtacctgggactacaggcacctgccagcacgctcggctaatttttatatttttagtagagacgagctttcaccttgttggtcaggctggtctggaactcctgacctcaggtgattcacctgcctcacccagcctcccaaagtgctgggattacaggcgtgagccaccatgcctgacctaaaccaaacttttatatgcgttgggaaaccaaaaaatctgtgtgactcactttattgtggtgttttggagccaaacccaaaatatctccaagggatgcctgtaccatatgaggtatcacaaagtatttggtttgcaagatacgccttaagattcatttttggctcatataagcaactaacatacttggcatagagtctaatgtcccttgtcatatatgctatttttaaatttctcatctcaggtttcagattacagagagttgtaattttaatgtgataagatttgaattaaagtttgtttgtttgtttgttttccctgatacggagtctaactctgttgccaggctggagtgcagtggtgtgatctcgggtcactgcaatgtccgcctcccgggttcaagcagttccggtcactacgcccagctaatttttgtatttttagtagagatggggtttcactgtgttgtccagggtggtctcgagctcctgacctcgtgatccgcctgcctgggcctcccaaagtgctgggattacaagcgtgagccaccacacccggccaaaagttctttatattttataacactggctcattcagagtatatatgaaagtttgttttgggatgttgcccaggtttgattatcattaaaaatacttttatctatgaagaaaaaaaaacttataaagaaaatgattaactttctctttgcttcttagtctgatgaccgggattccaagcgggattcccttgaggagggggagctgagagatcaccgcatggagatcacaataaggaactccccgtatagaagagaagactctatggaagacaggtgagcggatgtacagatgtgcaagacccagctgtacacagccctggcctggccggtccttcctagggtcactgtgacaactgtgtgctgttgtaactattaaggtttactctttcctagagttactgtgacatagcgtaactattgaggtttttatgtcacagttgtgactgactctcaagtgttgtctgtggccctccagacccttgccccttctttctgtaaagaactttgccatgtgttacactgattaataaaatatactatataggattttgcacaggccaggtgtggtggctcacacttgtaatctcagcactttcggaggccaaggcgggctgatcagctgaggtcaggagttcgagaccagtctagccaacatggtgaaaccccgtcttaaaaggaaaaaaaggccgggcgcggtggctcacgcctgtaatcccagcactttgggaggccgaggtgggcggatcacaaggtcagaagatcaagaccatcctggctaacacagtgaaaccccgtctctactaaaaatacagaaaattagccgggcgtggtggcaggcgcctttagtcccagctactcgggaggctgaggcaagagaatggcgtgaacccaggaggtggagcttgcagtgagacaagatcatgtcactgcaccccagcctgggcgacagagcaagaccccgcctctaaaaaaaaaaaagggaaaaaaaagattttgcacaaataaagtagaatgctgaaagatacctgaggagggccgctgatgagaaatgttcatattggccggacgcggcagctcacgcctgtaatcccagcactttgggaggccgaggcaggcagatcacttcagcccaggagttcaagaccagcctgggcaacacagggagacctcgtctctacacaaaataaaaaaaagaagatgagaaaaactaaatgagttttcctgccatagcaggtgcccctcatggtcatcatcagggttttcagggcctagcttctaagcacccctgacagagcctagaatagagacaaggaaatggatgagactggggtaacagagcaagaccctgtgtggaaaaaaaggaaatgttcttgttgagacctgtgtgttccgacgtttcttcctgtgccatgaactgtttctcgtttgttttcttctcatatctagctcgtatccgtcatcaggtattagtaattaaaggaaacacagccagaaattatggtataatggttttcctgagaagcttaaggtgtgaattttcccagaattttggtgatacagaaatcagctgaagatactgttaaatgacgctttgagattatgaagattgttttgttgttgttgttgttgctttgacacagagtcttaccctgtcgcccaggctggagtgcactggcatgatctcggctcactgccacctccagctcctgggttcaagtgagtctcctgcctcagactcctgagtagctaggattacaggcatgcgccaccacgctcggttgtgtgtgtgtgtgtgtgtgtgtgtgtgtgtgtgtgtgtgtgtgtatttttagtagagatggatttcactgtgtggtcacactggtcttgaactcctaacctcaggtgatctacttgcctcagcctcccaaagtgctgggattactggcgtgagccactgcacccagccaaaattgtaggatcttttaacagatttattggggaataaataacataaaatgagctgcccttgtttaaatatgatgtgaatggctgggtgcagtagctcgcgcctgtaatcccaacactttgagagactgaggcaggtggatcacctgaggtcaggagttcaagatcagcctggccaacatggtgaaagcccgtctctactacaaatacaaaaattagcctggcatggtggtgtacacctgtagtcacagctactcaggaggctgaggcaggagaattgcttgaacctgggaggcaaaggttgcagtgagccaagattgtgcctctgcactctaggctgggggaaagagcgagattctatctgaaaaaaataaaaataaagccgggtgcggtggctcacacctgtaatcccagcactttgggaggccgaggtgggtggatcatgatgtcacaagtttgagaccagcctgaccaatatggtgaaaccccgtctctactaaaaataaaaaaattagccgggtgtggtggcgcatgcctgtaatcccagctactcctgaggcagaggcaggagaattgcttgaacctgggactggaaggggaggttgcattgagctgagatcccgccactgcactccagcctgggcgacagagcgagactccgtctcaaaaaaaaaagaagaagtcacatttggtgcagaagtggtagacatggaaacagcacagtgaacgctggacgaggctgaccaagagaactgtcctgagggagtgagttttcactgcatctggaagtaagaacgggtgtgatttgattgagggaagacaatgaagggatcagaaatctgcatgtccggccgggcgcggtggctcatgcctgtaatcctagcactttaggaggctgaggtggttggatcccttgagcctggacgtcaaagctgcagtaagctatgaccatgctactgcactccagcctggttgacagagtgagactgtctcaaaaaaaggagaagggagatcctaaaaaccttgaaacactctggaattcgggaccctggactcccaggactcctggccattagtttatatattcgttcccctttatgagccagattcccaagaaagaacatcggtgtagccccagatctgttctgtgaaccaggaaaaaggctgtaggccaggtgggagcaggcccatctccgccttcagagtgagtccacagaaagcttgcaagctgctccaggaagagaggagtctgaagcggaagggcgtgtgcagcgatgtttgccagcagccagggctgggtacacagcatgtaaagatgatgagagggcgctggttcttgttgatgccgaagggtgtgggagacactgaggcccaggggtcaaggtccgagaccgctgcggggtgagcaaggtttcagttggcctagttcctgttagtgtgtgaaacattcatgtatgccacaccctgtgccagacattggtgtgtcttgtcccacgagagtacagcttgggatagaagtggaggttggtagatgaaatttgggctgtcatattgatttcccagaaggtaaagacaggagagtgaatgagcaaaaattgttgggggcagacttctgggtagggccgattcagatcagccaatccagaactgggtatggtagcatatgctacgtgggaggctaaggccagaggaccgcatgacgccagcctgggcaacgtagggagaccttgtctctgacaaaaaggaaactgataaggataatctgagaagcactgatgcttggaaaactgctgagctgtgggtgaaagcagtaagaatctgaccttctggcctgagagctgctccctttactgcttccactctgcacttgggaagcacggaggttccactgggacagggcagctgcaggacctgcagtttccttgctgccttggaaggggttactccgtttagagcagtgggcagtggccttgcccaccagcatcctcagtggagggaggaagaaaaggccaagaggtctgctagaatgaagtacagtgtggttgggagcagctgtgatctcgccaaagacgtgcagcagagactggagagagctcgagccgccacccacttgtgaccagccctgaggatgcagctgcgtgaaaggacctggcagaaaatagaagccgccacagatgcgaatgacgcctgaacgttcagtgtgctccctgtccacacacagccgtgggccaaggaagccttactgtgctcgaggtatttgagcccagcctttttccagtgctggctaattgctaagctgtgcagccatggtggtgacccctaggaagccaaggttgaaaattaaaataggcatgggggaaggaacggggtggccacgagctgtgagggagatggatttcacggacaaccagacaggcctcggtggtaacaacgaaagggaaaacttagaatccagaattgctacaaatgtattatctaaaatacaaagaagtatgacagtgtgacccatactgaggaagaacatcatcagtaaaaactgtctgagtgtccagatgttgaatttagtaaaggcttggaaacaacttgtggatggagcagtagaaattatccattctgaagaacagagagaaaaaaacaagaaaaatgcacagagcctcagaaacccgtggtacaacatctgctgtaccaaagcacgtcgaatgggggttccaggagagaggaaagatatttgttacaataatggttaaaaactttccaaattttaattaaaaaatatgcacattcaagagcacaggaagtttgaactagaataaatgcaaagtcacatcatagtcaaactggcaaaggccaaagagaaaatgttgaaaggcctcagagaagaatgacccatcccatgaaaggggagcttcaataccgccagccactgacttcttagaaacaatggaggccagaaggcagtggagtggcatactcaagctgctcagagagaagaaccatcagccaggaatcaaaaccgttctacacaagtgaaagggaacgaacaacattccctgagaagcagagactggtgggattcattgttggcgaaacctgccttaaaggaaatactaaaggaagaccttcaagttgaatagaaatgacaccagacggtaacttgaatcctcaggaaggaaggacaggcactgcagatagcaagtgtaggttgacgtcaatatcctgtaactatctctcctcacatcttaggttttactggaactacgattgtataaaataattacactgttgtcatggtatgtggcataaatggactgcacaaagaagacagggaataaagctgtgttacaacagttttatattgtactggacttgagctagtatcatgaggcatacggtgatccctagagcaaccactaagaaagttgttttcttagtgttttaaaaagtacaaataaattaaaatggtatgctaaacatatgtaatttaaaatcaaaaagggaagaataaaaaagacacaacaaagcaaggaaagtaaatccaactgtacgtgtaattatatgacatatgaaaggtctctgtgccccaaacagacggggcagattatcagatagaaaaacaagatctaactgtatgctgtctgctagagaacaggaaaagacgcagcgtacaaacatcagctgtcataggagagcttgaatggctgtactcataccagacaaaacagatgttaagaaatattagaaaccagcctggccaacatggtgaaaccctgtctctacaaaaatcacctgggtgtggtggcgcacacctgtaatcccagctactcgggaggctcaggtatgagaatcacttgaactcgtgagatggaggttgcagtgagccgagattgcgccactgcactccagcctgggtgacaaaccaagaccctgtctcaaaaaaaagctagaaacaagaaggagcaaggacttcacagccagaaacaggccaatacagcaggaagatacagcaatgatacgtgtgaatgcatctaaccacagagcccaaaatccatgaagcaaacaccgatcgaatggaaagaaatggatcatttattaattagaattggaaatggcagctgggcacggtggctcgggcctgtaaacccagcactttgaaaagcggaggcaggcggatcacgaggtcaggagattgagaccatcctggctaacatggtgaaaccctcgtctctactaaaaatacaaaaattagctgggagtacagggcgcacgcctgtaatcccagctactcgggaggctgaggcaggagaatcgctcgaacccgggaggcggaggttgcagtgagccgagatcgcgccaccgcactccagcctgggggacagatgaagactccgtctcaaagaaaataaaataaaaaaatgaaaaaaaaacttcacggattgaattacgtagaaagccagtttacaaatgtggacaaaaacgcgataagcaagcttctgtttagggggaatgatggcgtgtgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaaggtaggcggcgcggtgggcagctgtgctcggcgggacgcgtgtctgctgccccctggtgctgggcacttgctgtcacaggcgggcgcttggttccggtgcttgcttttcgcccctgccttttttttttttttggaggcagagttttgctcttgtcccccaggctggagtgcggtggcgcgatctcggctcactgcaccctctgcctcccgggttcaagtgatcctcctgcctcagcctccggagtagcagggattacaggcacccgccaccatgttcagctatttttttatatttttagtagagacagggtttcaccgtgttagccagaatagtctcttgatctcttggcctcgtgatccacccacctcggcctcccaaagtgctgcgattacaggcgtgagccaccgcggccggccagtacgagcttttatagtcacccacgtcctcaccttaatggagatctttatttcttcacccagcttccggtttctgtctcgcgtcctttccttacaccccacacaactccctggagcttattcttcaaggcaggtctaggtctagtagtaatgaactccctctgcttttgtttatctgagaatatcctcatttctccctcatctttgaaggaaagtttgctggatacgtggttcttggttgacaattttgttgttgttgttttgagacagagtcttcttctgttgcccaggctggagtgcagtggagcgatcatagctcactgcaacctcgaactcctgggcacaagtgatcttcccacctcagcctcccgcgtagctgggacctacaggcgtagcgtgtgccaccacacctggctcatttttcagtagaaacaaggtgtccctgtattgcccaggctggtcttgaattcctgggctcaaggaaccctcatgcctagctgacagtttttccttttcacttggactatttcagcccattgtcttctggcctccaaagtttctgatgagaaatctgatgatcttatagaggatcccttggatgctttaatctgatgacctgattgaggatcccttggatgctttgaagattctctttgccttaggctttcaactgtttaataatgggttttcctgtgggcctcttgacttcattctacctggagttcactgagcctctctaatgtttatatttacggttttcatccaatgtgggggttttgaggaattcttcagataccctctctgctcctctcctccctcctgggctcccacagatctgttggggtccccgaggccgctcagcactgctcccttttcttcagtctcttctgctttcttttcctcagacgatgtgattttattgtcttcaggctcaccgattatttcttctgcctgctcacatctgcctgtgagtttctgttgtgaatatttactttttagtgtctattgtgagcatgtacttattagctctggaatttctctctggtttcttgttggatcttctgtctctgttgatatttccgtcgtgttcacgcgtcattttcttgactttctccacatcttcctttcgttctctgaggaactgaaggttaagacagttccctaaagtctttgggacatctaccgtcaggtgattttcaggaaccgtgtctgttggcttctttttttcccctctgaatgggacatactgtcctatttctttgtttctcttgtgtttttcttagtcaaaaaaatggacatttgattctcatgatgtgattcttcctggtccccactcaagggtgtgcacttgttgttttggttgtgctgggctgtgtctgtggggtcggcctgttgtggaaactcagggtcttcacgggtcttttctgagcctgagccttttcctggtcacgtgcagccactttttaacgttcccgtcaatacagatgtttttaatgttcttgtcctgaagtgtctgcctcctaaagggggaatagagagaaatgaagggggcaacgggggacgtggtgctcatgccctggaagtaccttcagcttgggggtggccgtggctgctgcctcttcatgcctctggggtgggacacgcagtcatcacactgacctcgggtgtgtgtgtccgtctgcccacctgggtccggcgagctgcatgcaggctgctgcctgccagcggggagtgaggtgggagccactaatgtgcgaagcggtgacgttgattaatgaatcacagtttactctccaagattccccctgaagttgcaaaccttcagtagactccagagcacctcagtagttgcacaggcctgatcctgtgatgcaagtgttgtctcggtggggagactgattcccagtgcttcctactccatctttccagaatcttctcccgccccttcctttttgaccagtgaagatcagtctagaaggtccacctgggtcctcgggctcacggcctccaggttggagctttttctccctgggcttcctgggagacctctggcctctgaccccgatgctgtcagcaccctgtgcacgctgtgggtgtgtctgccaggtgcgggtgtgggagacgaggcagctgtgccgggtggggccttttgaggaaggcagtgctgctagtgccatctccctctctgccctgcgcgccagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagtgtgagtcttttctgggggatgtttggcataagtgtgtaggattcatttaaagcccagctaagtaaccgcttcagaagaaagtgagagatgtgctggctgaagtcctctcgtgtcgtgagagggaccgtgagtgtctgtgtgcggccaggacacaggacgtgtgtttatccgctgggacattcgccactggccccgttagagaagtggcttccagcgtctctggatgagctggtttccgaccaagcaaagttaatcgttacgtgaaaggcactagttttggggtggtggtagcttgtttgtttaaaaacatttccccaaattcacctttatggtttatctcataagtaaaagaagagaaaatggaagaaagggacctgctgtccgacttacaggacatcagcgacagcgagaggaagaccagctcggccgagtcctcgtcaggtacctggaaccgcctggccaaggccttgaccactgctgcccaggaaggcccaggttcaccctctgctctgctgtctttctacagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccggtgaggcaccgcgacgactgtgtgaggtgttgtgacttcactatagtgttagaaaccgcagagaagtagctggcgggcgggggagttgaaactcccttctatctaggactctctcgggacacctccacatcgattctttttgtttgtttttttgagatggaatcttgatctgttgcccaggctggagtgcagtggcatgatctcggctcactgcaacctctgcctcccgggttcaagtgatcctcccgcctcagcctcccaagtagctgggagtacaggtgtgcgccagcacgcccggataatttttttatttttagtcgagacggggtttcaccacgttggccaggatggtctcgaactcctgacctcaggtgatccacccgcctcggcctcccaaagcgctgggattacaggcgtgagccaccgcgcccggcctgcatatccattcttgggaacacttgttgcttagctgaagcggagcccgcatcctgcctgtggcagcactcgccccggtgctggtctgagcagacgcctcctttctcttgcagaagaagtaagtgaggaagaaatgagtgaagatgaagaacgagaaaatgaaaaccacctcttggttggtaagaacctccctggagacagagccccctccttgtctgtctccgagtgcagcagccctctcctaagacagccggtcctgcgcagcgtggggcacgccagggtctgggaggccgcctgattcgttggccgctccaggctgtgccggtggggcccgcattcctcagcgaggcacagtgctgaccaagggcgtcctgagtgcccagcagggccgaggagctgggaagcccaggaccagttccccacaggggaggcccgtcagatggtggctccgggcctgtccctgcagagcagaggcctggcccagcctccgacaggcagtgaggttatgtcctcagcctggtggacgtggatgtgggcttgtcccccacatgacacccgacgcctcctcccagctcagcatccgggctctgtctcagccgagcctgccagcactcttaggcctcggtgccctgtgtccaggggacgagagcccagcgccagcacctcccagcgggacacggggcagccctgccacgcgcttgatgcccccggggcaggaggaggttcatgatccttgcttactcctagcttcgtaattaggttcaacttttccagttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcaggtcaggccctcccctcgccccaggccactgtccgcattggcagtcggagttaccacaggggctgagcgaagcctggcccccgtgttggcgtctgtcgcctcacagggctgctgggcccactggggcagtgacgggcgggcacagccactggcccctcatgcttctaggtcccgcctctttctcatgctggacggaactgggtggacagggagctgcccgcaggactgctctgcggcttgaaaggcagcctgggcgtgcggccgcgctgctgtcactgctgcccgagttgcgtcctcctccgcactggagagcagtgccttccacttgacccctgcgtgggcgggttatgtaggcaccaaggccttgttaccggcatctgtgcagggcttggatgggggagcggctacgggagtcagtgtagatgtgtgaccagaagccttttgcttaggcagctatcaataaggcaggatattgttgggagcgatttggaagggacaagcctgagaaggtgccagtggcctctggggcctgggagaccggcagggactcggccccctccttggtgcctgtgggcggagaggttctctctggcgcatgcagcaggcctctgtcgactgccctatgccttgtgagcgcctctgccccttagtgctgctgagcgtaggcgtcgggccacaggccaccccgagtacatgacatccggcctgggcaccggccccaaggtacacggaggggtaggtgccctggcatggggcatcatgctgcgcctggcaggtagggcccgtcctcagtgtcatcctggtacaagcaggggacacatccagtttgacaaagagactcttgggatggctttttttttggagactgggtctgtctctgtcacccaggccggagtggagtggcttaatcatagctcactggagcctccacctcccaggctcaaacaatcctcccatttcagcctcctgagtagctggaactacaggcgcaagccaccatgcctggctaatttttttattttgtagaaaggagttttgaccgggcacagtggctcacacctgtaatcccagcacttttggaggccgaggcggtgggcggatcagaggtcaggagttcgagaccagcctggccaatatggtgaaatcctgtctctactaaaaatacaaaaattagcctggcgtggtggtgcgtacctatactcccagctactagggaggctgaggcaggagaatcgcctgaacccaggaggtggaggttgcagtgagccgagatctcaccattgcactccagcctgggtgacagagcgagactccgtctcaaaaaaaaaaaaaaaaaaaatagaaaacagagtgttgctatgttggccgggctggtcttgaactcctgggctcaagcagtcctcctgccttgccctcccaaagtgctggaattacaggcctgagcccttgcacctggctgggatggccttttgttcacactggttttgtttcataataaagtgtcagatggttttgcaaggaaagagactttgaaagaactgagctgctcccggctccacccccggcccagtcccaaggctctgccctgcacctgccccgtgccgggtgtgccgtgcctgtggacgcagccgccctccctccagctggcatggccactgagacctcacacaggcgcttccttcccagggctgccggagcgtcgaggagttccagtgcctgaacaggatcgaggagggcacctatggagtggtctacagagcaaaagacaagaaaacaggtgggtggggtcccctcaccccacaaaggcaggggaagtggggcaggggctggctgcccgagagctgcgactgcacctgggcccgcctcacctgagcagctactggaggttggacccctcagcacctctagaagccagaggtcagcctggccctggggctttgccactcccttgcagtagcaggcggcctgccccacagggccgaggcccagcgcgtggagtggtctgtgccggggctggtgtgcaggtttgcgttcccagcgtcccacccaagcaggtgtgtgagccgggaactctgttgggagtcggccactgggatcccaggtgaggccggctctgttggggaagtcgatgtggagtcggcgtggccgctgggatcccaggtggctgtaggtggctgtgagtgtctgtggtgtgttgagtgggaagccgtgggtgttgcccagacctcagctggggcgttctcctggtgcccacgtgcccccacctagaacgagacccccctccgtgaaatgctggcgctttgggcactgcctgcggtcctcactgaacgagtccactgttggtaccgtgactttgagaatgcctctcagtgccgtctgtattttcttcacagatgaaattgtggctctaaagcggctgaagatggagaaggagaaggagggcttcccgatcacgtcgctgagggagatcaacaccatcctcaaggcccagcatcccaacatcgtcaccgttagagtgagcatggccccaccacgcctggccccgggtggaaggcttttctgacagggccccgtgctgtcctggggccgggtgcttcctacactctcctgcacttagtggagcccttcacagaccacacagaagcaagcatttgcctcccgggtggcaccggaggtccttactgtccctcagcagctgcacccgggtgcaggggtgggtgggggcctggaggtgcccagcacccacagagccgtgccctgcaggagattgtggtgggcagcaacatggacaagatctacatcgtgatgaactatgtggagcacgacctcaagagcctgatggagaccatgaaacagcccttcctgccaggtacagccgcgccccaggggcctgtctgcgtacaagtgggggcagggtcctggtcacccccgcggtgacagtgctgcagggagggccagctgcatccacagggaaagccctgagaagcctctgttgctgccgaggcgagtgggccaccctgagtgccctgggctgggggcagccaggtccacatgggagcttccctccctcccaggggaggtgaagaccctgatgatccagctgctgcgtggggtgaaacacctgcacgacaactggatcctgcaccgtgacctcaagacgtccaacctgctgctgagccacgccggcatcctcaaggtgagcccccctccgagtggcccatcccagggagacctgccggggcccactcacagccgcccatctgtcgttgcaggtgggtgacttcgggctggcgcgggagtacggatcccctctgaaggcctacaccccggtcgtggtgaccctgtggtaccgcgccccagagctgctgcttggtgccaaggtgagtcctgggcgtctgagtgcctcccctgtcccccacgcagcctcccacagcttcgcgggcactggccctcctgaacacctctcctgacctcttaggaatactccacggccgtggacatgtggtcagtgggttgcatcttcggggagctgctgactcagaagcctctgttccccgggaagtcagaaatcgatcagatcaacaaggtgttcaaggtgggtctggccctgctgcaggtgcgctgtggggttgtggaggagttgcaggaatggggctgcggggcgcacaggtgctgggttgagatggggaccagggccactgagagccctcctggtggcttgtcttctctgacgggacacaggtgccaacactgtgggccacttggtgtggctgttgaagcacctctgtctttcaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagtgagcccagtgcagccgggtggcgggaggtcccgagccatagcggtgacttcccagtcccaggcctacctgctggctcaccacgttccagaactgctctggtgcctggcgtcccatgccctgagccccgtcccaacacagcccatctttgggggacccagtggagcacacgagcacctcctgggcctctggccctctccccccaggttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctggtgaggggcctggcgggtggggcgtgcccacaggtggggctggcttgggcagggttctcacggtagccgactcgtcccagggtgacgacgacctgaaggagacgggcttccaccttaccaccacgaaccagggggcctctgccgcgggccccggcttcagcctcaagttctgaaggtcagagtggaccccgtcatgggg

SEQ ID NO: 36918 - DNA, 13038 bp, Homo sapiens
gtacctgtctataaggagtcctgcttatcacaatggtaggtaactggttttatatataaaggctagaaaagcaaaagagaatatgtattcctattttaatatgcgtgtgcttctaccacatagcattgaatggtaaatgtgacctagttaggaaccttatgttattacctgcaattcaatgtgcagagtatgagagtctgagagcttgcgaaaattgtaatgagtttagcactagttctgttctctaagatctaagttgtttttccttccagtaattctggggttcaattagatttcataagtgtctctaattcttgggtcctatgtgagtaatttgaaattaaaaataatttcagagctacatgactgcatcgtttttgagatgagggaactgagcctggggaggggaagaagctgccactggggtctcaccgcaagcctgtgaatgagctgagataggaacccaggcattcctctctccctgccaggggctcccaaacttggctgtgcagtggaaactccgggggaattttgaagaacactgacacccatcttccaccccgacactctgatttaattgggctgcagtgagaacagagcatcaatttaaaaagctgcccaggtcattttaatactcaagtttgggaaccatttccctaggcccttttcactgtatcatgtgttaaggaaaaatcttgggtttggggctgtgtttgttggtttatttgtttgtttttgagacaggatctcactctgttgcccaggctggagtgcagtggtgcagtcatgattcactgcagcctggaccttcctgggctcaggtgatcctcccatctcagcttcccaagtagctgggaccacaggcgagtgccaccatgcccgactaatttttgtatttgttttagagataggattttgctatgctgcccaggctggtcttgaactcctgggctcatgcaatctgcccacctcagcctcccaaagtggtgggattactggtgtgaaccactgtgcctggccaagaaagaattttgcttcaaaatttataaaaacccatgcaggcttttcttgtgtcttaaacttgatctttcttaaaacattctttactaacgctggggactgaactgggctgctctgggggctgcaagggagatgaggcaagaaacagccagccaagtgggaggagccaagggaggtgggagagggtcctcaggaggggaccccgggcctcctctgggccactcggcaagacaaacttgctctcagaaactgtccggaggcagaactggggatggtaaaacaacagtggggtgggaggtcctccccatctccactagacaggctcctccagcctatactctatgcagcctcacagtgaacttagcaagctgcagagctggcaatacctctgcctgcctaagatcctgaggacccccaactctttatttatttatttatttattttattattgttatttgtagtagagatgagtttttactatgttgcccaggctggtctctaactcttgggcccaagtgatcctcccaccttggcttcccaaagtgctgggattacaggtgtgagaaattatgcctggccagacccccaactcttgatcatgggataacccttccaggagcagtaatttacctaaagagatacaacttttttttttttttttttttttttttttctgagacggagtctctctgtcgcccaggctggagtgcagtggcgcaatctcggctcactgcaagctccacctcccgggttcacgccattctcctgcctcagcctcctgagtagctgggactacaggcgcccgccaccacgcccagctaattttttgtatttttagtagagacggggtttcaccatgttagccaggatggtctcgatctcctgacctcatgatccacccgcctcggcctcccaaagtgctgggattacaggcgtgagccaccgcgcccagccaagagacacaacttctaaggatactgccagcctgcttcacctcaaggctcgctgtaccatctagaaaatcctagcccattctggcgtcgtggtgtaatctcctgcacacatcaggagctcagggttactaaatgcaggaaaggaagacacaaagggaaggaaggctggtggcagaatagaagacaggaatgaaaaaagctttagagcctctctactcaggggtggacctcagaccagcagcgtgggcatcacctgggagcttccgtgtaagtctaaagacctactgaagcagaatctgcaggttaattaacaggctgtctggttgggcgcggtggctcacgcccataatcccagcactttgggaggccgaggcgggcggatcatttgaggtcaggtatttgagaccagcctggccaacatgatgaaactacgtctctactacaaatacaaaaattagccaggtgtggtggtgcactcctgtaatcccagctactcaggaggctgaggcaggagaatcacttgaacccgggaggcggaggttgcagtgagccaagattgcatcactgaactctactctaggcgatagaacgagattccgtcccaaaaagaaacaaacaaacagacaaacaaaacaaaacaaaaaaaactcccaggaatttatatgcacattaaagcagcactgggttggtcattgttcctgggttctcacctgggagactaggtaaagacactgaggcactggctcctagattgtgtttcctatgagctccctggataactctaatggtcacccaaatgggagaacccctctttttacagggaaggaaaactgagtttcagagagagagagagagagagacagaaagggagggagggagggagggagagagagagagagacagcattaggctatttctgagatactgtcaagtggataatctcaaaattaaataatttgctctctgctgtcaccatgtttgggctctcccccagtggttcaatctcctgcctctgctctagagctgcaggagacttggggattttgcacatgtcacttgtcctgggatgcagccctgcttgtccctgttgactctcctgctttgtgactcagtgaaaccagatccccaagattccagtgatccccagtaccccaggagccctctttctgcatgaagggagtaaaaatgctgtcaacaaggctggctttttggggggaaaagtttaggtttccacaatgatttcgagctgaaggctactcagaagaatgaaacagaacaagtgccactccaagtcctggcttgagctgaatgtatcaaggcgttgtgtcatttttaaagaatctttctttctttgtggctataaaactcatatattttattgtagaaaatttagaaaataagaggaaaagtccaaagaagaaaattgtcataatctccccatccaaagatgacttgttatttggtacaaaaccctcagtgtgttctgagcatctctctccgcatcatgtatttcatagcctgcttcatttcatgtcgtgacatgtggtgatcaattgctcatgtgacttcaccttctaccttgctggctcaccaggtgtttttctgagtcactgttctccactggctctgttcttgggcattttgtttctttccatttttccactgcagtgagcatcgttgtggaggagtctgtctctgtctctgtctctgtgccatttttaggatcacatcttggagatgaaaaggtgaaatcaaatgttgtaaacggttttaagaatgtggatatatagtagcaaattgttctccttaacgattgttcaaagtaagtcattcttgtgcatatcacctcccatagatacctctatttccctctgggtattataaattaaatgattattctcaccatcccattatgcttctatttcatgctacatatttacatttcttttgttatcagtaagttgaactttttcatgtgtttattcatcatttctgtgtgtgtgtgtctgtgtgtgaaatgccactttatttctcttgccctttttctgtttaagatgtttttcttctcccattggtatgtaatgatattgttctgaaaatttgatatctttctaatttcagttatgttcttatgacgtttatattctcaaatctatttttcttttatgcttagaataagtatttatgtatatatgctgtgattattttatgatcttattgtaaaaacttaaaccttgaatccttttagaatttatttcactaatggggactcaaataggaaattaactttttttcttccccaaatagttcaccacttgttctaatagcatttattgaataatcgctctccacagatctcaaagaacatgtttattttataataaacttctacatatatttatactttctgggttttgtttttttcttttttaccctatccaactacctttggaattttctgggttttctattttgatctctgtgtttgcctttttttttttaaagacagggtttcactctgttgcccaggctggagtgcagtggtgctatcatggctcactgcagcctcaaccttcctgggctcaagtgattctccacctcagcctcccaagtagcagagactacagggacacaccaccatacccacctaacttttgtactttttgtagagatgggttttcaccatgttgcctaggctggtcttgaactcctgagctcaagcgatgtgcctgcctcagcttcccaaattgctgagattacagaattgagacactgtgccctccctatctttctattcatatatgagtaacatactacttcaagtagcgtcacttcataattaattttagcaatcttacagaataaatgccttcattcccattgtcaaaagacaaaattacaacaaatttagtttaaagatcttaattgattttttttttttttttttttttgagacggagtctcactctcttgcccaggctagagtgcggtggcacaatcttggctcactgcaacctccgcctcccaggctcaagtgattctcccacctcagcctcccgagtacctgggattactggcgtgtgccgccacgcccagctaattttttggtattttagtagagaatgggtttcatcatgttgcccagggtggtttcaattgcctgagttcaggcaatccacccacctccgcctcccaaagtgctaggattacaggcatgagccaccacgcctggccctcaattaacttttacttgtgagtctataatcagggaacacttcattccataaaatagatcgagtgttctgcagagctgaccagagaagtttggctttttttttttttgagacggagtctcgctctgtcacccaggctggagtgcagtggccagatctcggctcactgcaaggtccgcctcctgggttcgtgccattctcctgcctcagactcccgagtagctgggactacaggcacccaccaccacacccggctaattttttgtatttttagtagagacggggtttcaccgtgttagccaggatggtctcgatctcctgacctcatgatccacccgccttggcctcccagagtgctgggatcacaggcgtgagccaccgtgcctggcagagaagtttggctttatagacagaaaagagccagaaaaagcagaaacagagaacaaaaagcaaattggtcttttcgaagtgactttgcttataagttaaagcagaggggactttctcatcatgtcagctaaaactggcctgttgggcatttggctattacctctcactctcttctaatttcttagaaggttggttaagcaacttagttttggcttagtggcagagaacttcagcatgggcgactgcattttggtttggtctgttgggcccagtgcagctcagtccaaacaaatggcctcctcaacattttttttaacaccatcttccctttcaaaagttcccagaaattaccatgttaaggtttgtttgtttatttagctcatctcaaaaagatgacaaagtcaactagatacttttccttgttctacaatttcagcctagattaactggtttgttcagttatgagctccacatcataacctctcagcagagcccagccgagatcctggtacacagcactcagtcaaggattatcctttgaattaattcattctccaccctgacctttcttcacattacagaatgttctcctgggcagcgttgtgatctttgccaccttcgtgactttatgcaatgcatcatgctatttcatacctaatgagggagttccaggagattcaaccaggagtaagtcttggcttttcaatgtttattatgttattgcagcctggtagatggacctgtctgcagatgaaagcctttgtgtttctgtttgtttgtttctttgttttttgagatagtcatgctctgtctcccaggctggagtgcagtggcaccatttcagctcactgcaaactcctcctcccgggttccagtgattctacctcctcagcctcccaagtagctgggactacaggtgtgtgccatcatgcctggctaatttttgtatttttggtaaagatggggctttgccacgttggccaggctggtctcgaactcctgacctcaggtcatctgcccgccacagcctcccaaagtgttgggattacaggtgtgagccactgtgcctggcctcacttgggcagccttctaagaacacagtagcctgggccctgtacccagagatactgatttcattgttctagggtaaggctgagacatgggtggctttcaagtacccaagatgtttcacatgtgcacccagggttgaaaaccaccgatgcaaagcaaagggaagtgtagaagtgagattctcatccagagataatccagtaggaaaaaatgtggtcccaagtacccacaggctcacatggctatctaattcaataaaagggccttattttttcttgaaatatctgttctgaaataaaacttagaaggatataagctttctgtaagaaaacattatcagtagcatgaactgaacagtactggaattagccgtgggtgaatacaggagcaccattcttagatacctttaaaataattgagctcctctctctctgggaggggtgtagatagtaggggcaggactcaatgtcctgataggccttgttctcattgcatgacttgcactgatgatgttgtgtgtattattttagaatgcatggatctcaaaggaaacaaacacccaataaactcggagtggcagactgacaactgtgagacatgcacttgctacgaaacagaaatttcatgttgcaccctgtaagtctcaagccagtgctggccaagagggggacatagctgttctctgaggaacagctactccgtcttgcaaaattccaatcttcaggggtttagtttttgttttagttttttatagactttatatagagtagttttagattcacagcaaaactgagcagaggtacagaaatttcccatgtgcctcctgccctcacacatgcacgacctccccgttatcaacatcgtccaccacagtggtgtatttgttatgactgatgaacctaccttgcacatcattatcacctgagtccatagtttatgttagggcttcctcttggtgttgtggtattggggggttagttttcagtcctatttctttctttttaaaaaattgtgggccagtcacaatggctcacgcctgtaatcccagcattttggggggccgaagcgggcggatcacgaggtcaggagatcgagaccctcctagctaacacgtgaaaccccgtctctactaaaaataccaaaaaaattagccgggcttggtggcgggtgcctgtagtcccagctacttgggaggctgaggcaggagaatggcgtgaacccgggaggcagagcttgcagtgagccgagatcgcaccactgcactccagcctgggcgacagagcgagactgtgtctaaaaaaaaaaaaaattgcggtaaaatatacgtaacgtaaaatgtaccatgttaacaattttaaatgtatactttagtggcattaggtccattcacattgttgtggcatcactaccatccacctccagaacttgttcatcctgcaaaactgaagctctatacccattaagcagtcactctccatccccttctccccagcccctggcaaccaccatttcacttctgtctctatgattttgactactctaggtccctcatataagtggaatcatacagtaattgcttttttgagactggctcatttcacttagcataatatcctcatggttcatctgtgttgacgcttgcatcaacattgccttcttgttcgaggctgaatcatgttctgtaatatggagagaccacattttgcatctccattcatctgttgatgaacacttgggttgttttccacctcaatctcatttcttttctgttgtttttgaaacttgataagtagctttattccagatgggctcctgaagacaggaaagagtatctaattgtctgacactattccagagattggcccggtcatcacctcagtctgggccttgtagatttgtagaaatagcagtggctctgagcataggcagagggatcagatgtgaggggtaagggaggatctgtagtgtgccttgcaccataaaacttatgctgcttcactgctcaagtttaactcacgtcagcccaaaggctatgcagatgttttctgctgggttgctatggacaccagaagtctagaacttgagcaggcggaacacagagtacccgcagtgccgtcctaatttacctgtttcctcagcagctatgtccataacagctacctaactcccaaccccccaaatccatctaacctcttcatgtagccttggcttgtagtgttctgcaggaacaggaatggatctgatggcagagcattggtgtcaaggggcatttcgcaaacttgtctgatcacagactcacctgggaagcttgatgaaatacagattcctgggctccatcccagaactgattgatcagaatctgtaggggaggggccaaggaatctgaattttaacaggtgcctcgagagtcttatgaggacactgcgagtaaagaagcaagcacttgacttagagcagaacacctgagtcctactgaacttgaagtgcctggagagttccagccacatttatcgagcaggcctcatgctaggtgcctaatggaacagaggaatattggactgggagatggctggctgctcagagcaggctcctgggcatcgcattggccagatcactgggtattacagctgaaccttgattttgtggctccagaaatttgacattgtctttatatcaagtgttgatgtcactctggtggagtgtgattgtatcccagccaggtgaaggactggtgactggtccctccctcacataggagcgtggctccctggtggctaaaatgtccatgtcacccagatttggcatccctgccctcttctaagattctccactgtaggctgggattctcgtggtcctggtgtggaaacgagccaggctgctccttgcagtgaagagggaagaacctcactgttggagtcagagtaacttgagtctgaatctccattcccttgtatactagctgtgtgaccctgagtcagtttctgaatgtctctgagcctctgtttcctcacattataattatgtggctatgataattaaatgagattctgtgtatatattctttaacccaacaaacacttaatgccttctctgtgccaattctgtgtcctgtgatcctgggacagtaactgacacctggtcaggtttcaaggtttcaaggtttctactgccatgttgcctgttccatttggcacactgctccatgcaggggaaatgaatcaacaccttcttccctggaattgcctcacctcctttgtttttctcatgaacttttttctcctccatggaaaaatacagactttgattaagctttttctggaagaagtttttggacccactgcaccctctatgggacgctgcccagatctcaaggtgctcggtggcagtggagcctgaggctgggggcccaggcagaggctcccaggtagggcatgggagatgtcctgggctccacgctgcccgggcccagggctggctccctgacttgggtgaggaaaagggagtgggagacaaaaggccaaggtcatccagccactgactctggttagctgaatacccgatgttgacagtttctccctccctctctctctctgctgtttcctctatagagctaagtctggtttgcattgaaataagcatgcagtaatatgccttttgccttaccaacttgtatttgcacacaggcagcacagattcaccatttcacttcctaccatgaactaaaagaattgtatctcttcaacaaacaccactttatttttaaccttttttttttattgtggtaaaatgtatactacataaaatgtgccagtgtaaccattttaaaacatacaattcagcggcattaagtacattcacagtactatgcaaccataaacactatttccaaatctttttaatgactccaatctgaaactctatatccattaaacaataactcagattccctgtcccccaaacctgtggtaatctcaagtctactttctgtctctatgaatttgcctactctagatatttcacataaatacaatcacactgtgtttgtcttttcgtgtctggcttatttcactcagcatgttgtcaaggttcattcatgttgtagcatgtatcagtacttcattcttgtttctgccagaataatattccatggcatggtcataccacattttgcttatccatttatttgttgaacacttgagttgcttctgcctgttggataaagtaagtaatgttgttctgaacattggcatacagtgtttgtcaatatacaaacattggcatataatgtttgagtccctgctttcaattcttttgggatatatacccaggagtagctttctgggtcatatggtaattttttgtttaacttattgaggagctgccaagctgttttccacagcagctgcaccattttacattcctaccagccagcaatcacctttaaacatgaaaaacatgaaaggttttaaatgatatttcccaattttctaagtaaacatatgaattatagaatcattgggaagcataagagaaaaaagaagaaatacctactcataatcccaactgtgtaaaggtaataactattaacattctatttttatttatttatttatttgtattaaaaaaattaagacagggtctcactatgttgcccaagctggtctcaaactcctgggatcaagctgttgtctcacctcagccccaagtagctgggattacaggcatgtgccaccatgcctgggcttctatcatcatttattttcttttttttttttttgagatggaatcttgctctgtcgcccaggatggagtgcagtggtgtgatctctgctcactgcaagctccgcctcctgggttcacgccattctcctgtctcagcctcctgagtagctgggactacaggcgcctgcaaccacgcccggctaattttttgtatttttagtggagacggggtttcaccggtttagccaggatggtctcgatctcctgacctcgtgatccgcccgcctcggcctcccaaggtgctgggattacaggcgtgagacacagcgcccggccctatcatcatttctttatgtctcttttctatatgttttttcttttacatagtggatatcaaattttatatcacagttttgtgggctgatttttccacttaatattctagcactgggctgggcatggtgtctcacgcctgtaatcccagcactttgggaggacaaggtgggtggatcatttgaggtcaggagttcgagacctgcctggccaacatggtgagacctcccccgcgccgacccgccatctctactaaaaatataaaaattagctgggtgtagtggtgtgctcctgtaatcccagctactcaagaggctgaggcaggagaatcgcttaaacctgggagacggaggctgaagtgagctgagatcgtgccactgcactccatcctgggtgacagagtgaaattcatctcaaaaaattaaagtaataatagtaataatacataaatattctagcattagtatcatctcatctcatcagaactcttcaaaatatttgtatgtactgcagctcaattagaggtggtctctgactttcatcagcttctccctgggctccatgacactggcctggagtgactcattgctctggttggttgagagagctcctttgccaacaggcctccaagtcagggctgggatttgtttcctttccacattctagcaacaatatgctggccacttcctgaacagggagggtgggaggagccagcatggaacaagctgccactttctagagtagccagacttgcccctgggcctgtcagcacctactgatgaccttctgtgcctgcaggatggaatgtaggggtgagctgtgtgactctatggtacagactggtccaggttcctggaggtcacactctggggctgccagccaaagggtgcccttaagttggagtgtgggtgacttcctgaacagagctggcactggggagggggtgctcggggtcctttctcttctaacaggccccagttttgtctcaatgacagtgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcaaacacttgaatatgtgtgtccttttaatttataatttatgtatgcattgatttaatacacattataaagaatacaaaacattt

SEQ ID NO: 36919 - DNA, 10213 bp, Homo sapiens
cacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctgggtgagggccagcgggcgccccgttatgtgcgtgcgtggcctcccggcgccggggcgcgctctcccctcgcgggccctgcgcggtcgtgggcgccggaggcccgttagcagcctgctccccgtcgcgtcccgtcgccgctcgggccgccagcccgcgggtcagcgcgggagaggctgggcgaggagcggggggagggacgggtcctcggagccgcgcagctccgacccttccgcgaagaggcgcaggcgcgtccccgagcgcgggagtccccgccaggcccacgccggccggttggggcgaagggtgtccccggctgtgccagccttgagtagatcttttcgctagaagattcctgtgccctcaggtgggcgccctttcctctcaccactccctctcctccggagcgggccgaggtgagcgggtgccggccttggggctgcctgagtgctaggcagggtgtggtcctgggcatccttgggcctaccagcgagccctgctcagggtgtcgggcgccggcgggcagtactggcgggggcggccgcagtcccggccttgggcccgttaagggggccggcgtccctccatatgccccccggggcttctcggacttgatgggccctggtcggttcacgccgcttgtcccattgatcctcacgacaagcctgggacgtaagaacggcggattcgtaggcatttttcatccatctcggttttgtggatgaaaagactgaaaatggaagacttgccaaataaggaaaatatgtggcgtggcctgctggtcccctgacagctaattgagaggccttaactctccagaggattcgggccttctgtgttacatagagaatgctcatctctcccaggctactcctaatatgctagggattgtgtggaatgctttacaaacattacccaatttcatcctcttggtaattctacttggttggtattatcgctgttttaaaaaatgaaataagaacgcgtgactaaatgctagggggattctaatgcgcattcggttgcctcttccagagcacgtgtttgttttttgtttgtttgttttttgagactgcacgtgtttgttttttgtttgtttgtttgtttgttttttgagactgagtctcactctgttgctcatgctggagtgcagtggcgcgatctccactcgctgcaacctctgcctcctgggttcaagcgattcttctgtctcagcctcccgagtagctgggattacaggttcccaccactacgcctggctaatgtttgtatcttttttagttagagacggggtttcaccatgttggccaggcttatctcgaactcctgacctcaggtgatccgcccgccttggcctcccgaagttttgggattacaggcgtgaaccaccgtgcccggccagagcacgagctttttaacctctgttgaggaaacggggaccggtcacggtagctcaggcctgtaatcctagcacttcgggaggctgaggcgggaggatcgcttcagcccagaagtttgagaccatcctgagtaacatagtgagagccccccgtttacacacacacacacacacacacacacacacacacactttttttaaattgaggaaacggtgagttgaacatgagcaattattccttatatatagtatttccttagtttttcttctcaacattcatttgcccagtgaaaagaaaaagcaagtagctgggaccacaagcgcacaccaccatgcctggttgatttttctattttttgtagagatgggtttctccgtgttgcccaggctggtcttgaactcctgggctcaagcaatctgtccgctttggcctcccaaagtgctgggattttaaaggcgtaagccactgcacccggtaactttgggttcttgaattcccttcctcctcttcttcctcctcccctacactccattagagaaagggtcttgctttgttgcccaagctggagtgcggtggttgttcacaggcatgatgatcactgcagcctgggctccagtggtccgcatacctcagcctgccagtagcaatttgtttggcacatcacttacacatacttgatatgagatagcatgatacttttttgagacggagccgcactctgtcacccaggctggagtgcagtggcccagtctcggctcactgcaacctctccctcctgggttcaagcagttctgcctgccccagtctcccgagtacctgggattacagacgcccgccaccatacctggctaagtttttctatttttatttttagtagagacagggttttgccacattggccaggctggtctcagatgatgcgcctgccatggcctcccaaagtcctgggattacaggcgtgagccaccctgccaggccacatatgatatattttatcaatgccttatctacatgttacataggaataatctagcgtcctacctgtgtaaaaaccaactctggaatactgaaactgagctacttaatattctgaaaatcaggacgggtgtggtggcttttttttgcctgtaatccgagcactttgagaagctgaggcaagaagatcgcttgaggccagttcagaacagccccatctgcacgagaaattaaaaaattagctaggcgtgcatgcctgtcccgctactcagaaggctgaggcgagaggaacacttgaactcaggagttcgaggccaacctgggcaacatggcaaaaccccatctctaccaaaaaaaaaaaaatttaattagcgggacatggtggcatgtgcctgtggtcccagctacacagaaggctgaggtgggaggattgcttgagctggggaggtagaggctgcagtgagccgtgattgccccaccgcgttccagcctgggcaacagagtgagactgtctcaagaaaaagagatgaaggaagtgagaaggtgctgattgatacttacctcacactgagccttttttccccccacagacttatcactgaaccatttcactgggaaagtaaaaggaccacatatttcttggccgggcatggtggctcacgcctgtaatcccagcactttaggaggctaaggtgggcggatcatgaggtcaggagatcgagaccatcctggctaacacggtgaaaccccatctctactaaaaatacaaaaaattagccgggcgtggcggcagccacctgtagtcccaactactcaggaggccgaggcaggagaatggcgtgaacccgggaggcagagcttgcagtgagctgagatggtgccactgcactccagcctgggcgacagagtgagcctccgtctcaaaaaaaaaaaaaaaaaaaaaagaaggactacatatttctcaatgaaaatacagtgtacaatgttttccatgcaggtgtaaatactaactcatgttctgtttcagggtgggagatggaataacctgtagaaagaatctttagatttgtttaaattatacacaaatgataagagatctttctgaaagtattgactttttggcgggggagggaaggggcctgatagaacaaccaacaattgtacactttaagtttacatttagagttcacattaaaagttcatttacaaggcatctgtttgaaattcgtgaggatgagctgggctgggtggctcatggctgtaatcccagcccttgggtggctgaggtggacaggtcacctgaggtcaggagttcaagaccagtctggccaacatggtgaaaccccgtctctactaaaaatacaaaaattagctgggtgtggtggtgggcgcctgtaatcccagctactgggaaggctgaggcaggagaattgcttgaacccaggaggcagagggtgcagtgagctgagatctcaccattgcactccagcctgggcaacagagcgagactccgtctcaaaaaaaaaaaagaataaatcacaagaaatggttccttcactgttatactttaacatgatacagctttttaatgttttattttttgagagagagtctcactgtgttgcccaggctggagtgcagtggtgtgatcataaattcttgggctcaagtgatgctcccgcttcagcatcctaagtagctgggactacaggcttgtgccacctcacctggctaattttttttatttttggtagaaatagaatctgtttgcccaggctggtcttgaacactgggcctcaggcagtctttgtgcctcagcctcccaaagtgctggattaatggtgtgagccacagcacctggccaatagctttattgagattataattcaactatcatgatttattcatttaaagtgtacagttcagtattttttagtatattcacagagttgtgcagctgtcaccaccatataaccttagaacatttcatcatcaccaaaagaaaccctatactcattagcagtccctcatatcccctgcttctacctaggtaaccactaatctactttgtggcctatagatttgcttattctggacatttcatatacatgaaatcataaaatacctgatcttttatgattggcttttacttagcataatataaatttttttttttttttaatttgtagagacagggtcctgttatgttgcccaggctgatcttgaattcctgggctcaagtgatcctcctgccttggcctctcagagtgctggcattataggtgtgagccactgcacccagccattagcataatattttagctgggcacagtggcatgctcctgtagtcccagctactagggtgactgaggcaggaggatcacttgagtccaggagtttgaggctgtagtgagctatgatggcatcactgtacttcagcctgagtgacagaggtagaccctgtctctaaatattttaaggttcattaaaataatatattttcaataaaataatatttcaataaaataatattttaaggttcattcatgttatagcatatgtcagtgtatgattcctttttctggctgaataatattcctttgtatggatataccaggtgtttaacattttgaggaactgctgtacagttttccaaagcagctgcaccattttatattcccactagcaaagtatgagggttctaatttctccacatccttgtttttacctacctttttttattatagtcatcctagtgagtgtgaggtggtatctatggtttcagtttgcactttcctaatgactaacggtgttgagcctctttcatgtgtttcttgactgtttccgtatcttttggagaaaagtgggttcagatcctttgcccattttttaattggattattagttgtaagagttcttcatatattctggatataggtcccttatgagatacatgatttgcaaacataaccccgcttctgtggattgtctttttactttcttgacagtatcatgtgcaacagaaagtttttgatgctgtccgatttctctgttttcttttgtcacttgtacttgttatagtatctaagaaaccacaaaggccatgaagatttatttctatgttttcttatcagagttttataattttcttataaatttgggtctgtgatctgttttgagttcatttttgtgtatggtgtaaggtaggggtctgaatccattcttttgcctgttgataacaagtcggtctagcaccatttgttgaaaggactgttctttccctgattatattggtagcctgtagtattggtttttatatactattacaattttgggaaaattcagtacagaattacttggagcatgttgatttgtctgagaaaactgtgaataccagtttcatgattttagggtaactacaaaatgtatattatattctatcctttgtcagatgtgttaatttaatcgttttatataaggtaagaatgctgtacctctgtctaaacacagaaataacatgtattttaatataaagaatgtggaacttctaaactttgaggctaatttttcctgcataaattctcaaattattgtgacatgatatttcataactttactagtagaatccttccctgtgttattaaatatccactaaagtctctagtaaagggaatatgatttacagaacaaatttaatgtgttagtttaattggtgttaatttaattataattggtgaactattacatacttttcttagttcctgtttttttgttttttctttacagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaaacgattctcatgcctcagtctcccaagtagttgggattacaggcgcatgctaccacgcccagctaatttttgtatttttagtagagatggggttttgccatgttggccaggctagtattttgtcagtccaagcagttcattaaaaaaaaaaaaaacaaaaagagcaagaatataaatactgcatcttccagcctacttttacaaagggttcactcttgggtccttaagcttagtggttacacttaggatttatttttaattttattttttaactttatgtttttttagagacagggtcttgccctgtcacctagtctagagtgcagtggtacgatagctcactgcagcctcaactcctgggtcaagcgatcctcccacctcagcctcctgagtaggcaggattataggcacgtgccaccatgcctggctaattttttattttttgtagaggcagggtcttgctgtgttgctcaggctggtctcaaactcctggattcaagtgatcctcctgcctcagcctcccaagtagctaggactacagccacatgctatgacaggctgattttttaaataatttcttttaatcctccaaatggtttgttaaaatttttaacatttttaacatttttatagagctggagtttcctggatgggtgcagtggctcacacctgtaatcccagcactttgggaggcctaggtgagtggatcatctgaggtcaggagttcgagaccagcctggccaacatagtgaaagcctgtctctactaaaaatacaaaaaacttagctgggcatggtggcgggtacctatagtcccagctactcgggaggctgaggcgggagaatcgtttgaactcgggcagtggaggttgcagtgagccgagattgtgccactgcactccagcctgggtgacagagcgaaactccgtctcaaaaaaaaaaaaagagagagatgggtttccctgtgttgcccaggctggtctcaaattcctgggctcaagtgattctcttgccttccagaatgatgctgggattatacatacgaaccactgtgcccatccagatagttttttaacttgagatgaaaagacatttttaacttgagatggcagaattgcacatttgataagtgcttttttttttttttttttttttttgagatggagtctctctctcacccaggctggagtgcagtggcacaatctcggctcactgcaacctccgcctcccgagttcaagcaattctcctatctcagcctcctgagttgctgggactacaggcgcacgccaccatgtctggctaatttttttgtatttttagtagagatggggtttcaccatattggttaggctggtctcgaactcctgacctcaggtgatccacccgcctcggcttcccaaagtcctgggattacaggtatgagccaccgcacccagccaagtgcttaatttctatctaattagcatgccacaatttattagtatttgtaagttcctggatggcagggatcagatgttgcctttatattctatggcgtcatccatgcagtacattctttaataatatcaagttaatctaattgtatgtatttgttgttaattttacaaataagccagatatttagtcccttggaatgtgatgggagagagacctagagggtcgagtgtattcaactgctgctgaaatgtagactgctttttgtttagaattcccacagctgctgctgctgctgcttttttttttttttaagagagaggagggaggcaggtctcatggtttcccttctcagtgtttgtgtcaaccattcatcagtcatctttgaaagaacctagtaacactcatttttcatcttgctgtattttttcccttctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttccaccattc

SEQ ID NO: 36920 - DNA, 8459 bp, Homo sapiens
caacatggcagcggttggggctggtggttccaccgcggcgcccgggccaggggcggtttccgcgggtgcattggagccggggaccgccagtgcgggtgagacagtctgcccgagcagtcgcatgggaggcggaggtcgggatcgctgggagtcgggaatgttcctcactaaagtgagagggagcatcccgtgtggaccgacgtgtgtgtgtgtgtgtgtgtgcacattgtcagtgtgttgggggcggggaagagaacattctgagagtgattgtgggatccttccgcatatggagagtagagaccattgtgagtgtggtgggtaattctttttgggaaggctaaggccaccgaaaccattctgaatatgtggagtccttccgtgtggaagagaccattctgcgggtgtgggagttcctcactgaagaagggggagactattctgagggtggtggttccttccttataaagggacagagactattgtgagttagggtggggcgagtccttctttatgtgactagagagggtccattttgaggatgggggtgtctttcattatgtgcggaggagaccgttctgggggctccctcctaatggaggtagagttcattgtacattcgggtgggagggctcatcgttatatggtggagaaagaacgttctgagagtgccgggtccttccttatagcagagagagctcattgtgagtgtgggtagagcaaggaaaaattcattagctagagggtccgtgtgcggtggtgggagggcagaccatgtggagtgcagggaagtatttcctcatctggttgagggagccagacctttcttggtgggataaccattcctgatacaggattcagtccctgggagcatgtgggaatcatttcttgtatttagtagactattctggttcgagaggaaccagttgtcacaggagtgaggggttggagagaccattctgggtatgaggaggatcattccatatgggatgtaggccattctcagtgtgagggaatcgaatcatttcttagataggagaaagaccgttcttagggggtgaacatacctcatacagtggcctcattccctgcattgatgtgttattctttacatgagacagtccctcattaaacaggagcatcatttcatataaattctcagtttgctaatccataaatgggaatcctcgcagttcttttggagatgacagtgatatgagtctattgaggtaatccatagaaatcccttaacccagtgataggcatacagtaaacactcaataaacgtggagaatgtagttgtcggtattctttctggggaagagttgcttctcacttgggaggaagccgaggcgcgtggccagggtttgcctcagccattacctgacacctcagtaaggattccaggtatggactgggacagggtggggcccatttctcccttctggctcttcctgctcatggctgaggcagtaagccggtaggagtcagacccttattgggtgagggcaggcaggctgagggagcaagtagccatggctaggagggtcctgggtgagaaagaaagggggtgggtggtggtgtggctatgccccagcggcttctgaccccgtccttcccccttgccccttccgttccccacagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtacgaaccagggatggggctgcactggggtcggtgggtgagactccacatgtatgtgtgtgtgttcacacagatggtttgcttcaggagtgtctccaaatctcaacctgcctggagcgccactccagctatgcgtagcggcatcttacacttttctagccctaacagccgggtagccggcctgtgtgggctgtaggagtgagattgccaatgcttataaagtagcagggatctctcacatgtgatttagcttcatattatggagaattccgaatacatgcaaaatcagagagaataatcaaatagtaaaatatccatgtacccatcccccagagtcagcaattagcaactcatggccgctttaaacaacatcagtgattgttcactcactgccaatctatatgtctacctacgtccttatcctcttattatttttaagtaaatcccacacgaagtaatattgtatggaagtaaattcccctgaattatcttgaataaatgtagctgggattacaggcacgtgccaccacgcccagctaatttttttgtatttttagtagagaaggggtttcaccatgttagccaggatggtctcgaactcctgacctcgtgatccgcccacctcagcctcccaaagtgctgggattacaggcgtgagccaccaggctggccttgtttggtatcttctaaatctgttaatctctaggggttttttggtctttgcaattaatttgttggagaaaacaggtcatttgttttgtagactttgggtagtctggattttgctgactgcctccctaaggcaaatattctcaaaaatttaacaagtattctgtcttctacatctcttgtaaattggaagttgggtttatctgctaatttcaacatctccctgaaggccttctactttgaagtgttgcccaattgtttctctaaaaaggtcttgcataagtaaagggatggagatgaattatgcacctttgccctttgtttacattgaagagaatattctcacccacctgttaactccaggttaacaagagacctgctcttacctttgttaactctgtgaacagtgtaggtgtgaacactgcctcaggccgtgggggtagatgggttagcaatgcagaggagcagcttgtcctcattgctgatggaagatggaaataacagatagccacagacttaatcacaggccttcatctcttagccacaatttcagcacccctctctcccctgcccggaatttttttcccctgaattcgagtttggagaccaggagtgcacagggtttggtgaatgaacatcagtaggagttcctgggacaaccttgttcagtgtttgaagaagttttgcctgtggagtgacacccagctgtgacttaaaagatgaactgctggctgggcgtggttgctcacgtctgtaatcccagcactttgggaggccgagaggcaggtggatcacaaggtcaggagttagagaccagcctggccaagatggtgaaaccccgtctctactaaaaatacaaaaattatccaggcgcggtggcaggtgcctgtaatcccagctactagggaggctgaggcaggagaattgcttgaacccgggaggcagaggttgcagtgagccaagatcacaccactgcactccagcctgggcgacagagcaagactcctcacccacccaccccgccccgccaaaaaaaaagatgaactgccaaaaagtggggcgagctttgcaaaggccttgttacataggaaatgattctcatgttttttgtttgtttgttttgaaatggagttttgcccttgttgtctgagctggagtgcaatggcacgatcttggctcactgcaacctccgcctcccgggttcaaaagattctcctgcctcagcctcctgagtagctgggattataggcgcctgccaccacacccggctaatttttgtatttttagtagagacggggtttcaccacgttggccagcctggtctcgaactcctgacctcaggtgatccacccaccttaacctcccaaagtgttgggattacaggcgtgagccactgcgcccagcccgattatcatgttttcactggagcaggtcccaagcggacttctgcttaatggtcaagcctgcattcatccatgtggcagaggcaactctgtgtctagggctgacagaaagatgcaacaagggggagatggcccctgccctcagacggcacatgggtcagtgaggagctaggataagtctaaaagtctagactatgcctggtgtggtggcttacacctgtaatcccagaactttgggaggccgaggtaggcggatcacgaggtcaggagatcaagaccatcgtggctaacacggtgaagccccatctctactaaagatacaaaaaattagctgggagtggtggcacgcgcctgtagtccaagctacttgggaggctgaggcaggagaatggcttgaacctgggaggtggagcttgcagtgagccgagatcgcgccactgtgccaaaaaaaaaaaaagtctagactaaactcttctgtgtgggagacagccctccaccccagctcctagggcttctatttcataagctccaagttaatgatggttatttctttctttctttttttttttttttgagatggagtctcactctgttgcccaggctggagtgcaatggcatggtctcagctcactgcaacctccacctcccaggttcaagcaattctcctgcctcagcctcccaagtagctgggattacagtcgcttgccaccacacctggctaatttttgtatttttagtagagatagggtttcagtgttgttggcccagctggtcttgaactcctaacctcatgagccacctgccttggcctcccaaagtgctgggattacaggcgtgagccacggcacctggcctaatgctggttatttcattgtacacaaatatattgagtattgagtgctttccctgaatggggctctctgccagggaggtaggctctaacatgagtgacatgctctgtgattagcagacacggatggctgattcttttgctgccattaaactgagtctcagaaaagcttgctggaaacatggttgtactctagggaaaaccaagatcacatacttcattccagcctccagggattggacagcagggtggatgggggagtcacaggagcaaggcctgttcccagccttcaggggttccccatgtatggctgtcagtgctaagaagggctctcctcctcccacctaggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgagccccaagcccagcatggccccagaggaactaactgggttggggactggagtatgggaatagcgtggtgggggggtgttgcagaggacaggggctatgtcaccttcagaatgtccttggaactccttcaacctcccttttctcgtctgtgaaaattgggggtggaaatagtaatgcctgttcattgagatgctaggatacttaaaagaaataatacctgtgaagagcccttgattggtgacagataagctttaggctatttgtgggcagctttgtgaaatggttaaagagcctggattctggggccaggctgtctgggttcaaatctcagctctgctaccttccagctgtgtgattttggggcacgtcacctaacctctctgtgccttagttttctcacctttaaattggggcttacagtggtgctcacttcagaatggtgttgtgagaattaaatgaatgaattcacgtgcagtgcctagaaccacactgatatattgtaagcactatgtaagtatttgctgacattgttgtggctattgattcatttgtatcaagtccctcatcacaaagatacttccatacctcagccatcttttatagatgatgatgccagggctcagacagggcaagtgctttgtccccagtcacacagccaggaaatgggattgggatgtggacttcttggcacagccatccttttgtgcacttgctgggagagacttcagaactgttttgctgcagctcagccaatggccagtggctggctccttttgctgtttttgctgtcataccccccaccctgtccctccattgtgcctgggggcccacagtgggtgctgccccccatgtgcacctgttgggggccagggtcagccctcagtgccttccacgtgccactcgcaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacaggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgcc

SEQ ID NO: 36921 - DNA, 8687 bp, Homo sapiens
gtcccgggtggaggcggcggagccggagccgggggagggggcagcggctgtctcacggaccacggcggcgcccgcagctcctcaccggtgagggcgccaagccaggactcgggggtcccgggagcggggcgtcgtgaagccagggctcctggtgttggggggttgggacactgagggcccgtaggctctgctgccttggggatgcggggccccggggtctgcagggtgctcggagtcctagaccagggcttggctgtcacagggggcagccagcgtctgagtcggggaggggaggggaggggagggtcgagtcggaccggaccagattgggttctgtggggcggaggcatctgtgagcagaccagccagccagcgcgggtgacatcaccgaccaccctcccccgcccgagccccctcccctcctctcctcgccgcgccttttgtcccggccgagctccgctctgccccgcccatctgcgagggaggagactcccgtcagtgacttcattgagtaggttcttggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggcatgtttaagcgcacagtgctctcctgcccacccccagcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcggtaagtccctccggagaagggcactcacacccatacccagtcaaaccctccacgcggccatcccctccattgccttcctgcttcctccaactcatcctcatcccctctgtgacatacaggaacccccctccggcctcacccacatatttgaatgaattgcaccccttatcattccttttctcaaacccttcaggtatccattttccacagacatttcctccattatttcaactctccacattcctccctttcaacccatcattaacccattttccacctcagccatttccatctgtcactcatccccctccatcagtacctcattttctgtatcagccatctcccctccctgtacctcaacagtccccctcgccattttctccccatttttccttcctgcctctaccttaacatcctcctcattcttctccatcaaaggcagtgccatgccatggggctcctttgtcattccaacacgtggcctgtgggtaggggggaagggaaggagggaggaaagcagaaagagaaaaaggaggcagatcctgaaagagcttgccctgtgtctgcggaggcaagagatgtatgggcctagagcagctagcaggtgggtaccagggaggaagctggccgggtgtggaggtaatgcagggacaccaaaaggaggtgggtggttggtgagccgttccactggccctctgcctggaagctgctctcgttctctaggggcaccctcttggtgtgctagggttctttcccagtcccaggggaaagaaggtgtgggttgaggcagaaatggcagaccacccccccccgctccctctcagacggcttttgctgccatttccgaaaacggttgcccccccccccaacgaggtgctctttcttctctgcctctcccaaccccaccccccaccccatctcccccacagacgtgacatgctggtggggggcaatgggggagtacccgcctttgtggagccttttcttcgtcagagaaaggtgactcccagaaccatgagtcaacccagccacctgcagcagggcctgtgggggcagcagtgagggccattgtccctgcccacctagggccttgggcgcctcccccttacccggttacaggcctcactcctggaaggacaccctgtacacctccctgctgtgaagcagtcagaggcagaaaggcaggtctcagctgtggctgccagcctaggacattgctagaaagactctggttctcctggctttggcaggggttggccaagtctcagaagggctgagaatggcttctggccatcccccagagagctctagctacaggaaagtcccccttcccctgatatccaccacagacacaccgatagagggagactggaatggaagaattcgggttgtacgtttctcttataacaaatgctcctgcacccaccttaaaagggactcagaggaatatgggtctgatgatgggccggatcctaaaccacagggtggactgggggcgtagggtgaggctaggagaggtattaaggaaatggtggttggttagtgcccaattgtctcctaacagctggggttgaaaaagtcctgtccccaggatgcttttgttcactcacactggtgcttaggcggcacagccctcacagttttgtgtgtagacgctggcaaatgagtaaagggaactgttgccctggttgggggaaggatagtgtcgccccccctgctaatgagggagttggaaacagcagtttccaaaggctgtgagtcaccctgtgatctgagtcacacgtgaggcttagcatcgtcagaggggtgggggcggggaggcctggggtctccgatggcagacaggactccagacacccattccctgactcagtctggctggccaggacagctggcggaagacccaggcctgttcccggtcctgggccactgccccagctgccctcagcctgggcaccatgcctgaggcgtggcgtaggagaccacgatgctcaggtgacctcacccgttacactgaccttcgccagctcctgtgtgtgggtcgctcagtccatggtgccacctcgctcagcagggcctctcaggggtcctcagtctggcccaaggaccagggcctcagcctagccccaagagtgggccacaaccttcagcttcctgctgggaaaacccaggaggtgaggacggaatcacagaattctagaatgtcagagccagaagagatcatctagtccaaacctttcattttacagatggggggacgcaggcccacagaacaggcatgacctgctgaaggttacccagggagtcatttagggattgcaagatcatcaggaacagggctggggcagaagagaaggcatcaagtcttggccctgggtttctttcagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggtaagagggcagcactccagcccaatcccggacccctccgcttggtaggggtcccaggtgcaccagtttgtgtagcggggaactggaggctgtggagggggtgagggcagcaagggtttccagcactgtcacccagagaagagagaagcccacccactacccagctcagctcaccctagttctccccgcctctctctgccccctccctcctcgggttcaggccttagagaggtctgaagcaagagccagaggccttccccgcccttctttccttcccagccttattagtcctgcctgaagtctccgctgcttcattggctgatgaggaaggttggggagagggagtgtgtggctctctgaggacagagcatttacattcatcagcataaaagtctggcccttaagcagcctgggaattaactaccagagctctgagcagaaatggttttccccttctctcccccggccctgcctgcttctggccagcagaacagaggtggagctttgcctcccagaggaagtggcagggatccaagggtggacggggaactgctgctggcatcttcccccttccctggggtagctggtggccatggggtgggaggcaggaaaggcccaaataaagcctctgagagggaggcccctcccagcacatcccacggccatgatgtagctgctaattctgggcctgcccctcagggctgcctgccacccgccagccacaggcacctgtcaggctatattaagagacattgtcacgctgaggactctccttcctgggaagaactgtccttcctccccaacagaatccacctttctttcacattctcctcctcttcaccctcccctttctatcctcaaaactaaatgggctaatcatatgtagataagaaggttattttcttcccctcctcctggccttgtgttccatgcccctctgtgaaccctcatcctcccaactcccttttcctattctccatgctgccggttccttccattcttcctgcctacctcctagacgtgccaactcccagattcaccagataccggctggaacccccagtattctttcagctaagacatttttctctctggcatggagggatgggagggataggagtggaaaagagggaagcagtgcagacaccatgccaccatgtgacctgtcttggaattgcacccattcctccattcagcctcacctttgtttagaaagaaggcaggagctgggagagctcccttgagatacttcaccccttctgcctaagtgaaggggtccagacaccaggttctgatgcagaaccccatcccaggaaggcccctgaggatgcggcatggccttaaggggacctccatggcctggggagggagaagcagcttagaaatgttggttatatttctgtccaccctgcccaatccccagcagccatttattatagagcagttatacacacagactctgtgtgcagctccagctagggacaagttgctcccagcttgaaaagggggtggtagtggaagaatagaaatccctatagagagaattaccccttcccatcatcatcagtccagcctccctccctctctcactgagctctgccaggctgcttgaactcgcttgataatcagcccctcgatagaaggaaaggagagatcctaggtcttgggggaggggtgaagaggcagctgccacaagtccctgaaccgtctgccacttggcctctctagtgaaactcaaatctgcccttgtggtcccaggaaataagaggctaatttaggctcagatctccatgatcagttgaaattctagataaatggcctcaaagagaagggtctctttcctagcctggaccccacccatagtctctgtattccggagcagttctcagtgtgaaccgtctccccacatcccccactactgccagcaccccctcctgtgcatgaaggctgcctccaggaatctgagccccttagacaggacctgacagagagagcagctaaggtcaccactgccatgtgccagcccattcatgcattttggttgctcaacattaggtgtggggtatggcgtttgctgttgtataactccagggagctccattcccattgtagtctatgtctgtacaatgtgtgaatgacactccctaaagttgtgtaacaccgagcagagtgtgggaacaaagcatttaaaaactttttctagaaaaatagctcttcatctccaagctaatgagctttcccactttttaaggcttcctgatttcccgtttgagcaggggccagggaaagaggaaacactgctagaagcagagtgaaagtggtcttcctcccgggttggatccctagcctatttgcgactgttcacttaccagccccctctgtggtcacatcctgtctgatggccccttgtcctatatgtctttggagataagcaaagatttgggaaccaagtatcacttgtaatgtgacaccaggctagtcattcaaggctttttgagacatctttggaccatgagtatgtggaaaagattacaggactggaagtcacatcctctaagtcctctagtcctggcttttccacctattgggtaagcaagcctctttgaatctcaagttgtgcatcgttattaaatatataattaggaatggaagataatcttgccagaagcctttcttactctattagcctggccctctctgtgggatttaaaggttgcttctttctttaagcctgtgaactgggagctagagggcagggggaagacactgggattggggccagaataagccacactgcccctaacttctcctcccctctaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggtggggcctagtcaggctgtgtgtgtgtgctggggagatggtggggacattccctctcttcccgccagctggcacattctttccccacctcagtctatttccttccttcccactcaccttaccccaccttttcctcactttctgcttcgtctttcccaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatgg

SEQ ID NO: 36922 - DNA, 210272 bp, Homo sapiens
gcctttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaagtaagtttttttttttttttaaatgaaaagatctgaggcggtaccgtactttccctgtggttttctgcagttttcctctctgcgctctccctgtcctcttctctctccccctctccctctctccctgttcgcgcgcgcgcgcgcgcaacacacacgcgcgcacgcacacacatacacacacactcacacacacagacacactctccttttcctcccccccgccgtcccccatccccgtggaggagcaggcttgctgatttgctcgggtccgcccggctcgagcctcccctccccctcccgcccccccgcctcccccacccccccagccggggctgtccgatcgcactcgttgcatatcagaggctcggcgcggcgcgctcctcctcgctcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaagggtaggtttaaatctccaacacttacctagatataaatcctctcctaagaggggcctgtcccgatgcctcctctcccttcaacgcttctgctgctgctcgctgcttgatgatggcggccagtattttaaaaaatagcaaaattattcatcggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctggtaactttcacgttattcgcccccccaccctccgctccctgcccccggggaggcactggccctagtctttcctagtcctcggcgttctcgtgctgattattagcgtttttcttctctttattttgtttcatttcgccttttgatttattggatcctcagaggaggcgaaggggggttaggggtgggatccggggcttcctcctcacactaactccacttctccctccgttggctcgctacggttctgttgcctccggcgggagcggggcctcccggcgccccctcaaatccccggcctcgccgcctcctcttccttctctaaacgttgctcttggttcatgctttttcatttttaaatttaataacattttttcctcacaacttttaactccgttgttttggctggtttggtttctgtgtgctcaacttgtgctcggtacttttctcctttctgactttgtttttatttttattttctctctctctctctctctctctctctctctctctctctctctctccccctctcctccttttcctcctcctcctctcttctctcttacctccctccctctctctcatctttatcccttcctctcttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggtaaactgaccccccggacccagcttactgtgtgtgagtgtgagagtgtgtgtttgtctctgtgggggtgggaaggtggacgactaagtggggagttacttctgtatggtggggggcgggcgccgcttgccttaggaagggaccgtggagggggcctgctcttctgcccctggagtcaaagccccgaagaactagcctctttcgctctcacagcccgaccactccagaccccacagcctggagtgactgagtccccagaatcttgccggggccttctccccgaggacaggattcctggccaaaggacgcaggactgctcgtttcaggctccctaacagaggccttgacgaaggagaaagtttcctgccgatgagaagcaactttgggtttttttattttttacttttttttcttctgtttcctactgagggtctgggagtcactaacagcagcttgagctgggatcagggctgcttctgtcggccaggaagtcctaatcacccacttcttaattctctgtaaataaagggggcagacctcgaagtgcagcgaggtggaagggactcttgcttgcttggagccgctcttagggggagtaaggaagatggctggaaattattttatattctgagagcacttggcgaggggtgagatgcacgatcctaacgtgtaccacacgagctcttccggctgagggtaggtgggcaaagcgacgggatgccgaggggaggggacagtgggtaaacagcaactgagccccaagccagaggccgcaagcatcccgaagtgtggctaagccgcccggaggaacacaaagggcatacgcgcacgcacacttaaagttttaaaacacgatttatttatttttgtctgctgcaacgctgggagaaatgtggtctttggaaggaagctctccagtgtgtaaccttcctattattttggcccccacactgtggctttagtagaacaggagcaaacaagtttataaggcaaggaggtggagagattaaaagagcattctcttgcatttatgaagtgtcactccggtgtgtatgtaggtgaagcctttggcctcgtctgaaatgcccattaaaatgcagagttaaaactatttttttttcaatttcacacagtgttcccttcttgggaggtcagggctgggtctcaggggttggttccgcggcctccgtagtgtggggagtggatcagaatcgactcgggctccagactgcctgagcgtctcggatgtttcattacgttccaactgaggctgtttttatttgtcgggctgcagtggccggggtcttctctggccagatctgagggacctctgagctgcgggagagggccaggcccttttccctttctgtttctggcttaggctcgcctgatggaggaagggttgtaaagtgtggtgcgtgcctgttgtattaaagaaggactccacaccctccaaacttgttgattacagttcttgctccttcccctctgcaccccgtctctgtgtgtgtgtctctgcgtggcgctgcccgttaggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggtccagccttcttgatccactcaacttcgggcagtccctcactacccctcccctttcctcggagctttacttgaaaggaggaaaggccagggacaccctatctgttcctctggcccagtccgctctctacgcctcctccccatccctgagcctgggggcgaattggaagtggagataaatatgggtgtttgttttcccccccagcaggaatacaggggtcgaccctcgaattaaagttgacctgctcctaatctggggcttggcctttttcccccgcctccagctacttgaacaagaattggggagaggggctgtgagggacccgggagtgcccgggaggcaaggaagctgggcgcctctccgagcggtcccaggcagcagtggagagccacagcctcttggactgctggatatggaactcgaggccctgagaacgaccctgagttcctggctacagcttagtcgtaccaggtcccccttaatggggccaggaccagaatgccctgattcttcttcagggactccactaatttaaggcaccagtttctttcttgtattttgccaaagcccctttcctcttctccgccattgccctccaccgtacccattctcacatttcagctttcttattttaaatggggtgatcgttcaagttgactctctgtttcttacaggttcgcgccgaaaagccacttttttcctcaaatccagagctggacaatttggtaaggctctctgttccttgtttttccccagcctttgccctctcccatgcccagaagcacccactttctgctggagctctggggagttagaacagaaccctcttttggagctctagggagagagggaggaagggagcagcttagagcccccgcacgggagctggcgagcgaggagcaggatgaacgcggtggggagcgaagcccagggaggccgaaacgggagaccgagcgccgagagcgcgagcaggggatgtttcccaggtctcggccccaggagtaaactgcgagaagtgagttatttcctctgtttgccggggcaggcggccgagccccgggcggctaacccgaaggatgtaaccactggcacggctgagggcgggctgggggtgggggctggggggcggtgaggggcaggccagcgcaggccacttttaggtgcgattcttttgctaatttgcacgatttcaatattaaaagtacttaaatccgctttcaaaggccctgcctcagcattcatcttgagtatttccttctttagtgaggaaggatttcgctgggtatgctgttctaaaaagctttttctatcctgagaagggaccttttttttttttttttttttttaaggaaaaaaaaaaaagttgtcctgaggtcgagggaggggatgtttaaagaggactaagaggagaaaaaaggcctggcccgaggaaagcagtcttacaaatagcacagtgaacatcagggggaaagatattaatgcttatgctcaggttgagtcagattcctaccccgtggccaatgaggcagagatgatcagtaatcacttgatttttctgactatttcttgatgtttaagtttttcctggccacctgcccgtttcttctccccagcccaactttctcaccaccatcctcaccccactcccaaccccaagacaggacctcagagtcacagagctctaactccattccctgaacttttctttcagatgatacaagcaatacaagtactaaggtttcatcttttggagttagaaaaggtaagcaggaaataacgctccccgtgttgattaaaccatttccctctcctagttgagttgggatgtttttaacaaacctctagtgtgagggattgagcacctggagattttgagcatgtaaccatgtccatccttcaactcgcttctcaacacaggggctcagagggtgggtgaatcaggacagccttgcctttaaagtagcctcctcctccccaatattcccctcaggcattcaggattattttgaaatgcagcaaaccatttatgttactggacactcagcctgcttgcatctttattagctcagctcaccctcggccctgggtttgcattaggtgcaggcagagtgaatcatccttgctgggtgtctttacattgctctgcagctcaattactttcccctggaaacatacgaaacccctagcttataaaatcacaaacgttaatgctctccccagctccaatgttgtaatgttttgatgttattatcaaatcagatttaattccctggactcccactctgaacccagttatttccagtcctgtttctttctctctctattgtaacttgttgctcagagaagtctctggagaataatatctgctgcaacaattactctattgtttccttgccttcaactattacaccctttaattagagttagtttggaagacatcacactgttgctctttgcaaatgtaaccttgcaacctggtatttttcctttctaaaaatgaaacaaaacaacaacaacaacaacatgagctaaaccctccaccatgaccttcgttctaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccatgtaagtctgctagcctttagcaatcttttaaggccactgggcaaagcattattttaaccttgttttaacatctagctccactgatttagttttctttttaaatgactccgtctcttttggggtcttttcttctctttcttgctttctctgccatacccttcattttcatttctcctttcttggaccccctcctatttatgttgagagccaaaaaaccagagttgatagagtgatttgtgctcttaatgtgtaaagttttctggatttggtgacttgggtgttcgcaaattctgtttgatatagtcaccactgtgttttctgctttcttaattttgtgtaatcagtgcagcagggatagaaagaagcaagacagttagctggactggtctggagagagaggactgaatgaaagagaattgagtgagtgctgatttcctagtatgtcacagagatgacaattctgagaattattggcaatcttgcactgcattcgaaataaaaggggtgaacaaacacattacaattctcagggcttttgctatagaaacttattgtcagaatagggacttattgccaaatgcctgaagcatcttcataataaaagacagtaaccttgatgaaccaattattaacaatgtattacagaaagctgaagggaattatgattgagtaaccataggttagtggttgaattttaacactttaacagttggtgaatgaggatggagagtatagtaagaaatgactgtgtatgtcaggccaggaaaggagatttctttctattctctctgtttctaatcctattttggaaccaatctagtgagtctgatgctaaaaaaaaaaaaaaaaaaaaaaaaaaaaaaaaaaaaaaaaaaaaaaaaaaagcatatgtagtgagactgaaaatttgaaaaagaagcaaagagaagaaagattgcagctggtaggaaaggcaagagtggcgaggttaaagagtgggtgtgaacagcagttttatttataggaactcaagcctggaaatgggggacagggtgtctatagattacattcagttgaactcacagcctaaataatataagctgtagtttaataactttgtggccgaaatattaatttgacactccgtgtgagttaaacaggcattaaggcttgaaggcagtttgtccctacctcccatcccaattcctgactggtatgagaaatgaattgggatgccttagtataaaccttctatgaggttcttctctcccctgctccagacaaaagttttgaaaatatgcagtcatagattttcataattaacctttgcacttgtatgggaagccagcctaagaacaaaagttagaaaaagtctagaaaagaaaaccgcagtctgggatatccagttctgtgacagaataaatactgcggtgttgaaggctcctattcttatctctttacccttacctttttccatcatggtgagggaatctttggtgatctcctttgtatattgagtgaatgtaatgaaatcaaaaggatgcagcagtggttatggaaagtttatttgctgatctgtggctccacagtgtgttgtggtccatgaggcatgacactacctaagaaatatttacatttgttgttttttgtgtgtttattttcattgttttctgtttctatatttatatttattcacattattgggagactggggagggatctatttacatggtttgtaaaatgagaggttcacagttctcggagccaaaagcttttctcatgatatttctaggagtacctactacttagttttctaaaacagtttcttggcaactctttttccagtggatgtatacagctagaccatgttgatgtttacatagaaaagataagataaaataggctgtttaaagtattggctgatagacaatatcaatttatgagactattgtaatatttaaatatccactcaagaaggaagttgtacctaagaggatagtgctttaataatttatcaatcatcatctttggataaaagagtcaactgtaacatttgttgctctcctttcaggcccccagtcaagtaaatatgacaactgatttattttgaacccatgagggcttgccacttcattgggtgtcataatttaaagccttttatttcctagagatctgaactataacatttttactttagccccctgctatttgttttgaaaggaagcaataatttgttccaccagcacaccaagtagaaaacggagagatttgccacagacttgtattttatgcagggacatgagagaaaaccttggagagttttcaccatttttgagacttttgtaccataggtgtattgattgtattcatgtccaggcttcccccttcaaagcaaatcctcttatgcttttcagcctcttctacaaagttgccttccttcaaccccctagccaaacacaaagtaaaaataacaaagaaccactacctgaaaagtggtgtgagtgggacattttcagcatgtaaatgtgcccaatttgaatcttcaggtttatttttcatttgctttgatatgcatatttaatacattgccccaggctggatctcatttggtgaacactggtgcaggggtgatgatgagccacttcagaaaggcccagacagcgcgttgttttcttgttttatctgttggcccactattctgatctgagcttcctcttggttttatttgcacatgaaatgctgagagcatttcaacttattggctatgaataatgacagctaaaaaagaagtgtagtttaatttgttgtatgccaaggtttctcttgtggaggtgacagtttgtgacagctgtttgacacccccaaaacacatacacctctactcttattaagtggtatccagcttcattgtgtgtgtgtgtgcatactcgtgtgtgtgcatgtttaaggaaggaacatgcaaggagagagagaaaagcagagagaaatgcatcagaagcaaaatattaggtaccaatatagtttcagtattctttaaaagaatttgaaaatgtaaataaataaaagtaataaatataaatatcttcaaagcaagtatattggcagacttaagaataagttttatatattattagtaaatcctgttcacatttcataaagttatataaataatttgatataacagatgcattagaagaagacaaccataatattcttgctttccattccttacattcagtgaggttactgagtttattcatttattattaacacttacatatgatgggtgtaatggaaagaggaagtttggaattaaatagaaaataaaataagcaatattgattacaatttcgttgtatttagtaaatttataatgcatgcttatgtttttaatattataatgtattttgtcttttactataacataataataatatttataggtaggaaagagctattacaatatttttggaatattggggagaaaaaaatatataatagtcgaaggaaatagaactctgttttccagctgcagttcatgttagtttcctagacattcaaatttatcatgtttaaaataaatatgtctaaaaaacaatttttaaagaagtttcaacttgaaaactgctgtgaaatgaccagctttttctagcatgtggagttcctgaataacaggtgatactcacattatctattttacacaattttagatcagatatttagacctagtacagacaaagaaaatacatcctcacatttacatgtaaagatattacatgtaaagatattacatgtaaagttcagacaaatgaaatctacttgcttgaagtatattctctgagctaagctctattttcttgaagcaaatacagttatacaattatattgttattcctagttagtggtcataaagagctacatttttattttatttgaaagaattcagtagaggaaagaaaatacaattatgtctgttaacagttaatagcagataccttaaaattgcctggatctactaacaccactaagaaaagaaaacttattgtatatttatatgttgaaagctgtaatttaaatgaagatattctggtgttttcttttgcatctctgaatatatcaagtttatgttgacacagtttgtttgtttgtttgttttttcaaatgggttaggtcagagaggagactctccagaatcttatttctgatagaatatgggcaagtgactctagataaattcaattactacctgaaaaattagagggaagtgacagtgaggggtgggataggttcaagtggttgttctatagaatatcaagggggaaataatgaaattggataataatatgaatgctttattttatttgctagtttcttatgttttagtgtaaggtgagaccttatggtatgctattcaaagcctctggggcctattccgataaagttctacttctgagctctgtccaccaactcaaggaagcatggctgggtgcgtggattttctgttgtgttgctgctgcgtggtttctggtggttgttagctttcttaattccccattaagaataattatactatttaaatcatttagactgtgcagttggagtatgttttcagtgtaactgtgatgagatgaaattaaacaaaggttgtaattgacaaccacatagacattccctatcagattttttgaaaattggcattctttaattcattttctttttttaatactaaatgttctatggaatatcccaacacaattcaaagttttaagaggcattttataatatggcattacaccaacaatacaagacatttctgtcttctctaaaagttgctcgactaaatggagaaatcatttgcaaagggtgcttgccacttctgtgagagttgcttacatattaatcccaaagcttaatagagaggtagaagtggggaggtgagggaaggaccccagctttatttacatttttaaagagtgagtccaggttctgaaagcacacataggtctcctgacttcttatgtcaactttacaacaccggagttgaaattccaacatttgttcaaaccacacaattaacatttttaacttttgtagacttcagtaccccaagataggagtccttgttttatttttaaaaatattttttgcataatgttaattaggagttaaaacattataaagttatgggaaataagtaatttaattatgtatgttgatacaagtatatcttccctttgttgtttaaatatattgagtcaaattagttgtacatgcttcatttactgattaaaatatctttatgtatgtttactattactctctacctatgagcacataccctgagttactttattctattttccaagtttacatgtaatttttctcttgatgttatatagttgtgtaggttctagaagttatctggtctaacttcttaattttaaagagataaaggaaatgagccccatagaaatgaggtacatcacttgcttaagttcacctgactggtgagaggtggcatgccagcatcttaattccaatctaatgttttctttcctataccatgtccactgcattgccttttcatttgggatctaaaatgagtttcagattattttagatagaacttgtatgtggcatggcctttgcttttctccttgaagcctcatacattttacttctccattcagttttgtatttatttacaaacactttatacatttcaccccactggccccatggaagaaccatgtgccatgtggaatcatttaaatagggaaataacaccaattcaccgagacttattaagtattctcttataggtaggtccctcatggaaatgccataatggtttaaaatgttacaattccagtgtatctgcaacttcaacaagagaggcacacatatgatttgcttcctatgcccagagactcctgtcctctctatgctcttttctagatttagcaaaattcaatgatagtgctaaatcaatttttttttttaactttcaagggagaaaacactggcacaattgtgttttctagggaaagctgtgtgtaaatgagaaacagagtagagcagcagagcgctctcctgtggccccactactacaagctctgcccatattgtctcctgcttttatattaattacaacttgcattatcagctgtgagtctgtagcccagcaaatagaaaatactgcccctagagacctagcttcttgtatctattttccatctccttctattgtgctccactcagtattcactgcttttctcctggtaacactgctctgtaacacaattacgtaagagcaagaagagtaccatatttgactcccaattaccaaagccactgggaatagaaacatgttcactccttgccctcgggtgtcttcatgatttttttggctggagaacaggacatatattgtggcatgcatatacctgaatgctcagtcatacacgggcacccggcgagcgtttctctttatttttctacttgcatcatgtgtttttacatgcttttgtatgtcactttggtttcaggattcactaaacttctgcatataatttggcagaaagccatgccatttttcttgaaggatggaaacttgtaaactctaaggggaagaatagaagaaaggagttgtgatataaacaaatattttaatctcagggaaaacaaattgttaaaagtaataggttttgtccatccatgtcagtgacagttttttatgaccaaggaggaacaattttttgttgaccagattatcaacatttgtatttgtatatgatcacatcaccaccttgtgtagctcaatacaaacaacttgtggtaactcctcagccttgaaaccccagagggatttatctgttcttccttctttcaaatcagatgactatcgtgtgatagtccttagttggtgttcagtctctcaaacaagaccataatacttgagacactctatgggaaataaacatgacactttttcaggagagcatttttaaagagtgagaaagaaaagagggaagagataagggaatggtaggttaaagagtgaacttaagcatattttgggaatgggcagaaaaccaaagacccaatttatttggaagaaccagctgctcttaaaagtaatatttgcttctgtggcttatttttcacccctttactttagaaaacatctccttcagataccattgaaagaaatacactgaattataaacgaatgaggcctaacttgaaaactcagcaccagtttagctgatagggacaaaccagtgttttcagttacaggaagtccttctgagtgatcccttcaaatcaatgcagcacctaaacagaaagacttgctccggcttcatataaacgattatataatagctattggatgacatttgccttaaaacatagttgaggtgttagtggttaattattataattttcatgaggggtaaggagcttttatagcagccagcttaataaaaagcctgcagtgcataaaattaacatcattgctgtgtacaatgaaaagtttagcttaggtgaatatgttgcagctattgcattttctaaaagaagcctctagcctgtgttgtcgcaggactaaactcacaccatgctattgcttctttttcttttctttctttttttttccatgtaattcttctagctctttatctcattaccgcccggcaaacagctgacacgaagaggcttcaaagcttgaggagcccctgtattctgtttgccttttgcttgaaactattggagtggtttctaacttagattaaaaagagagctcacaggcatgactttgtctttctacaggcagcagaaaaccttgacttttattttattctactcaatttcattccctaatctactttctcaaacatatccttattttagagatctatacctgtgccatatttgtagtcacaaaatttctgctcagggttttcactttgaatcaattgcttgcctgatagcagtgccagtatcattattttatatagatgttattaatccatagagctctggattattatttcataatctatcaaaaatgccaaatattaattcacagtcagtttgctgcagatctgtagggggaaaaataagttttgtagttccaaataagaacatttccctatttttttctcaccttggtttcttgttttattttggtaacatcatccatgctatatgtacactgtagagttgatgctgagaaaaatgacagactgacttcttttcttgatgaactatacataatggcaacatggcaagattactttcccttggtcaagaggtttatttgttgcctatacccacgtggctctgtctgaattcttatttaccaattctagtaagaaacagtgtatactttgattggtttttttagtgatatactttgtatattttgattggtttttttagtgatatactttgtatactttgattggtgtataatttgtatacttcgattggtgtatactttgtaaaatttgtatactttgattggtgtataccttgtatacttcagtatatacttagattggtatatactttgtatactttgattggttttgaggaactattttgccccttcctctggcccccaaatcattcacttgccagtaggtctgtgggcttaattgaagtcgtcatatgcaggtgacaagtgtacagctctggctttaaggctggactgtttcgtatgctgttcctcctctccgtttctgccagaggaaattccatctcttgcctgccttcatgtggtgctgataaagtccttcctgtacattagaattcctgttttcctttaagcaacagcagggcattgggaatgatcaggaaaagggaggaggaacagaagaagaatatactcagccaagtagcatgagctataactcttggtttgccttgcatgtcctttgaaacaagtagttcttctaggaaaaagcactgctcagtgaatttcaagcttccatgaagctcaagtgaaactcctctctagcttactagatggacagtagttcacacatgtttcctttttttaaattatttctacaaattaaagcaaaaatcaataatttattaggtattgatacagtgattaatatcattacctttgttggttatatagtcaatcagttgataattttgagagtttgtataggttgttttagggcaatgcatttgaaagatgtcaagggctgtcccatacattgtggagcctgtaatttttttaatggagtcattgaattttgcagatgtgaatgttctgaagtattgagtgtccaagagcatcgggacctatttcttagtagaatgtaccctaattaagatagcgagagtaaaaatgacttttacatttttcataatttttttttactttagaaattaactttgtttaggtttaaatttgtatataataaaatttacccatttaaagtatacacttaaattagttttaaccaacatatacactggtgtaaccatcaccacatcaagttctagaacatcttttcttttatatacctattactaaaaagacagcacaccataacatggcatgcgtatatgcctactgccacaaatactaatatgtatacatttttttgtctctttctgtgccgttccttttggttcttcattgatggctgaaatggtaactgtggaaaaattccttggtatcctgacatcagaacccttcttcttggcgagaccacgatgatgcaacctcaacccactcagcaggcaccccagggccctccagtgggggccatgcttcccagagcggagacaacagcagtgagcaaggtaaaaggtcaaacattttcctcgtgcaaagtaggcatgactaaaataacttcagtattttatgatatcagtacatctgccgccatgtaaacaggagagtggcaggttagggagtagaatcagctgctatttaaagagacagtatttcctcttcttaacttactttccttaaaaaaagaaatcaaagtgagctgtctaatctttaagtaggcattacaataacaattgattagttctgccaattcttttacaaatttggttatctacactttatttctgtgtgtataagtggaatcacaggcctgctttactgctgtgatgcagtagcttgaattgtgctataaatagcatattttgcctgtaatatcaactataagcattctctataatcaagcaattatgcctctaaagcacataaaatttaaaaatctgttcttattagctctggaaatattgtggaattttacatggaatcttatcttgggaaggtagattttgaaattcttagaggattatttgtccccatttccattcagctgacatggtgacttttgtcacaagtcctaaaaattagaataatcagagggcaagggggacatcaactgcagatgttgaggaagcctagtgcaatttagaataaattttactatttaaaactcacctattgcacagagagcaattatatattggtaggaatgactcatctatggctaaaatgataatttaaaggaagatgcattattgaatgtgggccagggaagtgtatagattttactttttaatattttacattagatggtgtctgatctcctaggtctatttcatctctattatgactgtgtttatggccacgatatttaagtcttagacaggcttccaagtagaggacagtttaacagctcgagctgtagttatatatgccatttaaaagagggtgttgatgtaagtagggtgccttttgtcctccaagcttctgactaggaattttggatttctgaggttctagaagagtctagaaaaatgtcctttctaggatgccattcatttgtgaatgggtccaaattagaatctaggtttaagcaaattgaaactaacacagcgatgaatcatatcagacggcaaattatggaagaacttgcaacttgcacctatataatatatactgttttatatactgttttattttaccagttagtttctatataaaagataagtaaattataaggcattttcaaggtaactggtacatagggtcaatggatctgcaagcaatgacttaactgtggttccatgtcacagtgatggacttctcagcatggttaaatctggaaagctttctatgactccatccttcccaccaccccaaattgcggcgacacaaagggtgaaatgtatctattaataaaaacaaaatactctaaacattgtataaaagaggggaaaaggagaagccgacttaatggtctaatgaggctatcttccagagacttcttgtgtgtgaggctcactttgacctttcgctttgctcaggagcccagcgcctcatttttcacattcttgcaattacgttaacgcttcaagcatttctgactccaagtcagctagcaacaccaggcataactcaacactgtgagtttttctcctctctgtagattcattaacaggtcaccaaggtcccaactgaaatttaaaactgactggttctgttgggttagttgagttatggcaagggagatagcaagaaagggccagagagaagaggaggtgggagaaagaagaacccaggttttggagtggggattacttgtaataacgagcaaagcataaagttttagcgtttcggttagttagttttgttttttaggaaagagaagaattctgagactgatatataggtaaaaacaatcacacaaacttctgtgctgtgggtagatgcacccacttatccaatgctgaaggatttgatccctgtaggattctgttcctttaatcatgtctctgcgggattaaagaatggacatggtagcttatgtgtatgagtactaggaagtcagtcattttactgtatcgaagtttgaaagaaaaaaaaggtatgatttctataaaatggggactattttggcatagaaaatttcctacctggcttaccacatcagtgattaaaacacatatataagagcattctggctttttacagcagactttaaaatttgaaggccagacttgagtgtatgttgtcatactcatgcctatattagtcttttaaacagggtttcaaggtattttgatattttgtcccaccgaattgtccagagtagtttcagtgggaaagattaattatctgcttcagggcaaagtcaacagagatattgactgaaatcgcatatgcttatcctaggttaaatcttagggttgatgtataatggaaaacgtgggagagaaatttatgtccttagtattaaatatattataatgtttcattggaaatcaagtttgtagtttcgcaaagagttttcgcattcagaatttattagcaaaacaggcatatggaaaactgtaaaatgattcagtttcaaaacaaattatgataaacacaaaaaatagggatgaattgtactaaatacaatgttttcatacacattttaaattaaactttaatagccacatgctataaaacaatacatgtatttatgttgctttataatttttgtgattatgtttactataatgattcatagaaactttactttggaacctaaaaataccttgttttatgacctgatagtgaaacagctacagttacacaggtgaaagttcatcttttcctccatagtgtttcagcaatgaaccaaaaggaggagaaaaaatgtatatcacatttttaaaatatcttaagaaataaacttggtaaaatgtgaaacctgactttactatctttcaaagagcacatgtctaacagtaagctatataaatatgaaccagacttttcattcactgatttctcttgctaaaagcagccaaaggaagggagtttgtcttgttagtcacattagacggaggaagaaaatctggtttttcaaggatggaattagggtgcagacttggggctctggggaagtaactggccctctttgtgtctggcttcccatcagtaaaatggggtttgataataagtctagagatccctaattctgtacctgctgagtcaaaagctgctttgtatttcactgtgtattttgccagagtaacgactaggaagcagccccttgttcctagagcactttgagagccttagatgaaagacacaatatatgtacaaagtattattattattgatgggtttgtgtagctcccattaacgctgatgggagttacgcatgtgaattggcaagagaatagacccctcagtgtttagagcacatgaaatttacattttttccagtgctgtaattgagatgttgacaaattggagaatattgatgagcctttgttttaagtatttcgtgccaagtttgttttatttttcctggtttgaacaatggtatgggttcagccgcaatgaataaaaagggtagagtaaagataactttgtatttcaatattttgatgtgccaatatgaaataaattgtcttaggcaaatggaatatgctgttttaatcattagctatgcatgaaagaaaaattgatgttgacatctttgctgtaaaatcgttgtaatggggccttccttacaattcatttttgtaaaattcattttgtacattttgcagcaattgaacaatccctgcactgtgaataggcaggattcccagaaataccgagacagttggcccagtaactgctgagctcacactgcacaccacacgcacgttaaccatactgttgccagacccagttaacctaaatacattagcattctagaatctatattgctctaatctttcaggacacagggctgtacaagccagcatagttctccctaactctgccacctaccacgtccctctgttgatgtccccatctattttccaggcgatgaggctagaattcctcatagctagatatttatttatgtattatacagttgtttagcaatcatggtgttgaaacctacaaatatctccttagtagtgaatgtaagtgtttataggtaagcaaatgtctaagatagtattgcacttttgagcttataatacatgttatagttataaaatagtatttttttcccaccaaagtattccagttatatatttaaagaggaggagggggcttcaaacccacttactgtgggtcctgaatatgttctactgggatttcttattcagtctaggaaaactctgtcaatggaatgttttcatagtggcggcaatctctttaaaataaccctaaatacaatatgacagatgccatctggcataatcttttgctagttgcttctaacttttatttttcctagagctaagttcatccaaaactggtcacttactgttatgataaatacaatgacattttttttccttcctgtcctcctaattgtgtcaaaaaaattctgtgagactataattgataattgaacattgccatagaataaactgttgtatatggactatttacattgcattttctttctcttttctccccccaaataaaatttaaaataatgccattctttaaccatcagcaaacatccaaagattttctgttgatttttctcaagactttttagagtagtaaccattagaagtaaaattaaattcttctaataaataaatgctctaggagcatgtaatggtgcccataaatgcttaaaaggtttctataattgctgttaattttgagtaatttcttcctatatgtatcaacttacttgagaaacccagatttgggatttctagattttttttttaactgagtcatgtaaagggatgtctcctgatgccagttagagtttaatttagagtagtaattaaacttgaatactgcctcataaacaaaagataaacaataaaccagccacgttccctgctgtttcatagctttctttcccagatgttttagcctgataatttttacacagtgaactacctaacatggagttttgtggacagaggtagaaaatgagttttcttttttggtgtttttttttttttttttttttttttttggttgttttttcctggcaatccttttttccttccaaaaagcaaaatgcaaaggatttttcattatttagatttttttaaaactctggtgaaatagatatttaatggagatgtgctttaatggtaactatggtttttttccttagatattgctttttttttttttcaaaattaatttggtcatgaatgtctttcacatctggtaattgaaagagaaccatatttttatttaagtaaaatctcgataataagtcaaagaaagaaaagcttgacagtggagaatttttctttttacccttcttgccacttctcaccggcatgcattcccactcacggccagtgttactctatggctctgctcttccttgggctacaagggtttctctgtccagttctagactcttccactgtcagccatgatctttctaattgtcaggtacgagtcagccgttcaatgcagaagccatgttattttcactgggtggggtaattactgaaagctgagaatagctgcactaaagacagagggatactttcatgatcccattagcataagagtgggtaaattattcatgccaagtgaggattctatggggaaaagtatagttaatgcacatagtttttaaatgtatccctttctgctctgagactaaattcttgttggaatcagttctcagacatttacgggaaagctctggtggcgtgttagatgcagttcatctctctctgtttgcagcgctctcaatagagaccatctggcaaagatccaaaaggtgattaaacaaaatgatcagctcttgttgctgtgttacatgtccaatactctggattaaaaaacatgacccaggacagtcaagctaacgtcatgccgcgcccccttccccctcccctctcggtataagaattcagatggtccacaaatgtgtgtgccatctttgtgtccttatggcccataatcatgaacaggttgtgcaaatggctctttctgtagcactgtctgttccagcaccatagaagcatttcatattaattgggtcagtctaatattcatattgacatggggaaaaattactaaaatttattcttatagcagacaatgaatatgtgtgctttctgccatgagggaagtgaaatctgacaactggcttgtgcaactgattaatttttcttgaaactggagaaaatcaaagcatgaaaaactgtcattctctgaaagcaatgcacaacccttttataactaaacaaaatggattgggtagggggctttcggggaacttgtagaaatgagctctggttttaacgccataatcagggatgagtttacagtgccattcagaagagtcctccctcctcataaacaagctgataatcacagggaagctgacttccaattagcttctcctttcctcacacggatcagggtatttatatgtcctccttgagctttgatatgtcactactgagttagtacatctcgtgtcaaatttgaaagtttggaaataaaatgttttattatgaggaaatcctgctaataagcaaggtaattttcaaccaatcatttcacgactgagttaaggtaaaaatgccaagatttgtgactaagggacagatgtatcttatctttgggggtctgcaccaaatgccaaggagaaatataaattgaacaaaccagacattgtgaggaagtgattgaagaaatattgagatgaaatcttggaatgaaatatatatgtatatttataacaatgctgtgaattgcttacatgtcacatttgcataagcctgaactgggattttattaaggggcagtttagttaaggcaaaacataagactattaactcattaggtgactcagagattacagctgaccatttaatattgtggaaatagtctatgactcatattataggataaatttaagtgcaaatgtcaaggaagagaataaagcagaaaagaaaaaattctcaaaaaccactttaaaacatcatcattccttgtcagccatgctttctaaggaagagtaaagcagtaggtaagaaatacagatgggcacaggactcagggaggggaagtgagggtcccctagagtcagtgctgtgtgccagatgaaagggactcacatagccttgggggtcttaaggctattatagggcaactcatgctctgttatcatgctgatttttcaattgatttttggctgaacagtacttgttgaagccctccagagcaccaaacacagccttatggtgctatacattgtaatacacgtgttctatttttcccttcattgtctttactttgcttcagaagaatagtctgtgatgacgccatgttattttttccccttctttctttccgatttctaccctcagagagtttgttgaaagtcttattgcttttttgctggggaggagggtagtaggagaatcactttttattttcacatgtggaaatttgcttttaatttggcctttaaaaatattttatgtcacagcagacaataatatacaccacttttatataccaaatttatccctcggtagtcttgagttattcactatctttctgaggaccagcaaaaaagcaacaacggggtttcactgaaatctagttcctcattaaaatgaaagtgaaccactttagtatccctgctatacagcaataagtttcctcagcttgctggaacacaaggtctcgaaaaaaaaaataatgaaagagacctagagggagtgtgtccttctcttctgcctgccttggaaattcgtacagatgaaaatcctgttctgatattatcttctctgtgagccttcctgatctgcccaggtatgaggccgtggctccttctctgcactcccatggcactttttacctctattataacatctttcacactgcgttgtaattatttgattcctagtctctctctctctccctgcttttccaaggtgcagattatcacttcttcgattatctggcattagtatgtccatttttgaagcaataaacaaaatccacagatttttcttttttccttttttaagatgtataagttgatcaaaacttggtgtgtattggttcactgatgtgtgcctgaacataaatgaactctttggaacgtatggatatattccatcaaattccattacatctttaagagataaaaattattttgttttactgaacttatgttgtattcattactgtcttaaatatgtcaatggaccatcagctcaaacttagcattatttcgttgtaggtaggttcttaaattttaggtttctattttaagtattactttaagatagtacttaaaatgggacttatttgtcctttaatgtcttatattatgtgcatatggtcagaatttggagatgcaatttcattatgttatctatacaaaatgtatagatggatgtctttaaatgtaatggtatatctaatagtggaaaattgcttggtgtggcaaatagttctcatggactcaggatccattttgctaataagtgttgtttaggataggattgacctcatggaagtcattggtgggtcttcacacacaggtaaaggagcctggaagtatttcatgaatttttaggccccacctcctgttgtcgattttctacacatgtcctccagattttcatagtttgcatttgggcaaatataattatttttggtgatgcaagcaaaaccttgtagtgagttctttttcatctacatgggttactgtctagaatcttgaactatgagtcgagacctatgctcaaaagtcatgattgcattgaaaagggcacagacctagaagacagagagacatgagttccaatcccagttttactcaatatctgccagattcagtcactacatctggaaagtgaagtgcttaatataatctcacttatattaagagagattccatgtgttcagcaaataacattgcctggaaccagtaaccgttggttcctttattactctctctcttccctttgtcctatgctgacattaattagctatatgaccttggctgtgtcctttaatctctttggacttttgctcacctgtaaaataagattgaattagatgatcttttaaatccaagctccagaaatctaatgtttccattcatgggtcttaatttttatttgtacattttatcttttaacataaagggaggccacaagcttttcatctggggtataacatgaactttttaatttttttgatttattatacacagtgaagtaatatttctgtttcttgtttttggttgccaggagagcctttttcttctcagtttggcaaaaatatgactaggcattagagtttattttctgaggatagtggaatgccacaattcagatataggacatctaaggtggtagtattaataccaatagactgttctatctgctaaaatatgaggcgtgttttgaaaacacagagcaacgtctccatcctccattatctaattagaactcactcagttggaattttctatacttcacaagtggaacaataaacgatcattattacagaggctgagattctacccactcctgaaatatgttccaaatcattccagaaaaaaacctaaataattttcaggagaattttacagttacatatatatttagccaaattataattatttagactgtaaattcatataaaatatagataagtaccttatcttagtcaatgaaatatttgtttaatcaaaacacttattccttaacccttccagctggagatatgactcttgcctcaaaaccaatcattctttttttataagtttgaagatttacgaaagtagactgggagtgtaaaatttcatatctcttcttccaactaacatttgtaacaaatgccatccactaaaataaaactttcaaaatttccatgtactaaatgtgaaagatgaaaaaaagttgataaatcattgattattggaagcttatggactctacctcatggatgtccttttctgacaggttgtcacacactggggctgatgtgtagatgcacaccactctctggagtcagggagctctcactctctcaagacctcttcttagtgtaggctgtttaaatttaatacacaaagatattcattgagcaaggcaccttgggaataaaaatatggaaatcacaagggtccttatcttcaacggcttaccttctcccaagatgtgtgtttgtgtgtgtatgtggtggtggggggagtaccatgacaaatgtgcaagtaactcttacacatggcaggtactcagttatagggggagcttgttgcagattaaacggcagttttggaagcaggtggatctgaacattcctctttgccctgccacttccaagcagcaatatttctgaatgtttgtttcttcacctgtaaaatgggaataataactgtctcatagggcagttgttaggattaaattagcacttgcttttaaaaagtccattttggtgactgactaatagtggagccccaaaattattctcttcattgaacatttatggaccatataattgtgtcaagtactgtcctgggttctagggtatgaagcaaacaagatgtgatctctttcctcagcaagttggtaatatttagtaagcaactcagaaaggtaaacgaataaatacacatgcttctaatgttgcatttaacatataggttgtaaggtatttcagaagagggagtgattacttctgtctgaaacatctgtggaagtcttcacaaaattcggaaggttttaaaagattttgatggtgggggaaggggggagggatattattaggagatatacctaatgttaaatgacgagttaatgggtgcagcacaccaacatggcacatgtatacatatgtaactaacccgcacattgtgcacatgtaccctaaaacttaaagtataatacaaaataaataaataaataaagattttgatggccttcagtgggtgtttccaaatggaaaaagtagggaaggtgcagggagcagataaaacagccagcgcgaaggcgcataagtgtgatgcagtatattgtgcatggagcaacaactgggttgatattgctgtttgtatgagagaatgcatggtgaaaaaaaagaggctggagaggcaagtgggtgcgtacatgaagatccttttttaccacactaagaagcttatgcttaatcctgtagagcactgtttaccaaactttcctggtgataagtagctcctcagatgcatataaatacagattccctggcacaccacagaccacaggaattacacaaccaggactttccagtgggaaatgctgggaatctgattttccaggccatatgcctgggaaaccctgttctgggatgtgaataactcattttaaagaagtttaagcaaaaggagtttatgatggggtttacatttttaaaaataactcttgtagaatgtggagaatacatttgagagaaagaagactccatatagaatatagattaatagtctagaaggtgggtgcgtgttgaatgaaagtattggcagtagagttggaggggagaggactgacattacatgtggggagaaaggaagaggacaaagtccacagtaacatgcaggtctctccctcagtgcaggcaccatagtcgaggtagttttctttttccctgccatgtgtttgaagtatgcatatctaccaaccagtagagaagaggaggaagaatatttcatttgcacatgcaaagttgtcaaagtggaaacgcttgatgcatgttgggtgaataatgattctttttggggcatagagcactcacaggcaatgtagcatagtggttaaaggtatggcctctagtgttggcctacgtgcctttatatcctcagatctgtcacttatcatgggcaaatctcccatccttcactttacatctgtaaaaggagggtaataaataatacctaatctaatagatttggagtggaaagtagggattaaatgaggtgatttatgtaaaatgatagtaattttatgcctcattcatagtaagtaaatgttataaatatgttttatttaaaagttgctttcaaaataattgaaaactgaccccatgcaacaaacatcatgatgaagaactaaaaatgaaatcccacatttatccctggaaaagagaagttatgaatccctggaaaagagaagttatgaattgtaaagctagaaaagcatccacctactctaagcctggccccaagccccaagcccggacttctagttggaagcagatcttttcctctgaagtctgattacacatttcggacacacgaggttcccctggtgctacagtaattggttacatgacttacttattatcttgcttgactgtaagattcttgaggacagtttctatgttttaggcatctcctccctcttctagcccccactgtgctacaataatataggaggccttcaataataattatttttttttgaaaggaagattgggtccatattgtgaaggacattgaatagcagactggggagtttgtgcttgatttgctaggtaatagggacctattgaacaattttgaatgggggtagtgacataattgccttccttttgaataccaatgacaaattctctgctatgtcctccatggtcaaaatagcagacccgtatgcttccctgaaatacggcctgtttgaaagactggatattcttttgagggaagaagcaaatttcaaatagctctttaaaaaaaataaagctttgacattctctctaaagtactttaggcacttaaattattgtgattccttagatcccatgtatgtgacaccattctagaaacttgtagacagggcacaagggcacatttttataaatttttttagcattgttgcaattattaacacctagggatgacttaacaggattgagtaaatatatcttcttcaatatttagaaaactatggttccaagaatatttaaataggcattactttaaatgaacaaacaaacagaaacaaaaaagaactttgtggttaaatagattgaaagctgcagtagagcagggtatcctctgctacaggaatgttcagatcccctaatttgctaatatgcatttcaagtctgcaaagtgtggagagacagagctttccagactcatttaaccattgaaacgcttttatgcattatctctgggggccagtctttctcagaacacactctggaaaatgtggtccgggactctgcttctctcattgaagtacctttggatagagtttaattttgtagggagtcttcctgcatcttgtttttaagaggtgggtcagcatgggctcaggatcaattttcaattgtaattgtgtaaaaataacttcctttatattcagaagtctcatggacttccactatacttgtgcagaatgttccattaacccagctctccatgtagttattcttcattgtattaatcaaacaatgtgccttgaatatcccttgagtgtttcattaaaagtaagcacatttggttacaccctctaaaatgtataaatgaggatcccagcagacttttactcttgacatgaattgtattaacaactagcttgatgcatttttttttaagcggccattgagttggaggttgggtggcaaatccatgaaagaggaaggaggtgagaaaacaacaatctttcctcatttggagtggatggcttggttctgcttgctgcaggtggtgagcaatggactggatatactgtccacccatgggaaatttctgggaaacagctgcaaaaccccaccttgtctacatctcactgtcctagatctctggtttagcaaatattagaactggttgccactgatgggtgttgcatctactgtccataaatttttcgctgactctcttattgttggaggatcccagaaggtatttttgtcatgatcggggcattcaggaggtctagaattacagtccctcttggttatcaagtgaggtgaaactcttctgcattcctacattctacccctcagtaatgtgtggggggattgcccacttggatgtgtcacacccccttttggctgtgggaaggagaattaggctgggtataccttgtctctccaattttgaaatgaccaagaagaggcttgtggtacagttaagactatctttgccatatgatgagaaaaagttgattttgtcttgtttgtcaagagactttctgcaagattttgaacgcttcatagcagttagctcagaaaactgcaatacctctaaagaatgttcttcctattttatacataggaacatagacatattgggagaatcagtgacctttaacatcatcaatcaccttaaaaaactgagagtagaaacagaatttctcttctttatccaaccagactgatgtttctacacacatgcactacatatcctagcatagttattagccactaaatggatgagagttttctctctatttcttgttctaaaaggaattctagatgctcattttctgccagtataaaatatgagttgctttcagctggcaaaaaagaaaaaaagaaattgggccctggctaacgtaaaattacagcaaaaataatgtgtcagactttttaaaaattagaggaaaaattggtacttttatacattggtatgttatactaaatgttgggcatttaatgcagaaatatcacagaagcttccctttgaacattgatagggaccttgaaacctgctgctttgtaggcagatagtgaaagtggaaaatgaagttcatggacgtcttcctaccttatataacatctctaccctagagacagtaatctctgaagctgtgacttaactttttcatgtgcatggaggtaactcctaaaaaaaaaagattttacttaaacctgacctctttctagtcatgttgtctagtaacatttgcttagtttttatggtacacttgccagtaggaggtaaggaaaacaagaattgaaaaatcaatcttgattatggagggccactcatctagtgcttattttgtaggtcagctctgtgtagcaccctcataatgagtgcggagtgctcagtgcttagtttgtgataaatacacattggttgaataaattgttgcaatttgacgattggttaatagctagtaatttgtgacaacttagaatttgctagcattgacatagggtttcgttcctcattagggatgttagcactcccaaaatttgttgagtttgtcaaagcgtcagtcaccaaatctgtgatgcatttattaggtagaattgagtagtcataggtagaagaaagcaggatacaaagtcatggcttgagattcctccaactcctgcaaacttaagggaagtgattccacactttatagagagattataattcaaaactcaaatgctcataactttgttcttaagagcatgaaatttgaagttagacctaagtctgaattctgactcccacatgcaatgtgacctctggtgactgatttaattcttcgaagcctaaatttcctcatttctaaaatggagttaaccatgcctgtctcatagaaatggtgtgagaatgaaattagataatatatttgaagatctatgtgctgggttgggcatctataatacaatatgctccataaatgtgaataataataatagcaattaagtgataataatatgcatgtgaccaccggctttattagttttggttccatagcttgaactttaagcccacatcacttatcactttctgtaaatttctatttcaggatacagtataatatgatttcttaaaacaagagaacaatagctcaagacactttctttctctattttcttctgttttttgtttgtttgttttataacacagacatacaaacatgggcagggtttggagcagaaggagtctcaggaaaaggcttcaaatctgggagaagtatgaggtcaaaattctcagtttcctgtgtaccatggtttggtactcagtcaaatgctgtcccattctaatttttttttttttttaatttctgatttctgttttctgcctaaagaccagaagaaagtgagctcagcagaccagagtctgaatgtgggccttctagttagccccaattcagttggaggtatgacgtgggacagctttaggaggcctggaggttatgggctcagacataagggtgggagagcctgggcaaggttccattctttactacctataaactaggcttttaccttgtaaaggaatttggtggaaggcataaggtgataatgtatacctggcacgttataaccatctgttaaaaattagttactgcagtctggacaacgtggtgaaaccctgtctctacaaaaaatacaaaaattagccagacatgatggtgcacacctgtaatcacagctgcttgggaggctgagacagaaggatcgcttgagcccaggagatggaggttgcagtgagccgagatcatgccactgcactccagcctgggtgacagagtgacaccctatctcaaaaaaaaaaaaaaaaaaagagttagttgctggctgggcatggtgactcatgtaatcccagaactttgggaggccaaagcaggtgaatcacttaaagccaggtattcgagactaggctgggcaacaaagcaagaccccatctctacaaaaaaaacaaaaaagttagctgggcacaatggcatgcacctatagtcccagctcttcaggagactgaggcaggaggatcccttgatcaaccaggagtttgaggttgctatgagctatgatcacaccactgcactccagcctgggcaacagagtgagaccacatctctacaaaaaataaagttagttgctcttaatactatcattatctctttaagctctcatggactcacatttctgtgtgattaggatgttaggggatttctaagttttctccaactctagcatgctgtatctattacttttcaaatgatattatttaaaactcaagttatgtctgcaaaggaatactgtatatttagtgttacctttcttaatgtaggtttctaatgcatttttacataaatttttgtttgattcccccagaatttttcagatttatccccattttccagatgaagtggcttggccttggagagggtcagttacttgactgtcacgatagaaagaggaagcagaagaatgaagacaaagccatttaaaattttcttgttctttaccttttgcataaaaggtattcagttcacaaatgatgtaaaatttaattaaggcaagtgactgtcctgagaaagtcattaaaaccctcatgtcatttctctaatcaaaaggctgccacgcttctattatttctttattacaaccctttatttttatttcttcaagttaaactggagcctgagccatcataagcctcttgctagtgattttttaaatcagtgatttacactttgaaaaaccaattttttttatttttccaatttatattggttagatccatagggtcactttgattagaaaagagagccattagaaattaaattggcaattctaaagggttagttatcttctccttgttcttagaaatggcaaagaatacaagaggtgctgaaggctaagataatgagactacttctcttgtgggactttccaaaactcctatgtcatagtcatcaacttatatataagtaaaaatgcttatttgtgttttagcatttgctctttgcatcaaacctccactgactttgggaataataagatctgctaccccaagaaagtctgccaattccattagtaacacattcaactggatcaaaaaactgaagagttagtgaatattttatatcgtgggtttttaaaagatatttttgtgtgaataaaaaaggactttctcaaagctgctcatttcaattttcttttaaatttgctcaccaacaccgcttaatcacctctgtaacctactggaagtgttctctagatgggctttaaaaattaagccaagttgatttcttttttgttataaattggcttagcatcttgtttttatctggcttgaaatattgaagcagtaaaataaaaccacactctttaattgaaaggtgcttctgcagtattcaaaccacagttgtcagtcacacgtgttgttcaaattcttcagagctccgaaattacttaaaggtatcctcagtattctgagagagttatttttgccccactacaaaataaaaaagagccaatcagggctttctcaactctttggcagtatttttcctctaaagaatttcttgacactctctttagttcttgacttccagggttgttcctgacaaatctccagaaatgtatctcagtgcctatagtagtgtcaaaagcatgaagccacatgtctagatgttgtgaccttacatttcattgccagcagttcactatataaagtgcttaaactgccacctacctaagggcttccagaatttacattatgcacttttgaaagggcatactttgaattgagactatgtaagtacttctaatctctagttgacctgatcttgaaaacttctgaaaaatattacatcatgagtgatcataggaatgagaatgatatttcagcataatttcaaaatcacgtagtatcctatgttcaaagttttctgtgctaaagatctaaaaagcacattttgaaaatatctagttatctttggctcaacatttcaatgggaattagttgcctaagaaatgataccagacaatagataatttattccctctttagaaatgttgtagttgtttgttgatttttactcactggattgggtttgtggtttaaagagaagttaatcctgactttcttaaaacctatagagtttcaggatttcttaaagacaatggcttttgatactccaatccaatccattttcccatgcgtaagtgttcttataaccttcctttgctcaagttctaggacaatgtcgatggtgtctacacagttaaaattaatttgaaagttgaccaattattcaattattttgactaatgaaaatcaaaaatagtattccattttgcatagcagtaagaaattagcctaaatgtaactaatcaattcactttgcctgtgcaaatatgttttattgtatcatttgctgtaaggattgctaatattattcataatgtcctttttattttaaacttttataagtgatatggttttttgtttacaattggggtcatatatattactacatatttacgttgtaaatatgtttttatgtaaatatacaaaagaaaaatagaaaaaatagagatttcttatcagcattatatactaacgtagtatctgcattgctggtttgctttctgtcctgaaaataagtggatatgtacacagatgtctttaatttcctagttttctatttagttgatatattgtatggagacacaaatgaggtattttctctcttttgatatcttaagttttaaaatatgttattttattttggttgagataatgtgtaagttatcactggaccttaagttctatttagtttttgcttttacagactaaatgctgtcttcgcatatcattacttaacccaccataaaatccttctgatcaagtttttcatatatgggacaaaaaaatcgttttgtttcaaatcttgaccagttctagcctaagaactgtttgacttaagcaagaatttcaacacagatcttgcagcttaacacccattggtgaagaaatattttctctttatattagttcatttttcatggcttctttatagtgtcatatgctattaggaaggagaaaagctaatgtgatatgtgaactaatttcttgtttaaaaattttaaagagtgccatctggaattcaatcaccatctttccagatactagctttatcgtaatctgagactcagttctatttgattattaccattgatagacagaaaaaagtgctagatcaaggaaaagtacctatgatatgtatacccaaatatggcagcaatagcaagattatcatcattattatagctaatgcttgacagctactctatgcccaacattgtgctgtacgtttagtataatttaatcctcataagcttgtgtgggtttttcagttgggaaaactgaggcttagagagactaagaaacttccctttacctggaatatctagaaagtggtggggctaagattgtaaatcaggtctatctaatccctaaatccagacacttaaccagggtaccacaccctgtctgcaagaaaagttgtcaaatgatgtcggatacctagcagtcctgcacagtagtgcacgccagtaatcccatctatttgggaggctgaggcaggaagatcacctgaggccagaagtttgcgtccaccctgagcaacatagtgagaccttatctctaaaagaaaaaacaaaatgctcttagatacctgttgtcagacctaaaatatgggctagagatgttccctcattctgaaagcttcaggtgggttttggtattttctatcatatgcctggacatttcagtaaagttgttttgatgctttctaggtcataatggtaacggagatcagctcttttctaaaaatccaccctgtaagtattgatttggtgacaggcttgtaatgccatatatggttttagaaaattactgatagtttggaattgccatactgaagagacgtcttaccccatccttgaagatgaacatttctctgacatcatttcaagtgtcaagtgaacaaagttttctaagctactgatcttgatgaacaggatgatgattaaggcacagaaatcactggtttccaatttttaaaaatacattccaaaaacatatggcacataacagaattcaacagaagaaggtaaatttggttaaattcttcaggggtccttatatgtaaatttgatgccatacagttgccctcactaggataaaattagaatttgtgaaggatctgattggaatttctcctgggaagttgtagaggatgagcatggatatttgttttgatttaaatattggcctgttcaatctccatgatcgtaggacaagatcactgacaaagcaagaagacagtaaagttgtacgtttccgtcttctttgtgaaagatctctccttctgtctctttgactacatccttggagtataccatcccttctgtggccttatgtttttgcaactaaaactttattgatttctactgcttattacaagttttgacatagaaggagggacattcacaaatgattttcttggcctactttagcaatccttctttttctctaagaaaacaagtcagaatctgtcacactgtaatgatacttaggcccctgctgttcctaggctgggcattgaaattatgccaagggcatcagtaagagggaggactagcttgtcaagttagtgccacatgcaaagagtattggcctggagatcagagagctgtgagtcatgggtcacactgccttacctgggcacctgaatctgtggaaagttcttgagtcttttattataacttgttgctcctcaggcagcgtgaaaacctttagtaggcttctgagctgatgactgacactagtgtgtcaggagctccaagttctggtctagctataatttcccctaagacatttacttgaagaaataaaacattttattttgaaatttttaaattatattaatttttaaaatatcctgcttgcttttttcaaacagttttaagattttttgaaaagttattttaagatgttttatggctgccattttatttataggaagatatccagattttgaaagttaagaggaaatgctatacttctgaaaagtttcagaaaaactcgtttggtgactgtaaatcttagtttctacaaccatctccccaaaagtccagaattcctgcctccttttataatttatttcaaagaaataattttgtcatttaggattttttaaagtgttaaaggcaagtattgaaagattttatgctagctcaagtccctaatgaatgacttaacaaggtagacatggcaaccagctgcttctgaagatattcttaatgtgtaaatttttagtgcggctacctctgcaactacaaaccctcatcttagtagtttggtgattttaccctaaagacctatatgttaaagatattttataaatacgagtgcagtcattgttttgtatagtattttatggattatagaaactagtctgtttcctgggtgaaatttaattagctatctctgcccttaaacacttctgccggcctcgatgaccttctcttagggcacctggtatattgcagcactttaacatgatgcctttcaagaaggcatcccaatccctttaatccccatcttccgtctgtttgaccccttcttcattgctacagttagaagaatatttgtgtgcacccagtgagaaggtttattttgactttatagatgggatatctagagctggagtcctatattcaggtaaggtaataccacaggatgaaaaatgcagccttgggtagccgcaccccctaagaggatcagatacaaatctgtacaggacctaaccatgcctatttaaaattactaactgcatcatgtattctctgtagagagttcttaactttttcattaatttccttccttgattgataaggctgccaagtgtgtgataccctcaaagtagatgataattaaattcataccacttcattattaaacacctgttttccttcccagattcccttggcagataaaacatgattccagcccacaagttcttatttttagggccattctctacaattgttagaattgtaccgaatccctgcactctgtagctgatgccaaatgccaagcatcagattcacagtaacagaaatggtgatgagcttagaatcattacgagatcataaacatgtgttttattcaccttgtttagctgggtcccacccagtcttatttgaaaagttcagaaaccaatttcttctctcatgtagtttttttttctttttgagtctgtgtcataattttttattttcaattaccttccaaacaccccatgaaacgtatagagcacacgttcaggggttacagatactaaactggcaaatatggtggtacacgataacttcctggaactaaagtgtcaatgtagaatatgtgcttaattgaacactccatgatacggtttgtagaacactgaaatacctaccctaagaaaagtgtgtagaaccagagaccttaaagtttgtagattacaccaaacaaaactatatactttcttaagaatatgtatttttgtcagttcctgttaatccaaggtagctaaaaggtggtatgttgaagcccaaaatgaattttgaaaaatgtaactcttagagagtttgctcatgcctgtaatcccagtgctttgggaggctgagatgggagaatcacttgaggccaggagttcaagactagtctgggcaacatggcaagacccccagctctacaaaatatttaaaaaattagtcaggcatggtggcatgcacctgtagccctagttacttgagaggctgagacaggaagatcacttgaggaccgtatcatagctcatggaggctgcagtgagctatgatcatgccactgccctccagcctgcgtgacagcgtgagaccctgtttctaaaaaaagaatttttttttttgagacagactctcgctggagtgcagtggcatgatctcagcaaactgcaacctccacctcccaggcgcaagcgattctcttgcctcagcctcctgagtagctgggaccacaggtgtgtgccaccacacccagctaatttatgtttgtatttttagtagagatggagtttcattgtgtcgaccaggctggtctctaactcctggcctcaactgattcacccacctcagccttccgaagtgctgggatcacaagcataagccatcacaccttgcctaaaagtacattttttaattaaaaaaaaaaaagaaggcagtacacttaggaaaattttatttatctgcaagcctcagtatcctaaagacatgtaataacttggatcccatttctgaggctatttaattaagcttttttgaataaacaagtgcacgtaatgcttagctgtacagaaattatcagtgtccttagcttctattgcttagtactaggccaaataatttgaaagagcctgtaattctttatctcccatatgtaacatgtcagccatgactattttactttactcttaaatatataatttataaatagaagcaatgttgatagactcgtttgactcccttctagaaataaatgactcattctggattgcatgtgagagcttcaagctgctctaagtaacaatccacgacaatgagaaaattgttatattattcatctgggcagcaggaaattaaaaaaataaaaaagcagtctgctcccctagtaactgggaccttttgtgtgttacagatcactgagggcaaactttgcatcagttctgggcactgggcaaataaacttatctcctcgtttttgtttttgtaccttgtcataaactatgtagattgttggtcatttaaatacaagtgaatatatgcattaatcaaaaagttatcttaattttttaatgattcttacagaacagtcttttcttttagatcatttttttctatttgtaattttgtatttattcaaaatatgtatgtttgctttaaaaatggggttttccttttgaaagaaatcccctggaaaagggtcacctctgttttctttggaaatgcaggaaatcaacatgtcctctggcagttatttttcctcataatatgcccagtaaaagtggtggaatcttgacccaggtgatctgtggagcctttgctgatgaatttggtgccactgctgtcctcattgttttgaaattaaagagacaagtggtaatagaaagaggaaaacacatttttaatgcagaaatcatttagacctgcaaagtttgttgcccactgaggaaagagctctgttagtggtgactgcacagatcacatgatacaaccttttgacaactgagtgtctgccggagacgtctgtgagagatgaccttttgacctaggaaggaatgctgtgaaggtgggaatgtactctcagccctggcccaggagagaacgttgaaaacagccccagcttctctgctcacaggatctagcttggttttcgctttgactgtagtatcagacgataaaaacttgagagcgtttcctaaaattcttccagacctttactattactcccaccctgtgtaatagagtgaaaaataatatgagttatcctataaatgtgtgttgcaggtgacttgagaaatcagttgttctccctaccagctcgtgggctggaacccacatcttgacctgttttcaggcagggaattaagcccatgcacgatcctttgggggccttaggtgggtgtggggggagtagggagaaaagaatgagtccattgctgtagaagcattcccagtagcgatgatcttcgtaggaacaaaaatccattgtacagggctgtaacctgagaaactttctgttatcgtgcttgttttactcaccaacattgatccccggtacatgtgaccctttgaaaagaagcaccatgttggtgattcctcttattactaaataccattgtgtttataatggccatttatatatggttacactccacgcccgtgtggttaataggcgttctctaactctctgatgccacctgaccagcacaggatacaagcctcggcttcttgattactctctttaccctgtcgtctgtcattctgtgatgttctctgtgaaaacaaagtagagagcttaacattgctgaaaatagggtagcacaaactctaccggggggaaaaaagacaaaaaagcctagtaaagccttgaaaaaaataggttactttatttatttatttatttattttttcagttccacaatatgtctgcatgctttggcactgatttctcagctagttgggtcccaggaggccccgttgagccctttactgctcagggagttgccgctttagaaaatgggggaaaaatgtagtttgtatgaattgttctttaccttggtttgggttcagaatggcagctgcactccgactttgtgtgtgacagcacaaaggccagcaaaactgaaaagcaagtcagcaagtagagagacaaaagcaacgatcagctaatacagctccacatggcctgactaatttatgagaaaaaaactgttctgttcattggatcagcactctgaggaggcaggtggaattgtaggaagttttcattgactctcccgagcaactaaggacgccacgagagattcttctcagtttgaactttatcagggtctacgcttaatcaatagagtattggaaaaagaattaattactaaagcagaataaaacagctgcattttaaactaaggatccatcaattcggtaatcttccagttacaggctaggtgccgtgaggatttgactccatgtaatgaggaacccggggagtttcctcatgaacaggctgggaattcacattagcctgtttcagctatttgtcattagtacaactcatttctcctcttctgcattacaatttgtattttatgtactgtggaacccacgaaattcccacattcatgggagggagggcgttaaggcggaaatcattgtcaccctgagaaagagtcttaacctagctcggcctctttattctggaagctgccgcgggagcggttcggagctggaccctgctccattgtgcccagggtgggggtcagggcccccgcctgttgaagacacactggtttgaacccagcctggaaatgtttcatctataatttccataatggtggatttcaaggagggctgaggagggttatgggagatgaattaggtttttagtgagctcattaggaagccaaacagagttgagacacaaggcagtgagcggggctgtaatcagttctgctcgctttgttccctgcctccgggacatgtttcgaaaactttctggcgggggctgccgagccggtgctcaggcgaagctgccgtcctggtggctgacttgttgatttgtaaacctcttaattcattttttttgttcaatttaatcttttctttctgaaggaaaattagttgaatgttagccctctttgcactattcacctcttaaattatgctcattttgaagagcttgttatgcctgaataaacatgaaatgacttggcattttcccatcagaggcacacccattttaacaccatgtatttaccattcctggaaatgtctcattaacttctgaaaatctgcgagcatgatattttgggctactgtaacacacctcttggcagtcacagaaggcagtttggttaatgcctcataatatccatttttattctcaacatgaagaaagactctctatagaaaattgatgcagtttgctctgctaattttcatgctcattccaattaatttaacatgacccagattttcttcctcgggctcatcctgactaattagtaaagcaacacctagaacaagttatgtttaataacattgaggaacactagttgtgagtgattttgatgctaataaagatattcactgatgggacagatattttatgtcaattatggtatgtaatttagaagtcccaatgtgctgcttggagtatggaaaggctagcaaatcactacgggagataatagtgtttttaagacttccgcagcacctaaataaccactgggaccaattactttattttttgtggtagaactagcaggattgttaactgattccatggtaatgaaaggggtggagttgttgcattacaaacctgacccatattcaccagggccgagctttccgtacttagtgaaccttagcgagaaaagaaaagcaatcaggggcatcagaaagcagcatttgttcaaggagaaggagtggtttctccacctctgtggttggcgttcttttatcacatttttgtcagtgagatgaatcaattttactgcttacagcaaggttgaaggtggtggtggctgtggcagtggtggaaggtttccgaagtcgagtaatgttgtttaatgttgagagctctccacattctcatgaggaaaacagttgaaagtgaggctctaggaagtggggggaaaaacacacacacacagggaagaattatatttattttatttctaacaagtatttcatcagtgcctatgatgtgccaggcactgttctatgtgctaggagtaaggagggataggaaaaccccagtgcctgtccccaggatgcttacgttcatagtcgaatgtatatttcctattgtcttaagttgatcaaccacaaaatcttggcatgaattactcaatagggtatagaaatgttatgaggttttataggagaatgggaaattctggacagatggactctgagctctcagagatagccatcataggatgcagtcaattggtgtcatccctgtttctgcactgttacctataagaccttgggcaaattgctccacctctctaagccttagtttcttcatgtggaaaatgtcaactctcataggatgatgagaattaaacaaaggaattcatataaagtgtttagcagagtgtctggaagagagtaagtgctcaataaatattattttgtattaatgctgtcgttattctagaaaacacttagagtgaaaatttctctagcggcatataatagaatgtacgctaatcatttctcaatgctaattactgctgttgaaatttgaaattagaattgacaggaatacttcctttttctaaatatcacaaacaggcttctttctacatccctctttaaaaacacacaaagttatgctgggcacggtggctcagcctataatcttagcactttgggaggttgagacaggagaatcgcttgagctcacaagttggagacaagcctgggcaatatagggagacgccatcgctacagaaacattttaaaaatcagctgggtgtggtggcacatgcctgtagtcccagctattcagggggctgaggtgggtggatcgcttaagcctgggaagttgaggctgtggtaagccgtgatcattccacggcagtccagcctgggcaacagagatcctgtctcaaaaaacaaaacaaaacaaaacaaaacacaattaaaaacatgcaaagtctccccacctcctgatttttcattggcaagttttctgtgtgtaaaatcactggcctctcataggtcagggcttccatttttagaatttatttctactttatctttttcatctggtcaatacagaaagagaatgtaattgagggagattgtgagagtgaggctagacataaaaaacaagcaaattgaaaaatagaaaaagcaaaagaaaagccttattacaattgctagtaaagctggaaataatgctttatggaattgccattttggtagatcaaaaagtcaaatattagtgatttcagctggttcagcctaatattatcatacgccataagtaatggaaagtgctacaggcaaggcaagaagttaggaaaactttgacctcactcgctttatctgttaaatgcggataacagtctatgcccctacacttggttgtggtaatcaataattgaaaagaattatttgacagctgaaaaattattatatagatatgaggcatttttatccaagatcacatgtttcaaagtttagaacataagtctcacaataactaatccaatagttatctccctatcatgtcttgtggttgatgtatagaggatatcaacttcatttcccatcatatatatagaaaaactagatattttagtggaaattctatagattttaaaatatattttcaaaatgaaaacattctcttggttatatagttgttttcacattttttatcatttaaataatacagcacttttgggagaattttttctcccaaataatacagcagttttgggaaatttgcttgagaatctttgaaccttcacacacagtatgactcagaatataaatagttgaggaagtcattaccaacttcagtagatgtgcataaggtaaatcggacagttatgttttaagtgtgccaagaccctctgttaggaatagttttacagctatgaagtgaagttggcccctctccagtgattactgactggtggtagaaattgtgttctactgggtcagcggtgaattcctcactcaaatggtgtcgagtcagccggtttttaatttgttatcttctcaagagtgcattcgccaactttatcactgagaagaatgactccctagcctagtgtgatcaagatccggaaatttgctgtatcagcatattaaggttggactgctatttgattggtagctcttaggtctgatcttacagcaaagatgttacttctctcataggctggtttaccacaggtatatgaataaacctactgagaaagcaaaccccttcctttctttcctgggaaaaggttgaacaacttttcctctcaaacaaaaacctttacagttcctgttttattagctaacaggatctgaataaagccgtgttggtgcccttcgagttgtctttcttcatggcagaatggggatatgtcttggcaaactaataattacatggctttcagctcctcacctttctaggagaaaaagatggatgacaatcaggtatgaaaatgtttcccacttaagtagtagcacacgtgaccctttgcttttgtgccgttttgagatatgagtttcggaagaataaggaagaagatatttttataaagcaaatgtgtttttcaaccagcggtgactctattttcatttttcttatgtgaatgggtctttcgaataagtgaaagaaggaaggaaaaagagaatggaatggaactaacctttatcgattatctaatatgtgccaaatatcacacatctcaaaagtcagatggatcacttggccataattggccgatagtaagtgactgcttatccaggttcaaagccataaggcattgtttgccccacctttcacccaccctttaaaaatatgaattccatttctgtgtaagaatagagtctgtgtggtgagtagagagcatggacttgagttcaggatttagagttcaagacccagctgcattaccaactagccacgtgactttaggcgagtttcttaacctgtctggcttcagtttctgcttatattaaataggaattacactaccaaactctgaactgtcctgtggttgagatacagcctgctgaaactggcatgtagtagacagtccacaaatgttacttccatttcatccttatatggtggattcagggatttatctgaaggcatggagcaggctggcaagggctaatattatttctgtattttccattaattcttaatcttgagagtgctcagtctttcatgaatgatgtggttttcctctgaaattgtctaagatctccagtgtggtgtgagatattttacttagaaggaatgggttaagactgaatttcctgaaagttttaaaaagcaatttattaagaattacttttattatctttcaaagttattatcggtattttttttttgcaacttggatagttcttcgttaacaatatatcttataatgacatttgaacaatggagatattttttgtaaaatctgccaagtgcattctgaccacccaccttacatctttatgaagttaaagaaaattatataaatcaacacattcataaatattatgttgagcttctcctcacagcttctttcaaatgctgccccaaatcatccagaactttgctgcagttactgggagaattcccactacagcatctctgtattgaatgctgtactttccaccaaaatgtgttttatgccaaataacaggtttttgatgatttaactgtactttgcttattatttttatgaactttactgaggtataatttacatacaaaaattgcacccatttaaagtgtacaatttaataagttttggcagttgtatacactcacgagaccagcaccataatcaagatactacacgattccatcattacgccaaaatttccttacactccttttaatcactccctccctctatatatgtcctcaagtaaccactgatctgcttttggtcattatgtataagtttgcattttctagaatttaatatatttgaaatcatacagtatgtggccttttgcgtgtggctttctccatttagcatgatttcaaaatgtaccatgctgggggtatcagtagtttattcctttctgttgctgagtagtatttcagtgtgtggatataccacagtttgtttatccactcaaactggtttgttttaagaaaagaaataactaacatttattgatgcacctttgctatttcaggtactacatgaggctagatgttgtgtatgaagtccttaagtttgttaataagtataaagcattgggtacaaagtggggacacaatataagtaatagctctttctctcatgatttcatttaatttttatggttaacctgtcaggtatatgtaatttttcccgtttcacagatgaggaaactgaggttcagagggttaatcttttgactgaggtcatactcaaccaataaggaatagatctggggctggtccaagtgcagtggtgtttacaactaattgattaaaaccagtcacaggtttcttcatttcttcttcactcacactctttcactttgactagtcttaacaaatataaataagaaatagatctgaaaattcaacacaagatctgttttattccaaaactcatgcttcttccatcacatcaccatttccccccatgagtacgtgcttctgtgtttatgtgaggagggagtggaggggcagggtggagggacaaggactgcatcagaagccagtctccagtgtacaaacaaagtagtacaactgcccagagaaatagaaaaatgtcagatatttagaaaagtatgtcggatactcttcctaatttagggcccctgttctctattgtctgtttcaataaagttgcttcttccatggagtgtatcttacaagttaatgcctttgaaatttatgacacgtcaactctatggccaatttacacctcttagagacaaacattctagatagtttctgtttccaagttttagatataaacccacaaggcataaaagcatatttcaagaaataagagagccctccatccattcatttaataaaagcctaggcacaaactatacccataacatatatgaagttctaagaatatgagaaaaagagatatggtttttgacttgaaggagctttcaataattgggtagaaatgtaggcatgggatgtgggatgtgtgtgtgtgtatctgtttgtggaagtattctggagttctgagtgttaatgtaagccttggaagagcaaatatttgggctagggttttgctgtgatgcaatagaattgagagtggagaaggattaattttagtatgaaagtcaatatatgttctataatgcatatctttgtaatatattctataatgcatatctttgtaatataagcagcataatatctattgcaaatttttcaagtacatatatttgtccatacacaaggtgctaagacaagattagtaagtggccttgaaatcacattgtttgaagcaattcagaaaaaattatggataccttcaagttcaactactaggcttttacatttcttccagcatgcttatttgtagtgggaggccaaaatctggtcttaaaaaaaaaaaaaaggccagctgcggtggctcacgcctgtaatcccagcacactgggagccgaggtgcatgaattgcctgagctcaggagttcgagaccagcatgaccatcgtgatgaagccccatctgtactaaaaatacaaaaaattagccaggcatggtggcgcacaccagtagtcccagctactcgggaggctgaggcacaagaattgcttgaacccaagaggcggaggttgcaatgagccgagattgagccactacactccggcctgggagacagagtgagactctgtctccaaaaaaaacaaaaacaaaaacaaaaacaaaaaaaacaaaaccacaactttattgagatataattcacatattatgcaattcatcccttaaaagcttataattcagtggttttaatatattcacaaagttgttcaatcatcaacacagccgattttaggacattttcatcaccccaaaagaaacctcacacccattagcagtcattttccattttccatgtactttatagggcctcagtgtctgctgttctttcctgtataggctatacgaagaatgatcaacttgtgctatcctagattattcttattaagcagccacacagtatttgtttctctagggctattatgtgtatgttgtagatattcatttgcattctattacaaaaacatatctgcttggtctcaaataatggcactacatttatttaaagcaatcatcataatggaatatctgaatgcatcactttacttttaaagtgctagcaatttaatttataaacttcttaaacaaaaattcaaagtttgattaggaaactctattgtatgaaaatgttctttgaaaaaatgttcaaaatatagttttctaatagctaacaaatatgttccaaatttggtgtgttaatggtttaaaaagtattcacctaaaaccagtcatcaactccataatactattgttcattttttctataggtaactatcactagcttcctaaaaacttcataaagggcatgttgatacatatctctaactagttatcttagttaacattattattatagagacggctatcttttaagataaagagttattgtgggtttttttcacactaactttcaaagtttcgaagttacacttttattaaaatattcttttgttttcattttacaatagttggcaaagtggaagaaatattcaaaaaaccttcgtttttgttgttctgctctttgaaattatatctgctgatataaattcacagagcaatatcatcttaggaattaaaactgatcaaccattttatgttataaaaatgtattgtcttatttttgttttagatagcaaatttgataatgaagtaaggactcttaaaaatggaatgaaataatttctgttacagatagaactttgcttttttgttatttcttccaacaaattttattattgataaatacttagctgacatttaatgtttcatttaatattaaagtatgataaaagagacaataagttagaaaatcctatagttattattgatctatactaaaacatatagtataggtttgatgtagttaatacatttttggaagcagactaattatattctagttttagtttaaaatgttaaaaatgtgttttatataaacggccttttgtaggaaattctttttgcaaatataaaggccatatctttccttgaaagacctgttgattcagagatgttagccagctatctttactaaaacacttcacaacgctaaaaatagtccacttcagttaaatatggatattttaaaaaagaaaatcccagttagactgcaacagaaggacattttgtgtgacaatattttgcatgattaaaaatttaaacagaataacagctatttatatttacagttacatgagagtaattactaaagcagacaaaatacttagagcataatttaataatgttttcctctagcaaaggtgccaaaattgttatttgcataattttcacaatttgtactgaaacatagctaagtgaaattgggaagacacatccctccgaccaccttttttcttctgtaggagatgtgagaatgagactcatatatcataacaactcatttttgtataattttccataaaaaccatgaccgttgtgtcaaactattaggtgaaagagatgggatccattcatactttctcttttagggtctttatttcaatggccagcctcagcccaacttcaaggctcctaattataacatttaccagttcaaagattaacctcctgagaggggcattctgggctcttggtaacttgatcaggttggtcttctcttggtctctctccctttctggttctttgtatcacaggagggaaatgatggtatctggcacattcctaggatgacttgaagatagcagccttctgtgtttagggctgaaggattgtgaactctgttagctgaaatgccactctagggaggtgaacagaacattaaaaaaagctttagctctaggtagtgtagtgcaagttgagtcaaatttgagagctgggacttgagtggacatttgtccctgccttctaccttaataaaatatgagtgttaactgtggaaaagggcatttgagagatcactaaaaatgaatcattagagtgcccagaagagctttattatgatgtactgtgaataacttcagaacatactctgtacttttatatgtgcttatcaggtaactgagtaacaagtacattcttttatcctgcaccacagagattaagcaatctgctgaattataatggcagaggaatgtacttttctactagggtcagtcagtatcctttagagaattcaatgggagacttaggagaacagagatcctttcttaaatattttaaaattggtaagcaatatatatatatatttcaaatgacaatgaattaaatatatatatatatatatattttttaaacgagaataaccacatttagtgaagaataggctaaaagtgttggaagctttcattctcttctgctataaaggattagactgttccagtcaataaacaaagccattttatggttcctaacgggtaaattgaggggactgatttggtcaaggaccagtatgaggatgtttctgttcaacagttaacaggattcaacatgatatggaaaatacaggcgtgcaaaactatactacgacactcacattgccagctaaagcctaaaacacagccacatttacatatgtgtccatctgtctgtttttacactttatttttccaaccagtgggtgaagtggttttcatccaagctgcagtctgaattttttttttcacccaccactttccattatatcatatagatgcatattttaaagtgcatgttatttgtctctggacgcacatttgcacagccttggctgggttttcctttctcttctggaaggttagctcatctctgcaggcctgtctgctttgcagctgcctgtaccagccaggttgtctcgggatcactgagttagtgagcagtttgttgccttctccaggttgtagaaatctcccatcacaggccagcgtggagctgcagcagccacagtctgggctggccaagccagtgagaatggaagtgctttcggtctcttcagtggagagcctgcgtaaatcctgtgtaaatagagggaggataacaaagaatgagcccctgcagctccgagcatttggagccatttgaggctgaatttgctaaatgctgcttataccgcctgaaaagttgaagagaaaggagcataaaatcccctctttttttccctttctgctcataccccggggggagggtgttcaggaccagggaagcctgaggtaagccgatgaagacttgttttttcagtgcccttttgagtgtgaaaaaggtggcctgggtcactgtcctctctttaatgtcggaaaaccctcacagttagtaaatgttgcatgtaaacgaaagcatttcatctcttctgcttccctccatgctagcgggccatgaactaatcacttgaaaaatcacagaaaaatttcactttaacatgtccggacagttaagcacagcaggagagtaaaagagatcagtaattagcaggtctcactgctggcccctcatcctccccgtgtttctgggtctacagccccctcccctcaactgatctgatgtgaaaaaaaggtaaattgcatgtaggaaaaaatttactttgctgatggtttttggaaagcaagttttgcaaggctgtattctaaagcagaattaagcaaaagcttcttcttcttcttcttcttttttttaatctcatttgaaatcctgatgcaggtttctcagtggggtgccctaaattaaactcctggaaggtagtccctgacaaccgctgaaagaaaataccttttggctcttagtgtgttgtaatcctgttttcaaagtactatatttaagaggaaaagggcataaagaagtgatgacggaaaattagtccataaaataccgtgtgttgcagttccattactacattatacttcatttttaactgtaatgtttctgaataacccaaacaagctgggcagtgggcagttccctctctcctagcactctctcttccctgttggaatagggcagagttgaggtggagggcaccatttctataagcagtgtatgacatgtgtctcacatcatctctgcatatatgcacacagtgaaacactgggtgggtgataacctagtgccgatagggcagggagagtggagggagggaacctaaggcttggtgactactagaagccagggaatctctttcctgggcgctttcttcaaagcagatttgttctcatcaggttctaattaatatatctagaggctcttgatatcaaactgtacatttcactaacatttgagtgtttactctttctcagggcttgggaatcagaaacgcaaaagctcacagacagacaaactagcaaaagctcacagacaaactagtaaacagataaattgcaagaagaaaagtaaataacagaggtaagaacaaactgttgaagaagtagagagcatagcacactagctctgttaatgggagccggggaaagctttatgaaggagattcctttttcactaagttttaaaggttcaataggagtttgctagtaaagaagaatgggaaaggaggaaagaaaaatgaagagaaagggcattcaaggccaacaggaaggattaaaggtatggaatcttgaaagatcccttggctcagaaaagtctttaaaattcagcagatgtttctgcttcaaaatcatatttaatttgagctttagatccacaggaaataatcataagcctgtagataaagggtaggctcatattggatacactcatctgtgcaaaaattatgagatgcttgtttctcggttcatatttaattttaagtgtactgtcatcccgtgtctctctaggacataaatgtgaacatacagggcctctcttttggcatttatttctttagcagagagggcaaatccagaatttagcttcacccttcacatcttcttctcccagcagcttgaggaaaggaatagaggaggtgagcatgggctttggaggacactttctgtgtggcctttgacaagtcatctaatttctttgagtctcagttttcttatctgtagaatggagatggttttattcatttgttgtgaagattaaataaggattggaacatcgcaagtgcccaatggaagttacttgtggtaatgatcataatgaaagtgacaacagtgtggataaagaagagacgggccaggcacagtggctcacgcctgtaatcacagcactttgggaggccgaggtgggcagatcatgaggtcaagacatccagaccatcctggccaacatggtgaaaccccgtctctactaaaaatacaaaaattaactgggcgtggtggcacgcgcctgtaatcctagctactcgggaggctgaagcaggagaatcgcttgaaccagggaggtggaggttgcggtgagccaaggttgcgccactgcactccagcccggcaacagagctagtaggactccatctcaaaaaaaaaaaaaaaaaaaaaaggaggggacggtgttctagagatagagaactggttactgaaaacacctacgaactatagaaatttgcatatgtaaatgtatatatgtatccgactataggcaaaaacattaagttcatctacaaatatatttcaataattgtgcacaaattgaagtattttaaatagtgacaatttaatttacataaatttaggtttaaaatagcatataacacatataagtatctttatattcataagtatacctacttcctggaaatgggttgtctggaagatatcaatattgatatctgtctacctatgtttgtgtatatataaaattagtgaacttacattgtgcaaaatgaaaatgttaatgaatatggtaaatttttattgctacaaaaagagacagaaaaaaagtcttgttcctccagatgagctatcattctttatttccttgacatatattttgtatgaacatatttaactattaaacctggtctagaactagggagaaatgagaattaaataatgtaccacaagttccctaaaagaagtaccagtactgttaaccaaatacatattaatttgtcttatttctctgaagagacatggctgagaggtcagttttaggtgtttgtttgacagtgtgccaaatgtcgcagaagcattattctattatttaaaaagtgactttaaaggatgtgaatatatcgttgtaatcacagttctatgaagtttttaatagtactgcacagtgatgacatcaaagcccatgagatcctacttcatggacagtaggctcaaatattggtagcatctctggactctgagggtcagtccggtgctctccatgtcagagtcttcacttggactgtgttaaaccagttatgaaaattctgagtctcaaatataattaaagctcttgcaggaactggctgacttctggagaagagttagcacatttctatttgaagccaacttggaccaggtctagctcagtcccaaccccagggtcccagaactaatctgttctctgtgcttagaccttttcctatagaatcaagcattgtttggatctgccattgataacagtgttcagacaaggtgatgctttgaaaagtaaaagataatttacagtgttaatgtgagaataccagtggtggtagcactgacttgaagttgccatgcctggactccaatttatccttgaccatgtgtagctgtggcatcttgggcaaggatttaatctcctggcttcagtttcctcaatggtaaatgtcagttttggcagggatggggtaagtagaagaagttggactaggactgtcttggttgttgcaatgtttttctgataagacaaggagaaagaaggccacatccctgtggtatcagactcatcatagcacatcatcactgcttttatcattttttcattccaaatcatgtgcttgatattcaaaataaagatttttggctaaatggaataaagcaatatgccaaaagatgaatctttttgcctggatggttgactttttcctttctttttgagatagggtcttactccgctgcccaggcgagagtgcagtggtgcaatcactgcccactgcagcctcgaactcttgggatcaagccatcctcccacctcaatctgcggtgctcaccaccatgcctggctaattttttgtagagagagggtctcactatgttgcccaggttggtctcaaactcccaagctctagcaatcctcccaaacaggcctctcaaagtgctgggattacaggcatgagccaccatgccaagcctgcctaggtagtttttatgaccatgaattttatgaatgagaattttcttttcttttttttaagctttttttaaatctttttgtaatcccaggtgcacatatattttgtatgaacatatttaactattaagcctggtctagaacttagaatttagaatcaattctagaactagaatttagaatcaatcatctgaggatcctctcatagtgtgccgacgtccttccttgattcagtggatacacaactatggatatggatatttgcctacacccagatgccgatggtatcccaggatttagcttcctgcagttagacactctcattattgctcttttaagtaggtgtatgctggagctacctaccagagcaatgttgtgttctgagcataatctgctcagctaaggaaagcatgcgtgacttccttgagagcataggtgtaaatccagctagagatgctctcaaaatgcttcagagtcttaagacagaaggaggacccagggattagattcaggccttcagacagcaacaaaggaggacagcaaaccaaggggatgttctctgtgctttatggcagtggttctcgagctagagtgggcatcagacccacctgcagggatgattaacagggccccacacctagagtttcagattcagtaggtctcagctaagactgagaatttgcatttctcacaattttttagctagtgccaatgcacagagccaatgttctatagcttctttctttctgtttaacccttactaccagaagactaggatggggatttagaacaccatggctttcccacagtgaataaggcccaggccagattgcagttactcactgtggctgctaacctcattcatgggagtaaagtaggattttaattacctacctgttcctgaggctgcatctcatttcaatttagataatctagtcagtggcttcccaaagccagttaaagcatcagtgatactctgattgcataagcaaacccaaggaattgttgaaattacaaattcctttttcccgccctaggacattttgaatcagtaggtctgggatgaggcctggggacctgtgtttttaacaatctcctctgatcatttaatccacttccgatttatctgtccacaggccttgagtcttcctttccatggtcacacacaatatgtttcactaatgcacatttattttgagtatgtttacccaaaacttagactatgcccttggtcaagggattagcaacctttcaaaagaagcatgcccagtatttctttatatagcctttcatcatcagaggtggcaatgctgatggaatggcctttggtttagctctgcaaaaaagccctgtgggtactcagctcttcaaagaagctctgttcctggcatgtttagaagttactgtgtgcacatacgtaacccactcagctgttccagaggaacaagaccttcaccctttaggtatatagtgtgtgcagttgccccaccgtgggggttggcaaaaagtggggagggcccttgcataagctcattgataagttcagtcatttactcacccaaccaacaatcactggttatgtgttctgagtcaggcatggaggtatcttctcataatcaaaagataagcaagaaacagttaactgcccgcaaggattccacaattttgaatcctaacttcagatgctatctccttacctcatttggcacgtgcatttgtgctggtatacatacctttttcagcacataaactcatttggcacatgtgccaaggattgccaactatcttatacacacaaccacacacacacacacacacatacacagccttaaaacaaaaaaaaaaaaacaccaatatccatgttgagttactaactctagcatcagctgcaaaattttattttaggttgcagttcacgcagttgtctttcaaaaattttcgttatgctgttgttagttctctgtgctggatttggtccacagtccattggaggaaaaaacaattgtatttattgttgtgtttgggagaggaaaattcctctttttatagaggtataaacatatattagtttaaaattttgtgtctagtatgtagtcattaatacaaaactagacacattattgtttataattatttgttacactggatctaaattcaaatattttacatttatatacaacgggttgctttatattaaaatttatgtgatgctcctgtcttctccagtttaagtcagtcatcaaaggatgctcaatctagctatattttttcttgcactaaatatagtgaatcataaagttcgaaggtgttaccagccctctttgcttttaagaaagaaaagatgcactgtggaaatgctgtctctcatttttaaggtcattgattgggttaaaaaggcaaatgacttttttcattgaacttccttcaattaagccattaaccttttaaaataagtgcattcaaaaatctatcaaaaaaagctaaatgagattttaacaaaatcctgacaatttcagcttaaacatatacacagaaaccatatgtgcttagaaagaaatatatacacacaggcattgtttacagagtgtgtttttatatttggaagacactgaaggaagagttattccatacatacattatctgaaatgtacattcagatagcctacatagatttcatattacacacaaagatatctttatccatggtaggtagacagacagactgactgacttcaaacttgcacttgcagtgtggattttttttcctcatctccgggtactgcttttcaaaattgcctcaggctacagaacagcacctcagatccccaaggcccactgcctggctcctaatagccactctccatctgtgtcacatgaacagctgatgagatcgctccagtgtctgtattttggagagcacatccacccaggttaaaatgctagggttgccaaggagcagtcagaagccattagtgtgggtgagaatttgccttgcagcagttccttggcatggtggaaagcgtgtgcacgtgtccctgcacgagcttgggtgtgcgtgtatgtgtgtgtgtctccttgtccaggcgacactccggtgtacatgggtgtgcagggagggtgacagatgaaaactagactgtatattatccagtattgaaagagtcaaatgccttttgtttcactgtatactgattcggtctttgactatatggggtcccttttttcttatcataacagaaggcaaagaaaaagagaacagcaacttcggggtcatgctctagtgtttgggcagatggaagggagctgctttgccttggggcagggtggttgtaatgaagtggcctgtcagtctgtaaatagtgagggtcatctcttccatgtgatggagggtatcgcattgcagtgaaaatggaaatgtcaataaaattaatctgccagctctttgctgtggcttttctgcttctctagtcaaagaaagttgagggttttttggcaagaaaggaaaagaacaggtacagggaagcccacagagcagacccagaagttagaaggcaagtggcccagtgggcaggatggctgtgctgtagcatagtccgagaggagggagcaggtctgggaatgagctgatggatctctagtattcctcagaaagctacagagcatccagctcaggctacattgagcacagagtttattgttttaggctttcttggacaaggtttttacttagcatgggatttatggcatttactgctaatgaatgtctattcttaaattacaaaaacccccatctcagtgcaattcccagatgtccttccaggaccctggcttcttaaacaccagcagggagcataaactctccacttctctgttttcctctttcgtgtggctccaggctaatgatgtgcaaggaaaacacagccatctataaagccccagtgctgtccccgtattcttcatttattttgcatttgattatgccacaagtcggatcttgtttctttcctttttttaaagttattagttcaaatattaatgtagggatatggcatatattgctgctcttgattgatgccttcccaaaaacaggaagacgtgctcgtatgaattttaagaaagtaggggtcctgcaatgccttgccagaagagtttttcagatacataatttagatgccctccaggcaggctttcaaggcatttttgccagagggcaagaaaaaataactatgactgttaaaagtaaatgatttttgctaatgcacaattaatgccagagaaaagcacagaagagaaagatgttgatagaaacttctgattaagtgagcaccctaccttgatgtgtatctttttttttttcatgataatgatcagtggtgcagagagctaaaagttttcatgtcatgcaaatgccgagtgcagggtcatatgagaagtgtgcgaatgtgcgtgcttaggaggtgacagctctaggaggggctgagcaggcagtgcgttatgtgcaacgaacagtgacacagttactgtcacctatgcaggcagcctagaatatatagactacagaacatttaacttgattaccctacagtatgtgttcactctgggcatggggatgcgtttccactgaataggttttctgatggcggttttcccacattggattccataattgacaaagagctactgcactgtgtcaagtgcacagttataattgaattaatgatatgggcaagtgtgagacacacaaaattaacatttgaagaggcctggtttaattttgtcttttacatatttgtgtctccaattatactttaatgaaagagaatatactcgcttaatggatttctttcaacaagcttagctgagctcatcattagctgcacttgttgttggcaccttgcgatgttttctctaatgtatttttatttctttctactaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacagtaagtcaagatgaaagagaaaaaaaaaatagtttttgttgttttgctagcaagttatacggtctcatactgatttttttttaaactaaggtgcctattttcttattcttgaaatctgatgactaacagactagttaaagttttttttttcatcaactattaccatccaaagagcaccctctagaaagtagcaggtttttgttttaagaagctgggaatggactttatttaaaatgatctaagaccctaaacagcatatataagtaaatttgttatttatgctaaaagtatgagagcaacttcggatactgcaacagcaaccaagggaaatggctgtaaggagctcacaaatccataaacgttgctgattacactgttaacgaaagctgtctcctctaggaggccaaaaaaaaaaaaaaaaaagcaccttgccacatgcatgtccaagctcacaatatcaggtgcagctttaattgctgaagcagtttacaaatatgtcatgtatttatatgacaaattcagaagggttataggtgctgtaatgcctttgtttgcaaggtggacattaaagattctttttttagctgctcaagtccattatcttaaaagctaaccatgttcacttctggaaacggttttactatgtgagacattttaaaagtaacaatttatctttatcttcctgtttgcaatccttgtatgtgtggatacatactgttgactctaagactcttatgacaaaaaaattacaatatatttttacagataaactaggcatgcttatattttactgttcatttggaaattctgggaaaccagtaaaaatttcagaggttgcttcttgctataatattgttttcaggccattctatttaggctaatacttaaaaatagagtagcacattgaaagctgaaggtcttctttgattatccaacttgtgtgttgccatgctgaatgacattagttacagtgtcatgggtccaggacaaggttccacttttatttatggtggtggctgctgatgggctcttcttgcagagctacaaagggcaaggggtggagcagtggtggggagggaaaagtgatagattcacattcctaaatcggccattttgatgtaaggacattagtagcaaactaaggtgtatcgatctggcctgtggtgtcaggattagctgggagaaccaatgaggcagctgtggtagtggttattcttgccttgcagctatggccatttcaaaggtcagggccctgcactgactcggctcagaggaattagacagaacatgcggtctctggactgattacttaaccaaagacaaaataatgagtcctaagcaaatactgactaattgaaagggctgtaaatccattacatattggtcagggataatcaggagtatttaatcacttttatctattcaggagcactgaagctgcaacagcaaagccctgaaccttgccatgtggttattattctcatcattatcaaaattacttcacagctgttctttgctacatcacctcagctggagatttactaacctgtaaaatgtttttaatttggaagtcgagtgactgtgaggggaggggtttctcatttttaaatgaaggtttgtttggttagagtagcaactaagaacggcagtgtagctgcggatgacaggccagctgccttctcctgaccagctcacctgtttggttccctccctctgtcctcctccatgcttggtctttcttggtcgaaaataaacacttcaacagctgctttccaagcaaacagctacgtgtgttttcaacctctctgtcatcaaaaccaatgtcagagaacagtagaaccttagagaatgcagctgctctgtttatagatgaggaaacagagacccaaaaagggaagttactagctgaaggtcaagctgagacaagggcccgagacttccaagtccccaactctgtgatttttccacattacaatgactttgccaaaatgacgatcacctttaacagttgcatagaaatctcacagtctccaccatcaatacgctcagagtcacaagggagaaatacggagaagccaagtgctgttttcttttcttgttttgaaagctccgtgttacccaatatagaaagccttaccacctgtattttgtgagttgaatctcacatgggagtgtcaggagcccttaataccttatctcccacctccctgcccagggcggcacccagcatgcaccatggccaccgattagagttgtgggtggctggtgatttctgggcacttgttgtacctctgctgtgctacgaactaacagtaagagcttgtagtcacctcaagaatgctttcatctagttgaatgtatgcaaggctttgtgcagaattctctgtccgactcaaatttttaatgactgcctgtcctccaggttgggagagaggactcaaatagcctaagctgggggagttgggaagtctgcattcatgctctgtgatcctctgtactggctgaacctcagttaagtccattaagttccctggactttctgtttccccatttttcaaatgagagggacacgttgcaggatggataagctcctttcccatgctcctaggttttggttctgctcaaggacatttagtcagagcaatgcccggtcccagcctcatgggtcattctttcctctctttccccctttctctttgcttttgcttttcactaactgctttatttctctcctgaccttcttcacaacatgcccctttcattactttctcccactagctttgtctcccatctttctctctgtgccgctcctctgccttttctgcacctcccttgtagctttaggaaattctcctctgcttgctctttgaaaatgttttccttcttcatccacacttcaccccactgcagagaagaggttcagtaactttgatgaggatggtcctgtaaaacttttactttccaatctttaatgagctgaaagatttactcagctgtaattctgagctcagaaaccaagaatagagacccctaactagcgacatgttaatttagatttcttttcttacatgcactaacaggcatgaggaagtccttggaactagagatgccccactatatttttctgtcatttaattaatttcgactttcaaagtgaaatgttggctctagctcactgaaagtagatgcagtctaaattattatttcatgtaaatttctttacaagtgcatgattcaatatgcatttctccattattagtctctttaacattatttcaaactggtttgttcccttttgtgcagtgtgacctgttcttgtattacaataatccccgatgtacccttttttctttcttttttaaaaaagaagctaattgaattatctcattattttaatttgttaagcaaatgtattttgcatctcaggatgtgttcttaaagaagggggctgccaaggctttgccccctgaatgggccattggcccattttgacattcatgcattcattaactagcagaacataaaagaactctggttgtattttttttttccaaacacccaaccagcgtggagcaacttttcccaataagccacaggggtctttctacatatgttctcaactgcaagctattgtcacctattctgaatacctcaaaaggcccagaggtggaaaaaaacctacctcaacaaaggccaactgtagcaattgttaagtcttagtctcaatatgacaaaaatcattcaccctcagttttcttggaagaacaagttccactccaactgtaacagttaaaacaatctctcaaattcctttgcaccaccaacttcagggggaaaggtaacaaacttgcactaattgattacgctgaggaaaatatttaaacaaagtccaaagtggcatttaaaaaatcaagtgatttgataaaccgtttccatagtcagaattaagcattctgaatttgcttaatctggggctaaatattaataattagcctcaatttttttgtttcgaactaccctattttcaaaatgccccttacaaatatcccctctaaaaaaattcacaataattttaacagaataaatctatctatatatttttagaaattcaactagcaaaaactttctgtataccattaccctcttccgttggttgatggcactgcctaacttctcaagctaagaaatccagtgatgattgaagaaagaatctcttggaaatgtgtgtgcctttgctggaaagtacccaatggcaaaacaaacaaacaaacagacaaaaacttagggaaatcctagagaagtacattccttttgctagcacatggagactatgatatcataaaagtaagcctgccattacaactgtttttatttgacttcaaagataaagaaagaaacagcaagcaataatacccaggctgacgtgaaaaaactcctccacgccaagaagcccttaatgtgctcaattaggccctcgggcacctccacttgccaccttcaagagctcctccagttgtgctgcaaataatatatttgatcatggactagaaacaggaagtgctcatacacaaagacactacttgctcataccagtttctggctgaaggtcttcttatttgaaaacatagggataaagctcacacttagcagatgtgggacttctttcaaagatgtgtgttacagaatcagaagcaaattttacttttaaaagtgatataagccaagtggggaggatcgcttggggctaggagtttgacaccagcctgggcaacataatgagatcccatctctacaaaagaataaaaatttagccgggtgtggtgcacacatgcctgtggtccctgctactcagtaggccaaggtgggaagatcatttgagcccaggagtttgaggctgcagtgagctaggatggaaccactgtactccagcctaagcaacggaatgaaacccagacacacacacacacacacacacacacacacacacacacacacacaaagtgatgtaatattatgtatgcagctgccttgaaactacagattctaaaacctctgccttttgttcatgacaaaatgctttgtcccctcttcatatctctgggggttggggagaggggtgaagcccacctctcaggtgtttactcattttactacttgcctattagaatctgacttatgggattttgtcaaggcctgggtttggtaataaaaatgtgctataaaggatatcatcctacagagacagtgcacccaagttataagtatattcagttccatgtgatgttagagaaacctgtctctccaccgagttcatcaagaccatatgaccgtaaacttagtcatcttaaatttgttattgtaatgtacacacacacacacacacacacacacatatgcaagggaggagagagggagggaaggagaaagagaaacagaaacagagagacttagactattttgccctttgactagttatctttatcttgtgcagatccagatggcttctttcttaaatgaggcagtccaatgtcgaggttaagagcacagggcctggaatctgcaacacagtagatttttgatcttgagccattaccctctctgcgcctcatttttcatatctgcagaagaagaataattctagttccacctggtaaggttattttaaggattaagtgaaataatgtaaagtactcagccctgtgcctgattcttataataagtacatatataaagtaactataatttttattttaatccagttaaatggctagcagaaggctttgaccaatggacctgggcatccaaagttaccacatttgttcctgggattgtagagatgtagagaccaggttttgccaaacaaatcccaaatatggccggtgcagtggcttatgcctttaaccccaacactttgggaggctgaggtgggaggaatgcctgaagctcaggagtttgagaccagcctgggcaacacagcaagaccccatctctataatttttttttaattggctgggcatggtggtgcatgcctgtggtcctggctgcttggcagtatgaggtggagcccaggagtcaaaggctgcatggagccatgatcacggcactgtactccaggctgggtgacaaagtgagaccctgtctcaaagaaaaaataataataataataataatatccaggctgggggcgatgactcacgcctgtaatcctagcactttgggaggccaaggggggtggattgcttgaggccaggagttcaagaccagcctgggcaacatggtgaaacctcgtctctactaaaaatacaaaaattagccaggtgtgtgggcacacatctatagtcccagctactggggaggctgaggcacaagaattgcttgagcccgggaggtagaggttgcagtgagtggagactgtgccactgcactccagcctaaaaaaaagaaaaaaaaatggaaatacccctcagtaggagagaacatggtctacattctgccttccgaaatccatattaacatttggtggctgcttgttgaagctaggtgatagcattagagagtcctggtgtcatgaaagccagagcatcctagtgaactttcagggatggggtggaaggtggagaagaaatgggctatggagtagttcagaatgtctccaatggggctacttttgagagagaatgctctctttcaccatttgtcttccaggatatgaacagaatatagagttgctatcttccttagagtgtgaaagtctaggctgtctgcaagacagcatgttatggtttttattattttttattgattgattgattgtagagacggcatctcgctgtgttgcccaggctggtctcaaactcgtggcctcaactgatcttcccacctcagcctcccagagtgctgggattatgggtgtgaaccacagcacttggccatggtaatggtttttaaaaaagggatcaccagctgtgaacttggaagccttaggtgtgaactctgtgatattattcaacctctctgaacctatttcttaccatcaaaatgaaagttatctgccctatttagctgattgggttgctgtgtggctcaaatgatgcagtcaatttgtaaactgtaacgtgctgcacagatgttaggtattctggtcttctgattgtgtgcttggctttctagctgcttgaagccgctcagagcttatgtatcaccaagggttagagatgtagtgctacccacctctttcatcctgcacccccaatttctccacttgtccatttccacaaatgtatccctggagacactgtgataatttctatcattagacatcttttaaggatcttgaatggttaattgaaccagtatttcatggacattagttatttctgcttggaaattagggccttcatgattctgagactggtctacataatacaaatagctatgagccaaattaataccaaataggaaatgttgaccttagttatacagtaagagatggtctttctcatattcagagctgcaaatgttcacatgcatgcaagtgagtctcctaagaaatacttatgtggaaatgcacatgcagaacacacagctgaaagtaccagcagagagagcttcccacaaacatgcagcatagtggggccgcccctagccttagcctttgcattgttttcctgcttgccaggagaaaacatctgtgaattatttgaatggaatcttatactagagatcgtctgaactggtgtcatctctgtttaatttcaggaaatgatgtcacaatgcattaaattacaatgctgggtgatttattttcccgtggacatgctgtcctaagcattcctcttcttttgcaatgtttccaattaactgtaagcttgagtgttcttcctatttcataatgattttgaggggtggggatgggagataggggtgggcagaagggtaatttcagaggttgctgaggttcagagctaatggcacatccgtcatgtccttattgggatgggagggtgctgagtgctggggctgtgatcagcagtggcaacctgcaacagtattggttagttttaaagaatgtctaaaaatgaaagcctgagtgttctgatgctagctgtccaaagagccaccagataattttaatagtgacctgcatactgtagcttctgcctttatcaaagtttctcttcactcccttcttcagtaaagaatagaggacataagtcaattctgtgtgccatctgttgtcgtttttacaatttctcaaattaaagagacaggccaaaaatttaatgtcgtgttggatcctagaagctcctctagaagagagaaaattgcaactgaatttactttgtctctcttgagggggaaaaattgcatattgctatgtcataaccttttacttgtagtcccaatttggtgttttgaattggattatgagggcttctgcatggaaagactgatgtgtttgggattcagcagcctttgttcacatggttctgagtgacattgtggtaaagttgccagtacagtggtggtgcaatggcttttcatgggggtaatgaaatgcatagtctcctcaatgcaaaaacattttaagacgtttcaagatatttcaaattacatcagacaatcctgtttaaaaagaggttcacctcagatagactgagaaacttacctcccagattatgagctactaactggcagatacattttaaaaataggtaattgataggcagaacacagagtttttagggcagccaaactgctctggatgatactacaatggtggatacgtgtcattatacatttgtccaaacccatagaatgtacaacaccaagagtgatccctaatggaaagtatggactctgggtgattatgatgtgtcaatgtaggttcatcagttgtgacaaatgtgctactccggtagggggtgttgataatggggaggctatacatgtgtggggccagggatttatgggaaatctctgtaccttcctctcagttttgctttgaggaacctaaaactgatctaaaaaaataaagtctacttaaaaaaaaaaggaattgaatgaaaagattgaagaatgaaaggcttattaaattaccatcaaaaagaaaccaaaataattattagctcaaagtttagcacccaatttcataaaatatcactcgaagtataattgtttaaaaatatgttaaagaattcaaggagatggggaattgaggacccttgaataaaggaacatagaaggcatgtgcatattgaatattcagctatttaaaaactccaagaatagagtgccattaaatgctatttagtgaaatccctgaatattcattcagatcatagggaaaatttccatttcttcgttccacatgaccacagtttgcaagtgtattccatggagaagtggagtgattgggaattacagggtaagttgactgggttatgagaatactgactgtccctcagctttgctgcaggatagggtcataaagtgaccctaacattcaagactaatttcgattttagaaagtgttactgcacagatttcagaggactcctggaaatgtcctgccttctccatgctgtagtctgtttttgcaatttggaacagattatgaagtgtaaagatgatatccagccccatttctcctgttaagaaatagtgacttaggtaggaagcattagggtggttgaatggagtttgccttattacatttaggtgctgtgtgccactttctaaattgattggcagcagttgtttacagtatgcagaataatcactggcaccctttaaaggtgtattatcctcttaaaacataatagtaatgccattttcatgcttttacatttgctattcatattctgaactgccaagtcccaaatctgccagaacaaatttaagttgtttttatctaatagtggataagttgtcaagtcacaatataatggcagataatttttcttaaactatagttttacttcttggttataatagataacatgaatatttgttgaatctgacttgattgtccacacacacaaaaattacaactcaagagatattgtcatgggattctgcgatgacaagaaatgaagagaatattattatctagttattctgagcattatagaaaattaacatgggccactaattagtttccttccagccaccactctccccccgccaaatctgctgatatctggtttgcctgacatagccagataatgaagatctcctcttgttaatcccagcatcaaatcttgttgctgctgttaatttaaatacctctgttatcacattataatataactgtctagattttatttgacttcttgcatcattctcctgcaatcacaaatattccagaattaattttgtcttggaaatatttggcaattctataataatttggaaaagtatattcccatgactcaggccacactagaattggaaaatggcttttttcttacccagaatacatggtgtgatcccatcgtacgctgacaaaaaacaacccaagtgtaccggggtggtgctacactagtcttttaaaaagaaaaaggcttttatcaatagaaaagatgaatgctagattattccctgtagatttggtgacacattgggactctctttaaaagcaaccttattttttttccccatggtgaaaagttataggttctatttcagtgtttcaagatacctgcaggcagctcatgagttgctatacttgttttaaacccttcctcacagtgattttttttttaaagtagtaagagaacatgggaacatggggtcattattattcaattataggctcagtttttctgttagtttctgtgaagccataaatttagaactgtgtagcaaaatctcatggattacctgatggcactttgataaaaacccctcttagagcttagacctgaaggttttatgttttctagtaaaacacttaaatgtaattaaatatgatcgtgtgaaaaggcattagtttttaatatgacctttgttgtcagtctggaaatcctctaaaatttttgattttttttttttttttgcagagcaagtttgacagaaaaatgatttcatgctctttggtccttatgtacttgtacccgtttgtccatggctattccaaatacccccatgcttatttaaaatgtatatataatcagttacataaaaagaggtatgcttaaattctcatgactctatggttggacctctgtggttggagcagacaatagaaatgtctgtaattcatttaaaaaaaaaagtgactttcctacctttagatagtgaggacaatctgttaactctttgtgttgataaaagcaaacatttcagggcacggtgaaagaaatctctaccatgtataaggttatatatataccagaagcagtggagttaggaccaaattaagatttgaccagtgtcctagtcttagcacagccttttgctccctggattattttgagcaagttatttaatttatctgagtgctcgttttcttacctcattgttttgagggttagctaagattagaaatagccttctgagaaggacaaaatactgtgcaagtgtaaactggtgtctattaatgttttcatataatccattgaaatagtttgctctgtcatagctccatgaaacctgaacttggatgtgagtgacacactcttcaaagacaagtattgcacttgtttcttttgccctaagtctggaatggggatcaaatcctacacatagcacatgtgcaagagaaaggcaaaagacctgacagaccattcatatgtggcagcatgagtcaaagtaacttttggaatttgtacactcaaacttaagagaaagaactggaagactgcaaactaacttcacaataaacgtattgtcacttgtgttattacagctttggagcaagctggttggggctttgggcatctttgttctttgttcctaaactcttcatcctgagaattaactgtccatcagcatgccatttttcatcctggtcaagctggtggagaagaattgttttacatctctaaatggcgatctcataggcccattccaaggaaggcaaagtctggtactagacagaattgtctcattgcagcaagtgataagtggaattttatttttcccctgaagacagtttcaatctggatgcttaatcaggctttctttgattctacatacagagatttcagatgttacagctcagttagacgaaagcacagaatatgaatgggagaagagtgaggaaagcttctaaaggtatatagaggccttaggtttagacgcaccagccagatatccaggtggatgaacttctgtggaagctgaaaatggtggcactatagtttgagagttggagctaatctttgtagaggtaatacttgaaaccatggcactgaataaaggttaaaataagagacagtgcagagagagaacggggtttgagtctttttgaagactatatgtgaagaggtggagaaagaaagtagtgagcagagataaagacatcagaccagtaggagcataatcagatcatgtgaagaggaaaggagtttcaaagtagaggaagtggattctgtagaaagatcaaggacaggacaggcgcagtggctcacacctgtaatcccagcactttgggaggccgaggcgggtggatcacctgacatcaggagttcaagaccaacctggccaacatagtgaaactccatctctactaaaaatacaaaaattagctgggtgcctataatcccagctaatcgggaggctgaggccggagaattgcttgaaccctgggggcggaggttgcagtgagctgagtgccactgcactccagcctgggcaacaaaacaaaactccatcaaaaaaaaaaaaaaaaaaaaaagagagagaaaaggaggccagtgaagatggggaccaaagcacacctgggaaggtactaagaaacaaacattttgtaaagatagcaagaaagctgagggaggtcaggaaaaagcttctcttcacttatgactaggaactgtggcgagggtgatggagagtgaattaggaaggcacggaaatgcagacttggagcaaaaagggccgggctgaatggactctctccacatcatctcatcctttctcaggcagtctcagcaccaaagagcaagagggactaaagcagacaacaggaaaaacctaagggtgagatcaacaaggggaggagagggaagatgttagagcagtttttgaaatgacagaccagtaagtaagaattccaatgagataatctttcctgggacagaaaaataatcctacagttcatgtgaataataaaacaactaagaaaagtcaagatatttttggaaaagaaaaatgagggagcttgtgcactgagaattactaaaatgtatcataaagctacatgacgtggcactggctgacacaataggcacaatgatcatttgaacaaaataggaattcacaaatcaacccaaatatagaaagaaatttactaattttaaaggcatcacttcaagtcagttgagaaaaaaatcatcagtagtcttcatcaaaatatacatttaagagttttttgaagtagacatgactatttctctttccttcgtttaatgaaatgttttgagagtaaaagcaaaggaattataaagaaaaactgtgatagattaaattacatacatttgaaaattaagagcttttgaatgccaagaaaacagcatatacaaaataaagaaaaacactaaactagcaaaaatatgtaacattatataacaggcaaaggattagtgtccctaataaataaagcattgtacaaatcagtaagaaaaaaattgaagcaggctgggcacagtggaccacgcctgtaatcccagcactttgggaggccgaggagggtgtatcacgaggtcaagagttcaagaccagcctggccaagatggtgaaaccccgtctctactaaaaatacaaaaattagccgggtgttctggcaggcgcctgtagtcccagctactcgggaggctgaggcaggagaattgcttgaattgcttgaattgctccctcctgggagacgaggttgcagtgagctgagcttgcgccactgcactccaacctgggcgacagagcaagactctgtctcaaaaaaaagaaaaaacaatgaagtgaataaaaagtcaaaagatgaataggtccattcacaaaagctgaaatacaaatgactggtaagcatttaaaaaatgttcagcattggcctggtgtggtggctcatgcctgtaatcccagcactttgggagacagaggtgggaggatctcttgagttcaggatttcaagaccagcctggggaacatagtgacactccatctctacaaaaaaataaaaataagttaaataaattagctgggtgtgctggtgtgcacctttagttccagccacttgtgaggccaaggttgggaccaaataaatttaaaaatcaacaacaagagatttttatttggtggaaactgagaataaaaaattataatatctggcactgtccagggtagaaggaaatatctaacttaataatgactataaaagttgacatggtctttctggaatataaactagtaatatgtgttaaaaaaagaaaacaactaaaaattttctcttctttgatctagtaattccatttctaggagtttgtcatgaagaaataattctaaaagtacacaaaaattatgcaaaattatgtataaagatatttattataataaaaaattgaaagtcacctatattctcaaatgtaggagatatggaatgttatggagcgttatggactactgtgtaaccattaaaaattatattccaaaagtattttgagataaggggaaatctctatgtgttgctaggcaaagtaaaccgggtaaggcagtatttatgatataattttaattttattagagaaaatatatatggacatatgcacagaacatatgaatgattatccttgggtagggagatctaggtgacatttttactttttatattagaaagtttctatgtaatgtgtattgcattgataatacagaataataaattttattttaataaagaaccatgttggctaagggggagaaataaagtgtggtaacacactgggaacactggaaacccaccaaggggttgcaagtccaggtgcagaataagagagagaaacagagaagcagagaaagaacatttttaggtttgtaatcttggaggtgcaacatctctgtttgatgaattttctgctgataaagtagagatggataacattggaaatgagacaggcaagatattagacaggcctttgtcatacatattggagttttcaaaagtaggggcaagccatgggatggagaactttctagcatgtacataagtcgtaggggaaagagggagtggcttaaaagtcaacattcttctctcaacaactgtgaagaggaaagaaagcaaatgctgtgagcttcatgagaaaagtggctggaaagtcttaggtaggggctgggagcaggcaataagggaagaaagggaagagagaacagtctagtttcttgtccttaattccagaggtactggtaaggaggaaaaatgaataattttagtagaagagtatattagttagctagggctgccataacaaaataccatagcctgggtggcttaaacaacagacatttattttctcacagttctggaggctggaaagtccaagagccaggtgcagcagggttattgttgggtgagggctctctcctggtttgcagacagccaccttctccctgtccctgcataacatttcctctgacttcatttaaccttaattacctcctaaaagccctatctccaaataggtatcatatggaggctggggtttcaacacacaaaatttgggaggacttaattcagttcagagcagagtttttagcttaacaatattttaggacaaacataagtttaaaaaaaaatcaaggatatggaattatgtgtatggaaaagttcaaaggtttatgggtttttttttcccccataacacagccagtgaggatgagggcaacgaggcaagttaatttaggttgtggtgagattaaaaaaaaaaaaaaagaccagaatgccaagagtaatgccattaggattacaggtctttgctagacccaggcactaataaagctctctaaaatactatcttatcttggagtagagaacctgagataaagatccctcaaatgtttcctcaaagcacctggatggaggcaggaaagaggagcaaagaaggcgtggggaggactattcggttggctaaaataagccacaaattgagttcttattttgattatgtgtaaggtttgtttgatctagctgcttttccttagagttcagttttacatatgcttcggcgcccaaccagcttgtgtattttcaggatttttttcctctctttcttttccttctttggttgggttttagatcagggagggtaaggactgagggaagcgaggtcagcagacgagactcatttcccggtttgtcagactgtgctcttgacccctcctcaggacctgtgattaatacacgctttgtagaggagacttggcaaaccccgctctccacaggacccgattcataattcacagcgagcaggaggagcagggtctttgtggtggcttgttggctctttgctgcacaaaaagcaatgccttctgaccttcgctgttatctaatcaggaagtagacagtcctggcgtgtagctgagtcctcgtagggctctctacaactgtaaattatgttcgagctccccggatctggggcatgccacactttacattactattgtgtatcttaaaataaacagcatcgcaagctgtttattttggtgttactatgtatgcaattttaaaacagtggttacttaaacaaatgtctctgttcccacagcacttgaaagccagtgcttgctcctgtggttttggattttgtcacttctgtttggattatatttgaaatccacactgtgagcagttggaatgaacctggcagcacctaagaccagggcctgctgttgggccctgcgtttcaccatgtgcagctctcttcctccccacactatgctctccctaccctctacgggccatatgcatgtgcacaaaccagatattttgctttctctttggggctctaaatttatccccatgagtgatctagagagtcatttactttaagttcctgaatgctttgcaatttaattgaagaagtggtgtcgtcatgattctatagcaaaatactactcccaaatactcatttaaattgtcatctgtgcactacagatacaatgcatattccattgacatagcttggtgaagatgaatgagaaagcacaggggtggtagacaaaaagaatgtaaaaatatcaaagttttgacagtgacttgccccatgaccttcagttcttatgcctcttctacacaaggggtgaaacagaaaggtagaaattcttagtagctcatgcaatacttgtgctcagatcgactttggtttgattcacaggaggctacttactagtgctgtttatttggatgagttatttaacatctttaactcttcatctgtaaaatgggtcagattgtcagggtggggtggaactgaaaaaaatagaatatgtaaaacagtctatctctcttgaacaaggttggtactcaataattactttttctcttctcattccaaccctcaccccatgacataaattatagctgcgggtggtctgggactagtcctcttggcttgaagctggagttaatgtagtgtgggaccatcaatgaccgacctggcctgctgggtgatgtttgggactgtcattacccagagtatgtttaaccattagcgatggggccacagcactccagacttctccattccctggcctgtttttaaggagagaagcagaggctaattggaagttttgtattatgtgtgccttaccccctgccattagtggagttatcaaattataatcatctttccatcttgatgtcatgagtttcttctgttgtactggtacattataagggaattttttcttttatttgcttgtttatgaatgaatgggtagaaatctacttggattcttaggtatttcaagaagtctaaattctagtggtaaaattcattgcctttaatactcggactccaaatcagcttacacaataataatttttgttctcataactcagttatataaatgaaataatttgttttgcatgtatagatactatttacattttccacaaaaaccaacactactttaaaaattgtatattataagcctgatagattgaagttgcataatataataaatctaaaacattgatgagatgatgtgggtcttactggctagattgccacgtttctccttcttctgaagcacatgcgcaaggtcctatgctgtaaagaagtgaagacattccttggatcatttagatgccggcaaggtccagtaattgtttcttattgctctctatgattccatgaagattaacatgtaaaatattttgagcatatggattttttattccacatataaagaaaatattcagtgatcatagagtgactgaaagcttggatggagcttcaatatctcttattagctgagctgtcttgcacaagttatttaacttgttaacagtctccatttcttatctttgtaaaatagggataatgataatacttcctcctagggttgttaggatggacaaaggagataatgatgggccaggcacttaccacattgcctgcattaaatactgggggaggttggctcttaatcactatgttggccctttaaggggacaaatacttttaaatttccctaataatttggaaggtaaaataaattcaaaatttttggtgtcattgtttcacctctgtcctaaacaccatagaatcccattttgcttgacggaacacaaaagaggggtgtgagatagaaataaatgaaggaataaaaagaggacttgtactgttgctaggtgatctccattttcactcagagtgagagtgcatcctgtcctccttccctgctgtggttggtctatctcttagttagcggtatttttctttttttagtctgcttattacctttctcataatgagatataatcaggcacttttttgtgtgtgaggccggttcttgctctgttgcctaggctggagtgcagtggcaccatcatagctcgctgcacttctgggctcaagcgatctttgcacctcagccttccaagtagctgggactacaggcatgacccaccatacccagttcacttctaaatgttttactcttagtagagacagggtcttgctgtgttggccaggctggtctcgaatccctgggctcaagcggatcctctgacttcagcctcccaaagtgcagggattacagggatgagccaccaaccccgcccacactctgtgtagacgattattctttctccacaattatagccatttcgtctcctttaccatgttctctttgactttctggtttgactgcattttcattcttcctcatttttttaacctcctatgtgtcactcgtgtttgatgttcaaacaattttattattttctatcggtttgcgtcatcagaaacaggtcaaaatccttattacaaagagattggaggggaatgtacttttttgccctaataaaactagatggcatagtgacaagtgtgtgtttgttaaaaagcagttagcacaaattagaaatacttcacagcagatgtgttttgtgaaaggatatgctaaaaaattaaacagagaatactttccggttataattttagaaaaatattgtgcaatgaagcaaatttacaattcacttaaatcaacctttttatagagtgtgtgccttcacgataaaattttgacaattctgcaatttgtttcagtgtttcattgagggggtggaaatccatctgctagttattttgggggacaccattgcatcaataaaatgattcctaagctgtacacagacttcattttaaattaatgtgtagctgttttataatgtgtagctgttttaagtataagtgacttagttaaaggcaaaagttcctattatatgcataatagtaggaatttcttttttctttctgtcaaacacaatcccagggtactctactctctaagaacatcttgggccctgggttctggcagacgtttcttattcttacttcactgatcccttttcgagctgctggagggacttttttttaagttgctaccgttgatacagttgctattaatcaccgtctgccatgttgtgacgcaggtttaataacatctcattgagtggctctcgcaaactggaggcttaccaacagcactagcctttgatattcgactcacaccaggaaaaagaaaatgtagagttaaaaaaaaaaaacactgcaaatagaaaaaagaacaaaaactggagaaaacagagtgaaatcaaaaacagatagctttctgtgtgcagcttagtttgccatgggagcagtgaagctataaatctcagcagtgttgtttgaaaactgaacatgaggctgctaaatttatcattcattctttgttgtttcagggaggggaagagctagctgacttggctaactttggattctgccccctcccatcagtaacgtttcatttttctccaaataaaatcaaaatttgttttttcctggatcaaagaatactgggtgatttttaccaatggttggggaaagaagggggaaaggaggactggctttgagtcatccatgtgctgtgggagtgtgtgatttcttccacttcataaatgtggggacaggatggttttctttcgttatagaaagaaaggatatacacatctcctactatatactttaaaaatccatatgtagaatgtaaaagcatggagaaagttcaccaccacgaggatatctagagcctcgtgaagctgcaaaattccctccttttgtttgcactggtgctctatgttgcactgcacagggggaaaaaaaaggtagaaagcaagcctgctacagatgtgactagctatgaatattcatgagtgccattgctcctcctttcctagagcatccaggcctttctgatcttcctcttgcacagctcccagatgctccccctgccacccaccccacacttcccccacctcaaatctgccctccctgaccaaccctggaacaagactgcagtttatttcgataacatcctggcatgatacagtgatcggtggccttagaagtgtgtttgtgtgtgtgtgtgcatgtgtgtgtgtgtggatatactcctgcaccaaaacaaagggggaaaagaaaaaaaatgtaattatctacagttttatgaattcaactccccttaatgttcattatttaaaccagcagcaattacaagttcaaaggggtttagagggccagcaacccgcataatcactgccaaattaagcgggactcattcgtcacaggagagtacaccctgagcagtgaatcatgcatgccgtgacaggctctgatttacataaagcagaaatctgtgccctctggggctgcacgttacttcttctcagtagccctgtgatacgtgaattttcttttggtattaggaagctgatactgcctccgacatggcatagcgttccgctaaatattgacaatagcttttcactttagtgtatacttgagctcaagtcacatgttgggccacaatgtcagtgcaattctgattctgggaaagaaaagaatttgtttcccctaaagtttctgaattaagtacttttatgattaaaaagaatgagagtttggtggtacagttgtgtttccttttatcccaatctgttcaggtccatagttaaaaatctatggtgctgataaggagcaaaaaaaaaaaaaaacccttagacctatgacctaagtgcctgaagggagtgatccgttgaggaatgccccctaaggccctttcctgtttggcatttagagaacttttgagtgttacctagtgacagttggagacgataattgaagtaacctgtgctctgaagctggactttgtgttaccaaacttgagaggacttctgattggatggtccaggaaacctgcctgagtgccgtcatcagccattgaaatctcttgggtctaaacaataaaaaattccagaattaagttcaaatcaaaatgcatttggtttaggatgattgtgtcagacaccaaaacaacatatgtagatttttatcccccattcttagatgttctctcttgtctctttaggcaaaccttggcactattttatcagttgttttctctcttttgggaagagctcatttttccatttgtggctcaatcatcttggtgttatgatgtcatttccccacacagtcattctcttttctcagatatagtactgcatccacacttaggattggaagcatttgggctttgagaattagtttggcaatttgggagataatcgacccttgtttttgtgctgactttgaagtgcagataaaggtcttgtggttttgtgtcttgtaactgggtctacgcttcacatatatctaagcagtgggtttaagaagttctttgcaatagatcacagtagtttgtgaagcaatgtgacaaaatggacccaaagcacccttaaacaggcttcctggtgttctgctattgttaacattctaccaccaccactcaaagcctccaaaatttcatcttgccattaagtctctagatactttgtttccctgggttcttgcccatatcttcctccctgagattcttcaccaagtggagattttgtatgctcaagtgtgaagttacagaaatgttgtctctactgtcacaagtatactgtaaggtggcctgcttatactggaaagaggagtaagccaggaatatcagtcccaggttagtccagttaagaaaccaggttaaatggacaagttgtttcacctctctgagcttcagtttcttcagttgtaaaatgggtatagtcatttctattttgcttaacccagaagttgttataaggagtggtagttgttaattttatttcattgccaaagctctgaattcattgagctgtttgagttcctcctagaatatatatatgtattatatatatatgtaatatattagcaatattatatatatatataatttttttttttgagttggagttttgctcttgttgcccaggctggagtacaaaggcgtgacctcggctgactgcaatctctgcctcctgggttcaagtgattctcctgcctcagtctctggagtagctgggattacaggcgcccaccaccatgcccagctaattttttgtatgtttagtagagacggggtttcaccatgttggtcaggctagtcttgaacttctgacttcaggtgatccatccacctcggcctcctaaagtgctgggattacaggtgtgagccacggtgcctggccttaaaatcatcttttttcctctcctctcttctgctcttctgtgttcctcagaagtaagatcctttctctctcgtttcttcaggccttattctcacatccaggctgagctttgctgtaaggtgccatctggcactctcagtggaaggattctcctggactccatgaaatcttccaagccagtttcctttctctcatcactacctctagagtcctagggaagaagaatcaacattttgacttgcgttcttgtgtggtcccctcctccagaactcatccttctttttttctgtttaaataatttcatgccttttaaaacccaaatactgtcaagcttttagggtcactgagattgaaatatgcatttgcaggaggtaaacattggtagacaaatttatatactgtaatatatacctaaagtgccaaaaaaagccacattgaaaaaatattattctaacctttcatatgtacacctgaaaaatatagtcaatgacttgcaaatccaaattagatttatagtaaattatttaaagatattctaataaagaatttaatgtaattgaatttgtacacattagggcaatcttaactagcatgctggcaaaaatggccatatagtagtaccctaggtagcatattgatattacaaatatatgtaaaataggccgtatatagatgcacacacatgcatgtatacacacaaacaagcaaagtgtggtaaggtagaacctatgcaaaataggggaagaattgtaacattttctcagtgaaattcatgggacctttttgtgggcacacgtcacctgtggactactttgtaacaggcctatgaataggatgcatgattagattctgaggttcagttagtgataaaaacggaagcatgctttctttgcaaacaaatagtgcatctcttcattcacttctttcttagcaatctatggtttctaacatggccataccactgggaaaggactgaggaacaaggagatgttttaatgatcaaatttcacctgctttggtccagcctctataaaatcttgctgctatattgaaccaaagtacccatcaatgttccttttattggacatgcttcatatattgtgatgagattatatgcatccgtagaggttgttaggaaaaacttaacatgccactgatgtgcaatgaaggaaagttaattgtgttgatgccacaaaactgcatcaatgagtagatccctctgtcaggagtgttaatctgtcttgaataaaaactgctacacaggtttgtaaccaatagcctaaggtaaaacctggtattaataaacatatggcaatgaatcaagccacaactatctttattcacatagggatctatggactgtaaaaccaccaccgggcgcagtgcctcacacctgtaatcccagcactttaggagactgaggtgggcagatcacgaggtcaggagttccagactagcctgaccaacatgatgaaaccccatctctactaaaaatacaaaaattagccaggtgtggtggtacacgcctgtaatcccagctactcaggaggctgagacaaaagaattgcttgaacctgggaggcagaggttgcagtgagccgagatcaggccactgcactccagcctgggtgacagaatgagactccatctcaaaaaaaaaaaaaaaaaaaaaaaaaaaaaaccactgatagatgctggtctgtaaacataatcttttttcatattgctcacagaatttaagtcaaatgcagctactgacaacgcacatgtctctttttcagtttctatcatattatcagtaatacacactttcattaatcaagaaagctaattcttttggactctgcatctatatacatttgtatcttaataaagaacttcatttttctattttgaaatgtctgcgtataattaactatcctggaaaatttcaactatcttggacttatatccaagcaactcttatataattcaactgcatctgaaattggtcatcattgaaggtgacaaattgggaaatgaataagatttgcatgactgaattttgtgtggagacaagagataactactttgaaaagttacgtatctaaatttagtaagtgagcttttactctgtgtgatataatatccctaacccaaaatatacttacatacagagctatttacatgtgttcatctggaggacggtctatagactacatgacatttcaggtacattccagttcaataaatctttccctgtcatgtcttcgtaaggagcaatagactattgttttgtttcatttggagaacagtggctaaacctgaagctaaatacagagagatgggcaaaaggagatatgataagaatgacggtgtttgtgaacttggacctgatttgtcttatgctccctaaatcattttgggtgcaattaatattgtgaattagacatttttcttgggtgagggaagtagagatgtgaatgtgagtttggaaggagcaagagataaagctagatcagcaataaatccaccctcaacccccattcaattaagttttaaaattcattttaaacagctgatctgaataacgctaaggagctttggagattcatctaaaacagtgcttttggccgggtgccgtggctcaaacctgcaatcccagcactggcggaggccgatgggggtggattgcttgagcccaggagttcgagggccagcctgagcaatatggtgaaaccctctgtctaccaaaaaaaattaggaaggcatggtggcatgcgtctgtagtcccagttactccagaggcttaggggtgaggatctcttgagcccaggaggcacaggttgcagtgagccaagatcatgtcactgcactccagcctggggtacagagggagaccctgtctgaaaacaaagaaataggccgggcgtggtggctcatgcctgtaatctcagcactttgggaggccaagatgggcggatcatgaggtcaggagatccagaccatcctggctaacatggtgaaaccccgtctctactaaaaatacaaaaaattagccaggtgtggtggtgggtgcctgtagtcccagctactcgggaggctgaggcaggagaatggcgtgaacccaggatgcagagcttgcagtgagccgagatcgcgccactgcactccagcctgggcaacagaacaagattctgtctcaaaacaaaacaaaacaaaacaaaaaaaacccacagtgctttccaggattatttttcaggctgtgaaaagcatgggttagaacacatcaaatggggtgtgtctcccttacctccattaactgtaaggacattaattcaatgttcttattcatttattcacttattctgcttttattgaacaaccactaaatacattaggtgctagtttaactgatttagttttttaattcatatccatatttactctgtgtatctatgtagacacatgttagaattgtcaacattcatttatattttttgtacccaaatcaatttttttcagaccctccttttcaatctccagatccttgtcaatagcagactgaagaagtgaagaaatctttaaattttccaaggataattttgtgaagtatcagagagactaggaagcaagtttctagaatactttttccaaattgaatgacttcataatatttgaagcgtaattcttcattgccataaactcactccaaaggatatattttaaaacactttcattgtcttaatagacacaatcttttgtgtaaatgtttctccagccagtattttcccatttacacaacacttaggtatcctagcagtgctaaaataaacattggcttcagcttaacaggacaaatgtttgcactctggaattgtttgtcaatgaaataaatatttccaacccaaaacaaaacaaacctgaaccccaaatgtattaatgtgaagatgagaccaaatttatattgggtttatgctcaagttgacatcttatttttttttattttttatttttttttgagacggagtctcgctctgtcgcccaggctggagtgcagtggcgcgatctcggctcactgcaagctccgcctcccaggttcatgccattctcttgcctcagcctcccgagtagctgggactataggcgcccgccaccacgcctggttaattttttgtatttttagtagagacagggtttcaccgtgttagccaggatggtctctatctcctgaccttgtgatctgcccgcctcggcctcccaaagtgctgggattacaggcgtaagccaccacgcctgacccttattttaattcttatggtcacagagaccatacttttatgggttatcttaaggaattcaatcaatggaaaaaagtgataatttaagaggggggagatatgtttactggtttagggttccattctgctttattctcagcctgaaaattctcctttatacctaaatatgtgcagcacaaaatgtcgtttcttatgtttgttcctataatgcgttctggcacttatgtgatgcttcacttaaaaatacttagctctttctttttccccccaaatcaataactttaatgcctgctccaaataagctaaaatagttttgataattttctagcaaatggcaaacttttaccttttagcagttaaaaactttctgaaatatttaaaaatcactttgacagtatattaaagtgagtgaaagtctttatctaaagatcccactcaacttttcgtgtacttaaaatattataggaaaattgaggaggtgacttattatagaaataagaagacttaaatgaataaattttctgaaaggaaagtgactcttgtgaaagatctcaaatggcagacttcattttgtgttttatctttgctggcttttactcacctacactcatttacaaatccatgaaaatggttcaaaggtcattggtgaaacttgagaacaaatgcaaaacttccaactatgggaaataggtagaaatacattttaaaaacattgggtttattaaattgggttgattttattactaatttataaatcagtcaaaaatgtaacgccaagttcattgtcctagagcgaatataactatagttagcaagccagctagataatctgtaggcagttggtgattaaactaaaaataatctagtggaaaaaaattgaaatattctttaaacattctttcattgaccggctatattcaggataatggtagcattaaaatgaatacttttctactgtttaattctctgcgttcgatttaacatttttaaaaaggtatccttattgatagcagacgtttcagcctacccttgtatttcttacatgaagaggagaatgttaggttttaaaatcattaagttttgctatatattgaaaagttgttttctagaggtctgcagacctcttgcagacaacattattctaggtgttagcatactgatgaaacatcaaggatatttatcaaaaataccaactgcctctttattaacatagcaaaggcttatggacattaatcttagatggcgtttttaaaattgaagttttaaagaatcagaatgaggaacagagaattttctaaatcagtggtccccaagtgtgtattcacaaaaaggtgatgggaagctgtgttagttagaatgtttttgccttaaaataacagaaaaatatttcacaaactggcttaaaggatagtgaggaagttccaaggtgtgtggtatggtggactccaagagtcagtggttcagtcatgtccccagagacccagggtgtctctgctgctctttgttcacatgccggcaccaccctcagggagggtttctgcatagttgtaacatgactgccagggctacaggccactttattcaggtccaagtggcttcttgtgaattctctttttctttctttcttatttatttatttatttattgagatgggaccttgctatgttgcgcagactggtcttgaacccctggcttccattgatcctcccacctccgcctcctggatagctgagattacagctgtgctctaatatacctggctggatctcttttgagagctaggcttcccagaagcctctagcaaaagtcttttcatgtgggccagaagttggtcacactggcaaggaaatcggattgccctcagacaaattggacccatccttaaagttggaaggatgctcaaaagaggtttaattccttactgtcagccttatacactgttattattctcatttcacatgttaagcaagtacataatgcccagagagattaaatatattcgtctagacttactcagctagtaaaaggtggcagacgatcctacaacctcggctatcagtgtaagacacacagatttagtcttttcatatatatttaacaatttccaaccccttccttctaaaaaagatacattcaaaactgggtctggcctggaaagagtacatgaagcagtacatgttttcatgaagctacaacagaatggctttaaaaacttagccaacaggagtttgtttttacttttattcaggcatttaacatggttattggcttatccatgaagaagcaagttaagtttttgtcaggtgaacaacgaacagttctgcatctctagtgagctacgtcagttgtaagagggaagatttttgaggaaaaaatttcattggcactagccctagtgattaagagacgcatatagctatcaaatatttgtgagtagagaacagggacaagataggtaatgaaggaaggagtgatttaaagtagacttgcatagattgaaggtgaacaatatagtttatagaccatggatcaagctgtgatggagaagatataaggtcacacccctgaaagtgttagaaaagctgacatcttaatttctccagataatagaaattgtaaccatttgcataaagtgaaattaatttatatggttacgatacccaaacattctgtatccttcagagggaaagagatactgccaggccatggcttaatttgggaattatttatagctaattatctttacttctgtcaacagtttaatgattttttatggtatgaaaaacagtagcaatgctgaatcactatcaaaagtcagcattcaaaaaattaaataaatggaaaaatcagtggtccaaatagtgcaaaaaaaatgtgtattatgcacaggcaagatttatttgtttcagagtttatgtaaacaaatacttagaacaagggaagaagattataagtaattgtataacaataaaaatgattcagtactccacctcccaaaggatctttaagtgctttacagaaccccccatttcattgagagatgtgtaatagattcattcacttacatacgtagaaataacttgtcatgccgttaaattcctcttctataggaatcaaattagtgttgggaactcattgtcaaaagttacatcatgggcccagtggcgtacacctgtaatcccaggactttgggaagccaaggagggcggatgacttgagctcagaagtttgagaccagcctgggcaacatgacaacgcctcctctctacaaaaaaaatacaaaaattaggtggacatggtggtgcacatctgtagtccaagcaacttgggaggctgagaggcggaggatctcttgagcccggaggctgcagtgagcagagatcacgctactgcactcagcctggttgacagagggagaccttatctcaaaaaaaaaagttccatcatgatgggtaggactggcctacagaatgcagtaaactagttagtaaataatgtctggatggtggtgcgtcagcaggaatggtactgtgacatgctggtccctggagggaggtgttgctgccaccacacctgaaagctttgagctcctcagaggattcactggagacctagattgttccattcgtgctttcagttaagtcaactgagcaactgactccctgctgaagtcccactgttcacttttctcatattcgttttttatcatcttactctttctcctaaaaatgtcctttgacttttctaatcagctttatatttcattacgaacttacagaaaaactcactttcaccaggagtggctggataacatcatggtgagggcatgcgttaatgaacatgacttctttcacagtgtgctcatgtagccatgatgttgaaaaggcaagttaaataagcttttgatagtagatgtttcaacatggtttttatgaattggaattttttagaacatcaggtaaaatcaaccagaggctccaacatgactttctctgccccataatcttttttcttgtgtttttaaaattggtatatcataattgtacatatttgggggaagtacatgtggtattttggtacatgcatacaatgtgttaggatcaaatcaggataattgggatatccatcacctcaaacatttatcttttctttgtgttgggaacatgcctcataatcttgattgtaacactagattataatcttgatggaacattatctgccatgtagtgttttgttggctgatgtggctcaaagcctaccaaggcatgatcttagtgttatgcaagggatcctgctgggctttgtctgaccaagtctgggtcttgttctggaatctccatgggtactatcagtctgcggtatcaagagtgctaatgacaggccttgaggcagagatgtggacgtgtacaaagagcaagcagctcaatctgaagcacatggggcacatggggcatgctgacacgtgtaacagaatcatctattgaggccatttccagttctattattctgtgagtctatgacgtttcctgacatcatagaagattattttccttttcctggagaattggctgataatgcctacagcaatgaagggcctcacctgctcaggctgttttgtgcttgaacatcacagttgaaatttattgctagaattctgattctagcactgtattcaagatggcagcacttattagcagagaattatcaagttcacgtgctctctgagcaagaaaagcccttagttatcctaagattttggtatagataattatttctcttgagtacaggaagagcacttcataacctgtttaaaagtatttttttccctgtttttagctttggaatggtaagtagaaactgctaggcatgaccaacaattaaagtcatccagtagttgtggaggcccaaaagccaacctgagatttctcatgtcagttaaggaaattttaattgctcatttacatttcatctcagtcatttttggctgctgtaacaaaataccataaactattcagtttataaacaacagacatttatttctcacagtcctggaggctgggaagtccaagatgatggtgctggcaaattcagtgtctggtgacggcttacttcccggtgtagagacagccgtctcaatatgtcctcatatggcagaaggggtgagggagctctccagggtctcttttataaaggcactaatcccatttgtgagagctccatcctcatgacctaatcacctactggaaggccccacttcctaatatcctcacattgggggttagaatttcaacccccaaatatgaatttgggaaagacagaaacattcagtctatagcacactgtatcatggggaacaatattttaggaagaaatttggagaaagaagaagatttcaaaagtcaggaccacttcttagtacataaaatggcctgttgatattagtaagaactactaatttctcactaatggctacagcaagtgtcatatggagtccaacatgttcgtatctaagtgacagaactcttgccttttattgattttttttttactttgccttccctctcttctaaatttaaaaaaaatcaaaatgtatgaagtctaaaatattgacaattttaaaacagaaaatttagccagtggtgtttttgttgttgttgttgttgttgtttaccctggaagacttattcatatcatatttgagcaaaagtgagtgtctgatgaatgcaaagctttcagctttctgagaagtattttctggagtatcacacagagtctatggcagagtctatggcccagtgaaatcagaatgtgcaggtccatttaggctagagggagggtctctgctaaaagggcagaataatcagagggtgtttctgtctcactgtgcagcaggttggtttgctctgggctccctctgtgggtgccaaactaaatgctcaaggctgtcctgcagctgtggtcagtcattcaaggaaaaatctttgtggaggtaagtgagccctccaggagacatggttttatagactttccatattacttaggtattgggaggatggctctgataaaaacagtgcacttaataaatttaaaaataaaacaaattttgttgtagcactgtcttcttagaaatcttccaattgaaagcaaataaaataaaaagaataaaaactttagttttcactccaaacagcctcctttcctgtgcaactatataatggaaatacttcattacatctatttcattgtctcgtttaaatgaaagtaaatgtaagaaaaagtgggccaagatgtgaaatatacgaagctccttcacccccttcattaatccctaccactaaaatacagatgaattattaagaaaaaaatgctactagatgaggaaactaatcaaaatcacttaaaccaaaatgttgcctgaccgtatattcatttattcaccaatatttagtggtctttattttccttctgcgggcaagtacttcactaagtgaaaggaggatgcaaagatgagtcagaacccagcctgccctcaagaaatttaaacacatgtaggagagataaaatgtgaatatgtaacataaattaaaagtaaaaagtgaaaagtgtcaaaagaaaactatgggtacagggctatgggagttggaggaaggaaagattacttccagctgaagaaattagtagatgttttaaggaggctgcagaagcggggaggaggagggagaactttgaaggcaggtgatggggtgggggtgggggctggagccagcaggacggtgcagggaatgtatgggaagcagtgattagcaggcattgcttccatcaaggctgagataaggctgcctgagcaacaggaaatgatgttgggagggcaggtctattcagactagagaccacattggttaaggatttcagatataattgggtggagaatgagtttttgagcaagaaacagacagaatattgttataattcagaacaattagtttggaaaagtttaatcagatgggttgaaatgccaaaaaaaatgagatagaatactcattacaaggcttttgtgtaataaaaataagtgtttcacaaagtacggatgatgtacggtttgtggcacgtatggcaaatctaagtgctattcagattttaataataacataggtttaagtacatatttaaaaatataatttgtatatcgaacctcttattctataaactattgccatggatgaatctaaagaaaacaatgtaggtcaagtaaatttaaaatattaaataaataatatagtgcatgtgatctgcccatatttcccaaatcttgaaggccttaggggaatgactaaaggttgcaaaagcctgatctaagtgtaagctaatgagtttctaccttagggcaatggaaatggaagtgaggagataagtatgagaaatagtctggaggaagaatctgcatattctggcaatctaagtgtggtgaacagggaaagagggggaagcaatccaacatactgctagggttttgggcctgactatattagaatgccagtaactattcaaataaataaaacaggagtaggtttatgagaaaatgagagtccagtatatgagcatgtaccaggcatttgaaatgcagaactaaagggctggagtaggaagagatttagaatcagcctctgattctcaagggtccaaggtagtagctgaagtggtgagattgttactgaggactctagagaagagggccaaggatagatccttgggaaagtatacttaggaatggcagcagctagagaggcccaagaagatactagagaactaagaagataagtgagaaaatacttcttctcttagtcatgaaagattacttgaagcctgagcccccagtatagccctgtgattggcatcaggtagttgctaaataaatgttaatgcaaaagaaatgcataatcaacagatcaaggtcgacagagaagggtgaggggaccaaagggagaaaataccaatgaatttggtcgtgaggaagtcattggtgacctttcggtctgtagagtctcagtggagtgacaagggcagaagccagattgcaagaagggaaggacagagtggggggtccggaagtggacttttctttcaagacctgtgaaaatagagaggatcctagcttgggagggggcagggagcggagctgagaaaagttgcttgttttttgcttctcttcttttaaagaatacggtatgctcatgcacgtttgtaaacaagaagaaaggatctggtagaagtgaagagattgaaaattcaagggatgggagaatatgggcaaattgatgggaaaaataagtgggggaaaatcaaaggcacacataggaagaatagccttggcaacgtggaagaatggctctttctctgacagtgggtgggagtaaatacaattagcgatacgaagaggagaaaaaaaggggaagctcattttgactttggttatttcatttaagtagtaagatcatcttcaagtagtatcaagactggggtttgctccttgggaaacatgaaaagcttggccattttcagtgtaggggttgtggttgcagaaagatgaagagtaaatcttctcactgcagttgaggctggcaagcttgggtaatggtggtaaagagacctccagtccttattaggatgtaaagaccttattttctatttagcttagttcaaataccatcaagcagacagtgaaggaagtagagtggctcctaaaagcagcagccctaatcttctgtttctcaaaaaacctctttgtagtcattcttaattatgaccttgtgatacataggtcctattaattgattcaaccaattgagacactgaggcctaaagaaattattggctataataatgaggtgattgccttagctatcacgccagatttgctcttttgttttctcctgatattttaaactcttccttgctggaatattaataactcaaagataaaaagggtacaacttgtttccatgtgggaggtaggaagaacattgcttttggagtcagttctaggcctggtgactctttgacttgccagttgtgtgccatgatcactccaagcatccattttctcatgtgtaaaaagcatgttaaaaattttaaatgaggagtttaaaaattacactcccagtaggcttactatgaggactaaaataaataaaagtgtgaaatgcagtgccaagcacataatagctgctcaataaatggaagctaaattattttccacagttatctttcaaatttcactttgatcagttttcacagactatcttctaagcaaattctgtaggtgtttgccttcggaaaagtgcgtttgttgtcagtgaatggttacagggaaaaggagatacttgtcatgcagctggaaacatgaaaacttggccctgtgttcttaaaaatgaaaactccctgcaggatgggtcaagttgctaccataggctggagcctatgattctcagagcagcatcactcttaatggcactgttctgcatgcccttaccttgctcattttgctgggctcagtactaattttcatcccctaggcaggcaaactaagtgtcattgtggcagttccttccatactaagaggaagcattgatcactaagagtcagcatggtttactatgagtaaattaaaccagacctatcttgacctctgacaaggttgtcgtgatgaccatgtcagtttggttccttgctgtatgcccagtgtctgacactgatcctagcatatagtagacactctatatattaaataaatgagccaacaatgtccttgtgagcataatgaaaaattactggccagtgagagtttcgttggatggctttgtaatgaaagacagcacaaagagattgctagcacctgagctcaattggctttgtcttcaggccagttatacgcaattattttcaaaatgatgaattgattgaggacactgataactctacctgaagatgaagaaagagccaacgtgttaaatgtcagaaacagaatccaaagaaatcctaagaaagagcacagaagaatggcaagaactagtcatgtatagttagaatgcttaagatttgaatcttggtttcagccagcacttggagtgtgaccatcagcaatttgcttaatcttccaggcttagtttcatcaactaagttaggaggggaatctctacctcacagggctcttgcatgaatgaaacgtttggcgtaatacggaagccctcagagcagtacgcttcaagcagtttatgaagtccttagcgtctttcttatggccgaaaatagtttggaatgggttgaaacaatgggccaacctaaccagatgaaactgtaaagaagataaatgtaaagagtgtttaagtaccataatttaattatacaaatataagacaggagctatgtaacagaggagagattttagctgacagtaagcatggaatgatttggaagaaaaagaaaagccttagccaggcactggggctcatgtctgtaatctcagcactttgggaggctgaggtggaaggatcacttgagtccatgagtttgagaccagcctgagcaacagagcgagaccccatctctacaaaaagtaaaagaattagcctggtgtggtggtgtgcacctcttttcccagctgcttgggaggctgaggtgggaggatgtggaggctgcagtgagctgtgattgcaccactgtactccagcctaggtgacaaaggaagaccaaaaaaaaaaaaaaaaaaaaaaaaactttgtgtttttacgacaatatatccagaatggtaaaagtcgtagtctgtgctgatcaaactggctttaaactatggtaccatttatgggatccacctttaaggaggacatgaacaacctatagcccgtcgtgaggaaaatggcctgaaggaagagtgcatgctcgaactgaagaagagaacatctaaagggacagtacagtgtccttaagtgtttgaaggatttccatgtggaagaaagcaactgggcttgctctgtgatatgacaggggatagggcaaggatcagtgaaggtgcagggccacaggtttcagcctgacctcggtcagcactttgtaagcaccagtaaactgaatgtggaatgaactgcctgtgcaggtggtatgcttcatcttcctaaatttgcttaaaccatgcacgtttgtaccttggcacctgtggtaaagagagaaatcaaggccgggcacggtggctcatgcctgtaatcccagctctttgggaggccaaagcggacagatcactaggtcaggagatcgagaccatcctggctaacacggcgaaaccccgtctttagtaaaaatacaaaaaaaattagccaggcgtggtggcaggtgcctgtagtcccagctactccaaggcaggagaatggcgtgaacccagaagatggagcttgcagtgagccgagatcgcgccaatgcagtccagcctgggcaacagagcaagattctgtctcaaaaaaaaaaaaaaagagagagagagagaaatcaagaattggctaagatactgaattatgtattatccatgggcccttccaaccctgtgacactgggatttcctttccctttcctaactcaaagttagcaaaatgttcattctttctcaaaaaaggtggaaagcagttcagtttgagggcagacaataaaaattaacccagaaaaataaagagcttgtcagcccagtgtgtttgtttgttggttttgctttaaaaaagccattagctgagtttcattcttaactttaatcagattctctgattaagaattccttaaacactccacaaagtaagcaatctttcctctcacatctggcaatttttgtaaagagagcaacatgctcaaggcatagctcgaaatagaacctatatttcccgacttctaaatccctgagctattcctatacaatgctttttaccctgaacttttcagaggctgtttgaattcacccttccagcccttgagggcttccctttcagtgattcacagctctgtttgacatccagttttggaaaggttagaggacttgacaagtaaaacctctcagagtaaatggtaaggggaggcctgaatgcaagtatgtaatatggagagttactcccatttctggttaagaaatggtgattcttatttttagctgggaagacaatgggacaaaatcatgcagtttaggtcttggcctttaatcataaggctggtcagccctcagctcttaagccagcatagaagttatgagacagtcaggtcatcctcagaggttccatttccgttccatctgctccatgtctcttgtttactgattccattttgggccatgatatttgacctactaagaaagaaacagtgccttcttggaggaaatcttggaagttttgcagatccctttaaattccttgactttactctgaagaaacacgtaattatgatgagacttcattattgctaaacaacaatatacagcagcagaaattcaagcagtgtttgtattcaaatctgccactaagaacaaatttccattattaattttcccaatctcgataaaaaaaataggggaggaggaacagtttgactagtggcagctctgcaaattgtcaccaggagccattggttccctgaggctgatgactgccccaaagctgccccacattcttccagtgtgaacacctagagctgttgaaaagaattgagacgcttgtcaacagaatggaaagctggccttcatcaaaacaattttagtctgtgagactaatgacctttcattgctgtttgttttagtttggaactaaatgagaaaattgtcttagataacagtagcttggttttcctttaccaattattttattgggaaaacctaagtagcataattattcaccaatatttaaaaatatatatatatatatgtgtgtgtatatatatatgtgtgtgtgtgtgtatatatatacacatatgtatatatatatacatatatatatatatatatatatatatatatatatatatatatatatctcagactagaggaaatggttaactagcccagaagtctgagaaacctaacttcagaatggataatgaaaaataataatacaaagattcaagtcgaacaagaaaaatgcctattgtgtgctcacttaccgcaatagttcctcatgataaagcacaacatttctgagtgctacttacctctaggttttttttctttctttctttctttctttcttttcttttctttgtttttttttttttttttttttttttagtagctgtaaactgagctagctgatgaactgcctctagggacaggataggatcacccttgtttcctgttcagccttgctgaagaaaaaaaaaaaccctaatgaaagaaaagaacgtaatggctttgccattaatccaggtaaaaggtttaggagagttcagagatcaattaatttttaaatcttagatcactaaatttcttttttgaagaacaaataaatttctggcttgtaagacttacaaacctgcaaatcaaaatgtaagtaaaaacaagagatgttcaatcaggaatgtactggagaaagtaaaagttaggtggttttcatttatctaggcactttcatagttcatttgaagtggcatgcaattagaaaaaaaaagtgcatggatatggccttccttggttaagtgtctatgggtgggaatgcatgaaaatgtttaaagtgtttaagtaaaaatatcaaatagactttacataaaaccgccagataatttacagacatttgcagtattgaccatttcccttcagccatatatcagggaggagaacagagacgtttgttgcatcgttgggaagcaatgaaatttctgtaagttgtgatccactggcatgtaataactcgatctgcttcatgcagacaaaatatattaaaagtatggacgagtgaagtttgtgccccagggaaaaggcgagataatgcattgaaattgttcagaggtagttagatgcctaatggtctcatatgtgagctatgtgaggtctgaggtctggttctcataaattctggctagactgatcctgtaatttcaagcaaaggataaaagcgttagccagaatcatcagtgttcaacgtccatgatggtggatattattcatgtaaagatttttaaaagaaaaaacgcactttaaaagggatgctgtggaatataattcatggttctatgtatttgcatgtttgtgcttgaaaataaatgcacacctacatgcacagtataagccatttaatgaaataaattaacttggaatttatataaacctttcacatcttttccatgatgggataggatttttgatataatataataatgtgctgcatgaaaaaccatgtaggatctaattatttcaacttcaaactgacatatctgtgtttaaattggagtaaaaaacatgtttgtaataaaaatttaccattacgaaaggaataatttaaaaccaatttggacggattcaggagtgattagagggaaaagttcccaagacatttggtagtcttataaatgatttcacaaaatatgctaagactatccgaccaattatattggctgaatactgaatcctcagatttgaaaagaaaattccttaagaactaggcttttgaaattaggtatatggtgggtatgaaaacccttgataacttcctcctttatgtaatttatttcatcatgggggtagaagttttgaagttttcctttgcagtttcttttctttttttaaccagctcacttatgtttgagtctacagtatatttatacagtctttcctgccagaatcgttgacagtatttttaaatgctttcccttgctgcctaggttataccaagcaccactctcctcaagttctcaaaactataccacccacacacacatcatgaatagagatgtgcatactttttttttcttttggaaaacaaagcgttcaatctaaaattactttggctttattgaccctgaaaatcatctcaacttcacaccttatggaggtagctggtttgagcttctgtttgatcctggtaacaagactatcattgtaagattttgttcgtaaaaatgtctacatttatatatatgtaatctctctctattagtaccataatttaaagcactctgacattctgtaagaacctcagtagaaggtaccttttgggctaaaaatcttttgcttcagtcttctgaatttacctgaagacatttgtagattcagttataatggattacatgagtttgacttttaagattgctgaaaatgcttaaccccaaactgttgtgcctgatagtgcagcacatacacacagcctttatattttaatatacaaatattttctgttagggatctaggaggtgatattccttatttacaaatgaggtaaccagtctcaaagattaagacgagcttaaaattatccttaaaaaccatcagattgcaaactttgcatcattcctctgatagttatcttttggttgaaaaacaaatgcttccattttattttcttcaccttgaagaaatatactaagagatccatctaccatttagaatataaaggacaattataagaaatgatatgatgccccaggagactttgacaagtggattaatactttttttaaatgaaagtacagtagaagaattagttaaataccggaattctagaagtttctttttgcctcatttaaatatttataaaatagaaaaagattctagaattaaactctcatgggtttctttccaatcatatgaaaggaaatccaggtaataattcacttacctctggtttttaataattttattggtgtgctcatccttccagaactcctcctactacctattcattgacattttgctgccgttttttgaagataaaatgactgtgtaacaatcctcagctacagataatttaaaagaattagtggtggaatcagggtatttaacttttcattatttgttctccattaggaagactcatagttttagcaggaagggtaagtattagaaatttgggattcgtttatgttttctatccaaagttaggtaatatgattaccttttgattatttcaattctaaatatctcaaggcaaaattcaaaatccgtgcgagaaaacctgagtagattcctctcatcgccccccttctctccccctcttcctcattctccaaatcctttccagattgtttgcaaaatgaaattatctaatttcacgagtatttgctctgagaaactactacactctctggtagaaaaaactcaaagacccagtttcaaggcctaatatcttaagataagatctttttgtccatgaaataacaccctagattcgatgagagaaccatgtgggccaagttttcccaaatatatctatgaactagcatgttgacaacaccatttacagtaaatgacaatgagatcttttagaaaacactgtatgctaataattttattatttctttcaacaatttatatcaccaaattaaactctagcaagaatttattcaggatgttttaatattcattgaggcactatttcaaaatgtacatctgcttgcttaattacaatatttctgaatttgtaacacttgtcactattacatttagtcttaaaaaaactttagcaactgatgctgaattattaatttcaacattatgaacttttcaacttctaagtattgaggaagaaatactaagctaatttgactaattaatctagttgattatagtatatttatccaagcagagttaatctggcagaccaaaaagtttaaggagcctctggtaaaactataaatgaagccgactagcaattcagtgactaaacaagttattcgattgaaaattaacactttaggccgggcgcggtggctcaccgcctgtaatcccagcactttgggaggccgaggcgggcggatcacgaggtcaggagatcgagaccatcctggctaaaacggtgaaaccccgtctctactaaaaatacaaaaaattagccgggcgtagtggcaggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaaaaaaaaaaagaaaattaacactttaatatgtacttttaatcatcttagattaaagagtgtagcctgatagctttaagagttaatactttgtacttgccttatatttctaatgctcacaaagcatcctagactatagcataattaaaaattttacttccaactatttttacactgcaaaagtatgcctagatcaaagcattttgtatttattttcttcaggctctctcactgcattataccatcaaccttattaagttagtgtaccctatgaagatgcatgagagaaataagctctcatttgtttaaatatcccacctacaataatgtaggtgatgacagaattagtgaaaatgggaactccttttgctttgtgacagaaaccacatttaataggcctaattttagatgtagtcactgattctgtcccatgataaaagaataagatgtggaatgtgccaaacagaacttctaaaggtatatgttaaatcaaagagtgttcctttgagtttgcacaaaaaaaaaaaagagagaaaaatctcattgattttacagaagaattaagggaaaatatcactctatggattgcttgatgtgagggaattctagagcattttgctttagtctgatgcttagtagacaagtcccctgagtaggaagcatggctaattctgtactttaaagtgcctaatgtggtgttgacatactcaaatgttaaataatatattttaacatgaagggaaagctcagagctttcatgaggtaaagctgaaaaatagttatacatgcccttgactcacagaaaataaagaggcaaaagctcacattcatttattcatttcaggaaaaagcctaatagtcttgtgtttagcacattttggatttacatttcctagattttcagaggttcaaatcctccctcagaagaaaatttatctaatagctctcaatatcagtcttttttttttcctgaaaagccctatccccctttctggcactcacacttgaaattattgtactaaaaatgttaagtttttgcttctttttaaaatctacaatatacttaagtacatcaaatcgtgcactttaaattggtccattgtatgttatgtgaattacatcttaaagctgtaaaaaaaaaagaaagcccactaaactataccaataaactgtatatacttagtgccttctttcatctttcttttttgactagttcttttgataggtaaaaattcaaaccaaaataataatttcaaataaaatgtttccagatatgccaaaaggaagtactttgaaaatgatttaagtgaacaagagactccattcacagcttagtcactcaaaattatcatttattttaatagtaacaaatttataatttccacactagctctattggctgatttaatattagacaaagttttttttttttctgcagattcaacaaagtgtggattcacttactcattgaatcaatacatttaaactttaaatcaaactgttttctttggggagtgtgtacaaaaataactgcttccaggccgggcgcggtggctcatgcctgtaatcccagcactttgggaggccgaggtgggcgggtcacgaggtcaggagatcaagaccatcctggctaacatggtgaaaccctgtctctactaaaaatacaaaaaatttagctgggcgtggtggcgggcgcctgtagtcccagctacttgggaggctgaggcaggagaatggcatgaacccgggaggcggagcttgcagttagccgagattgtgccactgcactccagcctgggcgacagagtgagactctgtctcaaaaaacaaacaaacaaacaaacaaacaaaactgcttccaaatgaagatacaatgcccccacttcaagtgacctacagcctaatggggactaccaacaagtaagctggcatgttgctacactgtacttacactacagaaacaactgtcatgtaatggtcaacaaacatctggcaactgccaaataagtgctggtaaaccaacaattaagctattccattatgtgaaatgtggcacatagttctgtaaacatgagttagcccgtagtaatagaagtgcagtatcactgctagagttgtaatagtagctatatttatgtgattggaccaatgttaacattcattttcaaagagaagatctcagggaagagttttgatggcttgggagaagtaaaggaaccttgggcagagaccatatctgggcctaaggcagttgtagtccgagctgaccctgtgtgactagaagtccacacgagtatgcaagggaattgaagctgaaagaagaagtcctgaaggcaaatattactaccctcccaagccgaacctacaccaaacctaaacctcttgtattttcaaacgcgaatactgtcatgagcatataaatgacagagttaggtcacttgcatgataaggtggcagctgggcagtggcagtgcaagcagaaatcccactgggctgaaaatttacaggaaaaccatgagctttagtttggttcttcctccaaattgtctaactggtcacttaacctctctagttctgtcctgacttgttaactctcaaagaacatgactctttgtgtttagcatgttttctgatggttaatgagtcagcaaatgaaggaaatgtcaagcactgaagataagaagaaatattattttaatggtggtgttttgaagtctgacagttaaaggattaattaaagatgtgtttatagaagctggctgtctttgtaatcactggtggatctcaatatctacaaaacaggaccccatccttttttcttgctagccttttttcatttcttaatgcaagattttcctctgtatgttactttcgtgtcttgttccatgcagaagggataagatgatctagtaataagtaagttttggttatattataaaagataatgaattaaccctcttaaaatgcttcagaaattcttagatgaatgcaaattattgtttgggggaactgccaaatcttgaacatctcattgaattgaagagacagaaaagagttatcttcctatgaaagaatggttgatggttattgttttaagatatttccatagctaatgggtatttattgtaaatttctgctttaataaatcttttccttctttctacaaatccactatgtaatgacttatgcagtgtgccttaaggtattctatcctgggccaaggcaaactattttcctcaggactgttatctattataacaagtaaagtcatagcaattgtctagagaggacccttgtaagaaataacaatatttttgctgtctgaagggtttatcaagccaagtgacaggaatgtcagctaacattcattgtctctgaactcgtatttggaatacaattaagaaatagataaacaaggaaaacatactgatttggggttccccaaaggataaagtttcctcccctcaaaaaagaatctgatgtgactcatttggataataataagtatttggcctttaaaaaaagctttattatatacaaggtatatgacatgatgttttgatacacatatatatagtgattagtgcagtcaagcaaattgttatatccatcatctcatatagttgcctttcttttcttatttttgctttgtttttgtggtaagagaacctcaaatctactcctggcaaatttccagtatacaatccaacatgattaactatagtcctcattagatctctagactttttcatcctgcataactgcaactctgtggcatttttaagagtctaaaatgttgttccagtgacatgaatgagcatttctaaagtaaaatattatacctatcaaaaattgtaaaagagctgaaccaaaattttgtatagatctgatgttcaatgcaaacagtattctcaacattgaaactgagtgttacgtcttctttgatttaatcccagtggtcagtttggtgactgaatcaagtgtttaaaaaaaaaaaaaactggtcatagctgagattcatttagatcagatgaagatgatccctgtgaacagaaaaggaactaagggactttcagcccctcagctgacatgccttttctttgccatcaaagtgttatgatgttattaagtgtcttatgatagagttggtctcattttcagtgaccatttatttagccagttcattttatcataatttcaccccagcccatgaaagacactgctcttcttaagaactccaacctgattctgacttccctttgaaaagtttacaaccagtgtcatttcaccccaagaagggcttgctgcaggtaaaatttctaagttttagaagtttacctttgaaatctacaatttttttttttttttttttttttgagacagggtcttgctccgttgcccacactggagtgcagaggcacaatcttggctcactgcaacctctgcataccaggttcaaatgatcctcttgccttagcctcccaagtagctgcgactacaggcatgtaccaccaagcctggctaatttttgtactttttgtagagacagggttttgccatgttgcccaggctcatctcaaactcctggatttgagtgatccacccgccttggcctcccaaagttctgggattatagctgtgagccgtggcacctgaccatctcccatttccttgtgtgtactctctaccacacacaccccaccccacactgagtgatctggcagtactgtagtccagaaagttttattttcttatctaaatcttggggtacacactttaccatcatcaagcatatctccaagcataccttccacacaccccttggcctggcttcctgaaatgtttatgctcacagatattttgtgaaagcatcctgtgtaatagttacagtccagtcagaaaacagaaatcacactagttattttcacagagagcattcaacataggcatttggtgaaagggacattagtaatcttaaaaagcaaaacagaacacaatggaaacaagataacgcttttgaaagccgttaccttctctagggctgagaggacaaaaggaaaaggtgggggtcagcagatcctagaaggccagaggaggagccttgtggagttgggactcggtcctctgagaaaggaagccacccagctagtgctgggattgatacctcaggagctgggcctcagatctctgaggagagaactgccagactacttgtgatacccgtgagagtaatgaagttgactctgggagcactgaaggaagctggaagccggaaccaactgtgtagctgccagagtaaagtaccattgctgaggcaatgtgggtggaacattaagagcacaggaaggagcaagttctttttccctcctcctgccttccagtcttcctctagtgctccctaattgcagtgtctaacaggaagcctggggcaaaggcgaaatgcagtttgtagtatcccagtttcagcatctgaaagcagagtactaaagagaaagttcggagctgaaagactttggctaaataaaggctaacctggatgctacagctgaatacagaaggcaagattatgtttaactagggagaggtatgaaacctaagattacaaaagtggttaatttttgctaatgaaaaggaggacttgatcatcccccaaataaaattatgtgaaaacctaggtcaacaagaaccatatcaaaattgatctgactagcagtttccagtataatttatctctcaatgcccatgaaaacacaagaaataataaaaaattacagtggcgctagaaactaataccaatagaatctgggagaaataggtcctatttataaggcatgtagagcttccactcatagcataccatacctctttattgaataaaagaattagtatggtgagaggtaagaatatgcttcacaactctgtcaccatctgcctgctgacctagtgaaccaggaattgtgccaaccagaaatctgagcagaaacccctctctggctcttgggaactgctttgagagattatcattttcccgacacttcaactgtgacctttctataacaaacagatattgaaattctcaggaagcaaatgaacagaaagtagggggatgttaacagtggtgcagggcattctaataaatacaatccttataagaaagccagtgtgggaagtgggacatagaagggaaaaaatattggcagtgcggactgtgaatttcagttttctaagtgctacatctaatcagaataaagcaaataacacacctgaggatgctccaattcaagatccagaaaagatcatcagaatactgtattacaagaaaacaaggcctctatcagaaggcaaaaatatgaaatagaaagtaaaatgatgaggtaaaggacagaagaagataaaaagcaaacagaagaagatgaaagaagattgtaaggaagctaaaggcacaagagcaagattaaaatactcattgagaacagtcaagaacagaactgatcctgtagaaaatcagaacgtgatggaagaagacatttgaataaatctcccatgatggtccagagaaggatagaaagatagaaagaaaaggagaaggaaagtgatgatatgaacaacagagaatggaggaccaacagataggtattcttacttaagaaagatcaagtacaaataaaataaaagtgatagtcaagagtataagagggaaaaaaatcacaaattctctcaactgaagaaaaataatagaaaagttcaattaaactaagggtaggttttttgaaaaggaacaaaattgacaaaccttcagctagactaagaaaagactcaagtaaataaaattataagtgaaagaggagacattgcaactgataccacagaaatacaaaagattataagagactgctatgagcaattttgtgccaataaattaaataacctaaaagaaagagatgaattcctagaaacatataacctaccaagagtgaaccatgaagaggtagaaaacctgaacagacaaataaccggtaaggagattgaatcagtcattaaaaacttctgaacaagaaaagtctaggacctaagggcttcactggtgaattctagtaaacacttaaggaagaattaacaccagtccttctcaaacttttgcaaaaaatggaagagaagggaacacttccaaactcatcttatgaagtcaacattaccctgataccaaagccagacaaggaaattgcaagaaaaaaattacaagctaatatgcctggtgaacacagatgcaaaaatccctcagtaaaatacaaatagtctaaattgaacagcacattgaaaggatcacatcctgatcaagtgggatttatccttggcatgcaaggatggttcaacacatgtaaatcaataaatgtgacatacaacattaacagaatgaagaataaaaatcatatgatcatctcagtagataaagaagaagtatttgaaggaacatatgttgacataataaaggccatatatgacaagcttatagctaacataatactcaacagtgaaaagttaaaagcttttcctccaagattagggcaagacaagaaactcactcccaccacttctattcaacctagtactggaaatcttagccagagcaattaggcaagaaaaagaaataaaagagattcaaatcaaaaagaaagaagtaaaaatttctctgtagatgacataatcttatatgtacaaaacttgtgatcttatatatcgaaaacaccaccaagaaacttttagaactagtaaacaaattcagtaaagttgcagaatgcaaaatcaacatacaaaaatcagttgtgtttctatatattaacaaggaacagagaaagaaattaagaaaacaatcccatagcatctaaaacaattaaatacttaggaaaaaaataaaccaagtaggcaaaggatctgtacactaaaaaactgtagaacatggatgaaagaagttgacaaaatcacaaataaatgggaagatatactgtgttcatggattggaagtattaatattgttaaaatgtccatactacctaaagcaatccatggattcattgcaatccttatcaaaattccaatgttatttttcttagaaatagaaaaaacaatcctaaaattatatggtaccacaaaagattccaaatagccaaagcaatatggagcaagaagaacaaagctggagccaccatattgactgttttaaaaatatactacaaagctatagtaatcaaaacagtataatactggcacaaaaacagacatatagactaatgaaatagaatagagaacctagaaataaatctatgcacttacagtcaattaatcctcaacaagggtgcaagaacacacaatgaggaaaatatagtgtcttcaataaatggtgttgcaaaaactgaactccagatgcacaaaagtgaaattgaactatgtctcataacatatacaaaaagcagctaaaaatgaattaaatacttaaacattagagctgaaactgtaaaactactagaagaaaagatagggaaagatctttttgacattggtctggacaatgatttttttggatatgactccaaaacataaggaccaaaagcaaaaatagacagatggaattgcatcaaactaaacaggttctgtatagcaaaggaaacaatcaacagagtgaatatacagcctataggaattggagaaaatatctgcaaaccacacagctgatgagataatatccgaagtgtttaaggaactcaaacaactcaatagcaagaaaacacataacccaatagaaaaatgggcaaaaactggaatagacatttttccaaagaagacatacaaatggccaattggtatatgaaaaaattctcagtgtcactaatcatcaggcaaatgtaaatcaaaaccacaatgagatactacctcacacctgttaggacagctattatcaaaagagaagagttaagggatgacaaagatgtggagaaaagggagccctgacacaatgttggtgggaatgtaaattggtatagccattatggaaaatagtatgaaggttcctcagaaaaattaaaaatagaactatcatgtgatacagcaatctcatttctgggaatatatccaaaggaaatgaaatcagtatgtcaaagaaatatctgcattcccatgttcattgcagcattattcacaatggccaagatgtggaatcaaactaagtatctattgacagatgaataaagaaaatgattgtacatacaaacttacaatgtgtgtattaatcagcactaaaaaagaagaaaatcctgtcatttgtgacaacatggatgaagctggaagacattatgctaggtgaaataagccaagtacagaaaaacaaatattgcatggtctcatatgtggatactaaaagagttaaactcctagaagcagagggtagattagtgattgccatgggctgggagaaatgggtacaatgtttcagttatgctgaatgagtaagtttggagatctaatgtacagcatggtaactgtagttagtaatcctgtattgtacacttgaaattcactaagagagtatgtatcagtcaggattctccagagaaacagaaccaataggatatagagagatatatatataggaggaaatttattgtgtgaattggcttgtgcagttatggaggctgagaagccccatgatataccatctgcaagttggagaaacaggaaagtgatggcataattcagttcaattccaaaggccggagaaccaggggagcccatggtgtaactcccagttcaacatgtaaggcctgagaactggaacttgggggttttgggggattggtgtaagtcttggagtttgaaggcccaagaatcagcagttctgatatacaaggtcaggagaaaatgatgtcccagctcaagaatggagaatttgcccattctctgccttttcattctgtcagggccctcaacagatgggatgatgacagctcacattgatgagggtggaattcctttactcagttgactgattcaaatgctaatgtctacccttacaaccatacccagaaataatgtattaccagctatctgggcattccttaacccagtcaatttgacacctagaattaaccatcacagagtagatcttaaatgttctcaccatgcatgcacacatgcaagcacgcacacacacacgcccactcacatatcaaagcctcacactgtataccttaaataatacctagtatcatatcggataaggaacccctagtctccctataaataaggagctacagtttctcagcttttctcaaaattatctggaaattctagtcaatgcaggaaaggaaaaaaataaaaaataaaattggaagtgtaagtaccagaaaggagaaaaaattaaaataactagtaaatggtataattgcctacctgaacaaagaacaaaatgaaataaaaagaatcaaacaaaaactactcaaaacaatgagtttattaggttacaaaatcaatatgcaagtatcaatagcttttttaatcagcaataaaagaatgtaataaaaagataaaatcacaataaagtgtataatatcaaataattttaaaagggaatgctcattttctatttggagtaaattacaaatgaaattgtggaacataaaagaaaacttgaaaaaaatgaagggctatattgtaaagattacaatttttctcaatctacacatcagaatcttaaaagaagattttgaggagaagcctgacaaaaagtactctaagttttactttgaagaataaatgtgctaatgtagcctaagatttttaaaagagcagttaagatatttgtcctactttaattaatacatattataaagctatggtaattaagatagctttaaacaggcactgaaatgaaggtgcctgtcagtggaacagaagagacagtataggcacataccaaaatttacataaaattaatttgaaaataaagatgacatttcaaatgggagaaaacaaaatggattatgtcatttgattcctaatgaattaaaaattttagtgtaagaaataaaagaacaaaattagtaggatataatatattagttatggaattttaagtttaagaaattgttatgggttggctgtgtccccacccaaatctcatcttgaattcccacatgttgtgggagggacccagtgggaagtaattgaatcatgggggcaggtgtttcccatgatagtaagtctcacaagatctgatggttattataagggggagttttcctgcacaagctctctttgcttgctgccatccatgtaagaggtgacttgctcctccttgccttccaccatgattgtgaggcctccccagccatgtggaactataattccaattaaacctctttcttttgtaaactgcccagtcttgggtatgtctttattagcagcgtgaaaacgaactaatatagcagtctttcagagcatgatgtcagggatgaaaaacacagatatatataactattaaaaagttaaattttctgtatggcaagaagtatcataaacaaagttaaaataaaaatgacaaactgaggggaattattcacaataaacatgtgactaagtaggggttaatatttttgatatgtaaagaactcttacaaataagttagaaaaaagtaccccaaaaatgaattgggagtttaatacaatagaggcacatctttttgtaaaacttagtaaggcatatctttttcataaatattctgaattagagtataaaatgacaaatggagaattttcaaagttaaggaaaaatctcctaaatttctaataatatctatattgtatggggtttttatataatcctttagagtaatatatatatgtgttattatatatatttattatataaactgacaaatggagaattttcaaagttaaggaaaaatctcctaaatttctaataatatctatattgtatggggtttttatataatcctttagagtaatatatatatgttatatatatatttatataataaatgtaaaatgtaattcatatatattatatatatttttatatattatatataataatggaaatgtatgcaaagtgtaattttaattacatacaggttattatgttgctgagtgtatgcaatcaaattaaacatgcgtctgacatgactccactaggtaattcattagtgaaaaatgcaagtgatcagtaaccatgaaaaaaaagtttatcccaacttgtacttaaggaaataaaaactaaaatacgatgtcattttcacctatcatattggcaaacgccaaagcaccaatgttggcaaagatgtggagagggacactttcatattatgctgaagagtgtttacatggagtatctctcatctgaaatgcttgggaccagaagtgcctagcatttcaaaatttttcagattttgaatatatgcatatatgtaatatatgtattcttggggatggtacccaaatctaaaaatgaaatttatttgtgtttcatagacactttattcaaatatcctgaaggtaattttatacaatgttttaaataattttatgtacaaaacaaaattttcactgtgttttgactgagacctgtcacataaggtcagctgtggaatttttcatttgtagcatcatgtcagtgctcaaaaagtttcaaattgtggagcagttcaagtttcagattttcagagggattctcagtttgtacagcctttccaaagaattaaacatctttaaaaaaatgcatacttttggccctttatttttacctccagtaattttcttaaaagttaatgatctaataaacaaaaatgtaagtagatattgattatgatgtttattttagccataacattgaaagcagtcagtctagtaactggaaacaaatttgacaaatcatggtgcatccatattgtggaatattatgcagccatcaaaatgtaatagagatgtatttttattgatatggaaaaatgtttattaactttttaagaagcaagttagaaaagagtatatgcagtatgagccgatttttttgtaaaagatacaaattcaaataagtatggaaagaaaaagttttgggaggtaaagacacaaaatactagccctttctggatggtagattatttgagacttaatttgttttctttttgctcttccttcttttccaacttttctacagtaaaccttcattatttgggtaattagtacattttcttagcattttaaaataaaacaatccatgtaagaagcaaggatacaataaaaagcacacttcagtgcctgtagcacaataccagtgtggtacagcgataagagcacagatcctggagccaggctggcctgcattcaattcatctggattctgctactactgacagtgttacctcaggcaggtcatttaacatctcagattctgcatctgtaaattgctctagggattagcaaaaatgtaaatcacctaacacacagtctctggcacatactgtgcacttaacaaaaggttaatccttattgttattgttgttgttgtaaatgccaaggaaattaattggcctgaagaccagaaacaaatttgtattgttgagaagaaacatggattaattgttaagaaatttttgtttataatgtatcatcttaccaaatgcagaggaggtacatttaatccatggtttcaccagaaaataactgcttatcaaaacttgtcacaggttaaagttatgtccttgtagaacatgtgcctttctagagggctagcaaggaaagttttcaattgggtaattttagatcctaagcagggtattttgtgtatagtagttgctcagcaagcagtaaatggagtggaattcaggttgtttgcctgggctctcctctggttacacttttgatgctgaatgcccttcactgtgtggtggcctgtgatcactacagcccttattgagagaaaacactcaagaagataaagatcaaccagccttttctaagttttatctttaggaattagagatagggagttctgtaaataaaaggctcctgctttctgtgtcagctgttgtagtttaactaacacattggaccttttgtggctaagttaatatttattgatatttattaatattattagttgactgtgtgttgggcactatgctattaaatactttactacaggaattatcttctttaatatgacaactctgtgctgtaggcattattattccttctagtaggtgatgatccctggactcacccaagatcacatgaatagtaaattcaactgggagcttgaacttgattctctttgatgtcaaaaactatgctattcaacactttgctactttacttccccattccttccaatcaacaagattttttttaagtttgtgtttcagtgtgtctcatttcttgctatgtatttcatggatttgatttaaatccttttctttaatattgatgctatgagaagcctggttttaaataagtatataaaacattcttgaaaagtgtgtttttcctcaactgaattttggttctaaaattttattattgaattgttatatatatatacacttaccacacctcccctgaattttttgttttgttttgttttgttttttgagatggagttttgctcttgttgtccaggctggagtgcaatcccacaatcgtggctcactgcaacctccacctcccaggttcaaacgattctcctgcctcagcctcctgagtagctgggattagaggcatgcgccaccatgcccagctaatttttttgtatttttagtagagatggggtttctccatgttggtcaggctggtctcgaactcccgacttcaggtgatccgcctgccttggcatcccaaagtgctgggattacaggcgtgagcccctgcgcctggcccctatttgagtttttaagttttcgaaggcagggattgtgttttactcctctttacagtccttgcccatagtaggtggatagtaaatattgaattgcatgtctccattgatcatattagaaaacaaacaaaaatgatcattttctattaatctgttaatttttttctgcaaatgtataagcaattcagtatcaacccttagatctgctgctatttgtctaggttcctaggcacagagatatagcacctgtgccttcagtctctgtcagttgtggtgtgtcatagtatttaagaactgatgtttccaatgatatatatgtataagtatacatataataatataattatatacatataataatataatataatatacatatggatatagttctgcccagaagaagccactcttacccacttacatttccatttgctttctttttaaaaaaatctctttataggccaggcgcggtggctcacgcctgtaatcccagcactttgggaggccaaggcgggtgaatcacaaggtcaggagttcgagaccagcctggccaacatggtgaaaccccgtctctactaaaaatacaaaaaattagctgggcatggtggtggccgcctgtaatcccagctatgtgggaggatgaggcaggagagttgcttgaacccgagaggcggaggttgcagggagccgagatcgcgccactgcactccagcctgggtgacagagcgagactctgtctcaaaaaaaaataaaataaaactctttataattacttgtcttttccttttaatttcccttacttataaagtgttggtagaaactttaaaaaattgtttattttgtaattgacaaataaaaattgtatatatttacagtgtacatcatgttttgaaatacatatacattgtggaatggctaaacccaccaattaatatatgcattccctcacatactttatttttattgtggtgataattcttaaaatttgctctcagcaattttcaagtatacgatacattgtttttgactgtagtcaccatgctgtacgatagatctcttgaaattattcctcctgcctacacatttgctttcttaatgtcatctcaccttggactcaccctgggagtggctgtgcacatgaacatcgtctattgtgtgccagccaaaacaacaaacagttggaagtaaaaacaaaaaccaaaacctcgttagattcccagctccaccactcactagctttgtgacctaagcacatcacttaccttctcagactgttgtcaagaagggaaaaattgatgcaggtgtatgtgaggagcgcttagcacatggtagacgttcagtaaattcatggaactctgaaaaaaaaaaaaaaacccttattttttataaacccaccgcctggccttaagaagtttcatgattctactatgaataaatttaaagaaaactgaaacacagatatgggatttaaaaaacaaaaaggggaaaaggcagtcacaggccttttgggaagtatctgtacctgagtgatgttagaaaaaacttcagtattctggaattcaaaaagcattcttcaagcagttcaagctgcactgatttgaggagcatttttgcttgcataaataaaacactaaaaatgttattgagctattccacggaggagatacatacctggtaacataagactatgttttcatgcagtttttattcaaggcaaaacataaaccaatgaaaggaaaacagaaagtgataagtaacgtggctatattttccatgaacatatggtaggtgtttaaaatgaggtatgtcagctattaattccccaggtgcttgccttagccttgataataaggttttctatggagggatttcccatctcttgatattttgatctttgggaaaatatgagaccgactcttctctcttgggcacgtgttagcaggaatatttaaaaagcattttgcactgattgaaatgcaaagggtttcaagaacaattctgatgagtgtgtctatcctaaactcagttattttctcaccccaaaacgccagagaaaccagagactagggaaagactgttttgttctcaactgaacatggcacgcagatttaacagtaggacctggttcctcatgctggctggttcctcatgccatatccatctgatactggatttagcttacagaggacgttaacccatgtaagtcaaagccacagacttaaacatccagaaagtataaggtgggctgaggggcagccctgtaaggtaagatcttatttcaacgtgattaaatgccttctattaggaaaattgcttttttgcttctgtttttcatatgtaaatgttaacgtggtatgtcatagctctcaaataatttgggagaatatggaaaatcattgaaatgttgataaaccaaattatttaatttttggaatatgaacaatttgatttttggagtgtgaacaaaaatattactaatgaaatcagtggacttaatggtcttactggggtcaacttctgtggctcgatggaaagaaaaaataaacgaactatgtaggagcttgaaatatgaacactcagaattctgaaattcattttttgaatttcactatgatgtttggtgttttaaaacacaaaattatagattcaatatcagccctgatatagaatgttctgaaataatgaagagctggcatttcacaatacaggataaccagacaagaatttatctgtacctgaaagtttggtgacactcttcgaatttctaggaaatggaaatgtgactgatttttattgagagttttcaaggtcaaagataggaactgctctcaaggcatgatagctagaaaaatcgagggggaaattgatgtgaaatattgctgaattaagtgtttagaaatacgtaagtacaagttctggcaggtatccatagacaacaaggcatatatcatctttaaatatcataaggttaattttggaaatcagtggatttgtatatctcacgaacatttcaagtggaatactggcttttttttttaaataagaagaaaacaatgtcattagtttttagggtttttttaattaaaagttcagttacagttttttagtgttaatattttaacttcttatttgaacgtcattactccagtcatcctctttattttttcaactcttattatgtgcaaagcaccaaacctgattcttctaattacaacttgtattttaccatggcaattcggataatttaaaatagatgaacgctttgggtttattcactcatgttttcttttttaaaccaatgttttataacacctactaagttccaggctctttattctatagttttatgcctactctccttttctccattagaagaatgcagatctaagctttaaagaggcagcagcatccaaataagagtcagtgcgcttaaccaaagaacagcttttaactgtttcctagtgaaacattttgaaataaaggtctttctaccggggcaataggtgttgtgccagtgtcacaccagagagtagaagcctttgaagagcccttttgtgacttggccactctgcaaaactctgtgtctgaatcctcaagctaagtggaatcttgattatgttttctatttgtaaatgctctacagcttatccagcatgattctatcattttcttacttaatcctcccaaatacctgtaaagcaggtattattgtcctattttatagatgagcaaactgaggcttagagagattaagtgactttagtttccgatggccaagtggaaactaaagcttagtctttcttccacagctgtgttggtgtatatcgacaagtaaaagatgtctatgcaaacacagactaattctagtacatacttaagagatttaaaagatagttgttcagtcagcccatacaaagaaattgtttcttagtcctaagcaatagaggcagtttcaacagatgtgtagacttttgatatgagaaattggtttcaaaatcaggagtcggggctttactgcttttcatgcacagaaaaaaaaaagtgtatctctatgaattgtcacaactgattcctctaaattctgctttagaaaaaaagaatttgttatacacttgaatcttaaactgtagtaaaattaaggtcttttggaaaccaggagaggtgttggtccctggggttcctttgaatcatatcagagtacactattgaaagaaggagaaaacaggacaaaaaatattttaaaaggcataagacacataaatgaatttttaaaaatagtttctattggccaggtgcggtggctcacacctgtaatcccagcactttgggaggccaaggtgggcggatcacttgaggtcaggagttcgagaccagatcattgggtaccttgaaggccatgataaacattttcgtcttcagcctgaaaataatggaaagccactgaagcatgccaagcagtagagtgacaaaatcacacgggtcctttgcagggatcactctggctccattctggagaacagaaggaggactaatgttaatgctcaccagctagtcaggatgtttgtttttttaaactcagtccttttagttacactttatctcttaaggttcattctcttcctactacatcttatcataacttacttttgtgctactcaggcagaagtttttcttttttaaaactttttattgacagcataacggaacatcatgaaaaaattttgccacctgaaaaataccatattctcatttcttcaataaagttagttttacatttatagtttctgttactatattgttctcctattgatattgcaatgtctttatcatattccattgagatgtattaaaatttagttacgtgttgctccacacttggacatttaggtaagaagttttaaccgaggatgacagggatcagtgaaatgctgtccaaatatattcttttccattttgcagcaatagaaactaagttgggagagcatattctgccactttcaaccccaattatgtgaaaatctccctttatgaagaatgtaaagtctctgagtatttgtattaagagtaatgcatgttgcttaggctgttaaggaaatattgatttctgacccttaactgaaatacttagctttcatttttcttctttttacatgaattgtgtatattgtgttcccctcagggaaaacttaaaagcattttgtgttatgaaggctccattctaggatcttattgcttttgagatgaataaatggaatgcttgctatcactggaacagccctttttttttttttttttttttttttttaatgtaacaaggcatacaagtaatacagggctgaatttggccccagaacttctgaagttccaagccagtttcttacggccaaatttagcttccagctttcagttgatgaggagctttggcatataggcaatctaatttttgttcagtaaaaacctccttgggtgttttaaatataactttaaaatttgtattaccaggtgatgcttaagcatttcttagacattgactctaaataattgctcagaaaacaatgtgccttaaaggtgttttataccagccttcgaggtattagaatgagatgagttggcgccaaaacatttcaatatgctataaggagatgaaatatggccaaacaggtttttatgttctgattattcctttttcctgttactagccagaggcaggtaaatcgactttacatcccccacccccccaagcccaccaccacagcaattttatttttatcaaccccttaggaaatttcagagggttttttttttcctattctttgaacacatacaatgggaaaattaaaacttctaaaagtttcttatctattaatctgttgatgagatgttgctttaaacacattttatattactaattaatttaattatacatactgcagttgtattaacacattttctgttctctgctctaacgtgacacagtgccctcccgcagccaccttaacctaaagctttaattgctttctccttagcctcagctcatgtttgatttatctgatttctttgtataaagattctctagtttacgatgtgtacacagtcattaaattggtgttgatgtttatgcagtgaacttgccaactggttacagcggacatccctttatgaatttatgatggggcaataaagacaagtgtcagaaacctcttgtctgggaggggaatcactttccttgtgctatgttggagacagtaatgtggacacttccactgatttgtacagcaaaggataatgttgaaatccagattttctttcaaatcgtgggcactctctgatttcttgtagggagatttttcaaatattggcgctctttaatttcctgcagagtgtgtgtgcgtgtgcatgagacacacacacacaaatgtttgcacttttttttttttttgagacggagtcttgctctgtcgcccaggctggagtgcagtggcgcgatctcggctcactgcaagctccgcctcccgggttcacgccattctcctgcctcagcctcccgagtagctgggactacaggcgcccgccaccacgcctggctaatttttttgtatttttagtagagacggggtttcaccatgttagccaggatggtccggatctcctgacctcatgatcctcccgccttggcctcccaaagtgctgggattacaagcgtgagccaccgcgcctgaccaaatgtttgcatttttaaacaaaactatattatatttgagcattttaaccaggcattcaatctttgtaaacgtgactgtctatatagctaggttatttacagagtcagtgtcaataatccagaattctccagctataaaaagtaaatgaagtattaaatatttgaagacaagggccctgtatagttttcttatatctgtactttttttgcgaaaagaaaaaaaaagccaaaaagacattgttctcaagtcttaagttacgaggagctgcaatttacattgtttttcattatgggaagatcttcaaagattgtaattgtgagtttaatttactaacaaggagcagacatgagtcttcttgactgagaatgcaaacatactaatttaaaagtagatttatatgtattgtattagtgcttcctcctgtgtacatatactggtttgatctttgcccttttacttttcattagtatttgaaattagaagtcagaaaagttgattcttaattttcatatacactacagaggatttatctgtaaatattatttatttcaaattttcctatgtatgtataagtttgttctcatataaacaatacctttaaataactaaagaattaagatagaatgtaagagctcagaaacataggaagagtgagccaaataaggaaaaaacactttcgtgtttgaagaaaaggatggacgaatagggaggtggagagaaggaaggaaggaaggtgttccagatggttttgaaatttgtgcagtagaggagaagattctcaaatgtcatgtggttttctgaagagacaaaaacaggactttaatgttgatgacagagtagataaactggaagtgagatagtgaaattcatttttatctacatttcctctcaattctcaccctttatgggagctctttttcttcatcctgagaaaattcagataattaaatgcagttaagagtgcaaactaagagaagaaatacaacaatgtcccattaggaaggttgtggctgatgaaggcttaaaatacttgctaccacttaacaagtaaaaatgactgcaatgtcatagaatattcttcaaatgtctttaacaaaaaatccaaataaactagaactaaatgatggccggtttacgtttcaagatgagaaagcgaagtgaggaggactggttttgatctgcagcaatcatctcttcaatagatacttttttactgagatcctcaactatacagttctgagctaggcacatgcaaattaaagagttgcgtgaaatatggttcattttattgagaaccttactctttaccccccagtttctataatgcaagtactataatgtatatctctcctaaatgaataatataaatgaagtgtgacccagatatcagctgattcctttgactgcacaagtgaattgcttttaaaccaacatagccttgatgcaaaattcagccacttcatcagcttccttaagaaatccagtcatatcaaggattttgtgaattctctagttttgctgaagacttttagtgtcaaggggaagtgtcacatcacatagcacacgtatcacttgaaaaactccctttatgcaatctcttcccaggcctcgcctcttaactttaatcgcctctccacctcttctcctaggcagctctcaacacagcttctcagcaattcaggctgagtagcttcctgctttgacaagaaacttgcctgccattagaaacacaggcctgggggatttatttcaacccctatttttcaacccacaggcttatcaaagatccttttcaatagagctgattcttcctacaaagaaatttctaaccagcatctaaagaaaattttctccgtatgatttttttagaagcacagagaaagaaaaaatcacttcaaagtagtgatcaagaagctggatcttgaagaaatgtatatcaatcagaataggatttgttacgctgcttcgacaaatagcaccaaaaacctcagtggcttaacacaaaagagttgtttcttgggcacacaaaatcagtggtgagttcaggctattctctgaggctggctgtcctccttatacaagctcagcatgtaaagtttcttccactttgtgacaccacactcttaacaagtacctccatgattgcagcggcaatagagagggctaggggagttcatagcagcaagtgaattcttcagcccccaaaatagcacacatacccttaatcacagtcctttgtctagtgatcagttgcatggtcatgcccaattcatggggaggagaggtatagagggactgggaaacacagtgtatagaaaaaggggaggagagaaagaatggtgagattttgaatatctgcaagatggaaggggttttggtggcaataatagaggaataaaatagagaagacaatgtggtttggttaggattttatatttgtgttgcagagtagtgggatataaatttggaaagatagtttgggatattgtgaaaggccttagagtgcaggccaagaatctgttttattggtgacatggagctataccggttttgggaagtgtatgaatgatccatttgatgtcttgtgtacttgctaggtggtgactgctggggccaatttgtagtcaatttagagacatgaagatcagttaaagactttcttccaaatcagcttagtataaggaaaatacctgcattctggtgttcttggggaaaatgcaaaggacactgtcctaatccatcttccctctatgtgtgtcccagctgaagattcttttttgcatcctatctcacctcattcaattaacatacccttttaaaaaatcacttttaagacccaccaacaggaaaataagatgctgaataaccacacatcacaaaatatttatatttacaaatactagtgatatcatgagcgtttaaaatgtgttaggatatcgctatgtgaggatgacaggattgatgtagaaaactcccattacatgacagagcaatggaaacaaggaatgattctgatttatgactgtatttacccagtatgaataaataaatagctactatttattatgtgcttaattactatgtgccagacaccatgttagtacttacatcctttaacatgacccacaggcccaggatggtctggcaccagctacttctccagcccccatccttccactgagcccctctcactctgcagtagggctctgggctccttgccatcctgccttcctagctggctctgactacacttgtctatgatcaaatgtcaccttctcaaaatgctctccctggctaccctacataaaagagcagcatccccagttattttctatctctgtatagtgccttgtttgtcttcatgaagtttgttacccccagagagattctgtatttttcatttagtaccttcactccttgccagaatataaattccatgaggtcagagatttttctctcctgtaacagtgcctggcactcaatatccatttggtcaattaatacatgacttatttaaacctcataagaactctatgaggtaggtaccattaattttcctattttataaacgaagaactcaagtcctggggtgattcagtatctccttcaaggttttacagtaagtaatctgccaagccaagattaaaagccaggaccgtctgattccaaagcccctacttttagccataatactcgtctggtgatgcgatactaagatcatggtaattaaaagttactgtaaaattattccttgagaatgtgtatgcttgagccatttctctgacattaatatatatttattgaaaacatgataaatatttctatatgtatgagaaagtgaacttacttcccccttctccccctaaaaatggtgtcttgtggagctaatagatggtgatctcaaagagcgaatttgctcatatgggccaaatgtttcctcctgcagagtgggctgcttcccaaagaattagccctcctcaaaatgaattattaaccccagcgtcctggccaaattcccacttggatagcctaggaactgttcaaaacttggaatctattgaaattagcctggcttgattgcagtttctgcattaattgtgatataatagagtttctccagagatttgagcatatattattctaatgtgtataagctcactttgtctcttaatcttttttagtttcttcttcccctcgtgagatatagcctgaatttctttataagtttttgtttttgttttaatttcccagaatgaatgacagtgagctctttttttcttggacttgtcaaagctttttctcacttgaatgactagttagtctcctggtcattatcgcagtgtgttgcagacattagccacagaagtttctagatccccaactctcttgtgcaactatagcctgggctagggaaaagtttgctccatgaaattttcctaattgtttctttcaagtttcttcaagaagcttatgttctggtgggagacatataaatattttaaagtttaaattaactgacctaatggtggaactattcaggacttccatattcatcctacagttattggcttttaatttctttaggcaattttgttaaatgttataggccacttgtgttgtccatgagcagatatagtatcacttacattctggagggacagagaggtatgagtttagttaaattactaaatcttacacaaaactaaaataccttagaaattcattgccttgcattgttttgatggcaactgtagacctcatataattaatcacatcttgccaatatcacataattattttatctgtaagttgaccttgcttgccttgagttggtataatcaaatcttcagtgtaatagattatattagaatgggtaacatcaccaatgttttcatatccaaagtttctccctaatctatatgaagaataagaatgaagattttgttaaaagacaaataattattcctaggaagtagttagcctcatggattttcaacatagggaaagaaattgagaactcgaagcttaagttcttgcatttaattctgcctggatcacaaacaagtaataagtcacaaatgcttcctgcgttcggttctttacctttatcaagtgagatgagacaatggatatgagccatgtgcacttagaacttcagcagctaatattagaaaaatgctttgaaaatgacagatggaaagagctataaatgcaattgctaatggatttatgtgttctctctccctccttccaacctatttctgccagtattttccaaaaaatttcccagagctccacctgaagtgtgacctgatgacaccatagcacatgtgtttcctgagttggttgagtgtttccaaaatgtatctacactttaaattcaaatgtttatccactagggtattaaattatggaaagtgttactgccttggaatgacagtcatgtacttctgcccagactattatgacaagttctatggggctttctacaggtttttccccttctttctgaatcaatatgggctaatagaaatatataatttctcatgaaaaaaatccagattttcattaatgtaaatgaattgatagagaatatgcttttaaatctgtaacatgcagaatttttccctccccttgtcattagtctcctcccaactaagtggttctaactgctaatttgagaattaccggtaaagactaacatttcccttgctttccttgtgcactctaaatgagacattccctgtttcagactcaggtcaagcactgaagaaatattcattcccttacaaaatacttattgagctatactgctctcctagactttttcctaagaagctggacatacagcaatgaacggaacacagaagagaaaatccaagtgcttattagtaaatccaccagaatgtttcatttggcatttttttgtaaacatctagatttgttcataaagaaatcagaaaagcattcgtcctttggggagtattaattgttttgcaagaaagttatttatcttacaaaaggactcactttagcgaacagcaaattcccttcatgattcaacttaggatatttcaatttgcatttacttcagtaaagcacagtctatgttgaattcccttgctgacaggttttatgcttacaataacttagggctaatagtcctaaatgtccaaaagaaagtaatgtctccagagagtgtagttctaggttcttctataacatctttagcattccattcacttaaaatgaaaacagacaatgtgttcaggaacttatgggagagaattaaaagaaagcataaccagtcaaatgccaaaatgctaatttcaatctctgtttctacattgctccagtcacctgacttgttaaagatctcgcctgggatgaggcagctatccatcaatgttcgtagaattgtacaaataccacaacaataaaatgaagataggtttattcattccttgtagtagtatgttcccaggccatttcaaaattggctagttaggttggaaagaagatgaagactttataaaatagtggcttatgcatttcttccttaatttcctgtttgtgctctacactgtatgaaaattttacacctacaaatacctgaactgacaaagtctttcctttagtttctgctaggtcagacttggtgctaaatggaggagagtttgtcagtatagtttcctcagtatccaggtcaaatccaagtttcactcttttttttttttttttgagatggagtctcgcactgtcacccgggctggagtgcagtggcgcaatcgcggctcactgcaaactctgcgtcccaggttcaagcgattctcctgcctcagcctccctggtagctaggattacaggtgcctgccaccatgcccggctaaatttttttttgtatttttagtagacttggggtttcaccatgttggccaggctggtctcgaactcctggcctcaggtgatctgcccacctcagcctcccaaagtgttgggattacaggcgtgagccacagcacctggccaagtttcactcttatatggggagccagagtcctgagttgaatggtgatttctatccacacttttgatctctttgagataattttcattcctcctattaatctcttgctaaaaactatcctctcttacctcctgtcagtaaatgtcttcatttagataaagcataatcaatattttcatggtacatacatacaaatagtatcttagatttgcttaatgattttctgcttagagtctaaaggccatttctggcttatttcttgccatgtggcaatccttaagtgttttgctaacttagagaatgaaacccactcagcttctgttgcatgaggttatatttccaattactgaaataaaggtatttaaattaaatattttaatcatgtatatgattcagtcagtaacacatgagtagccaagatacctttaaacagtacttcaggctacagtcggacctttatgtctgcgggttccacatctggggactcaaccaattgcatattgaaaatactcatgaaaaaaaagacaacaaaaataacactgcgacagtaaaaaaaaaatgcaaataaaaagtgtagtataactatttacatagcatttacattctattaggaattataagtaatctagagatcatttaaagtatacaggaggatgtgcataggttatatgcaaatactacaccattttatattagggacttgaacatcctcagattttggtgtctgagggagtcctggaagcaatcccccacagataccttgtttcagatgaaaaagcatcatactctatgggtaactggttaactcaccttattctgatatatgaatgccattcacattatgctggatatgggtcaaacttaagttcttctgcgaaagccacaacataccaggcatcagaaatgctagagagttttgaccatcattcagaaaaacaattgtttaacagcaaccaacaattcaaactatttaacaggcaccagctgtcagaatgaatgctcaactaatcaaagcagttgctggccatagtggttcataccagttgaatttagctgcattaaaaatttgtccttttaaggttctgtttttgtggagacagccattttcagggcttcctaaatccttgtaagaaatatttttttgcaaatacagaattatttatttctaagaatataaagatatactactaatttctaatatacaaatcaggaggaataagaaatagctattgctttctatcaaatcttactgcttaaatggattaaaaaaatatggctggtgtataccttcacatgtttatattttaaatatgtccaccattatttctctttcttttgtccagttgatgaatagaagcaaatatagtagagagatgattagactattttctgctgaggtcaacttgtttacccaagctaagaaaagccttttctgaatattttctgatttttttgtccaaattaggaaaaaaaagccacatattaatatttaagtaaactataaacatattatcagcatgtagccttattttttgccaagaatacttttaattttatgtctgtactttcttttagtccgtaagtttccaatttatttgtatttactcagcattacattccattatggtggcaaaaggttaaatactatcaagtggtttgatattttagtatttaatcacttttgtcttgaacgagtgaatgtttagtccgtagatatccagatcatgaagatatgtatatttattttgggggggttggttatggtgtagattagatggtttatgatcttataattaccagaaaaatacatgttcacaggtatgatgaaaagacattttgaaggtgctccatttactaatcagttgatttcgtctatatacaaattagaaactcacaaagtgattttcttttatatgctcagaaatactttatatttaatgtattcatgcattgtagtttaggtaaaatagtaatggggcccaaagatagacaatgttgtggcagtaccttgctctgtctccatcttgatttagtttaactttcactgcagaggctgttctaaaaaaaagggaaggaaaaacaaattgataagataaaactgtggggagttccaaaacaaatactgctaactgaccttttttgatggcctgggtaagagctttcttattatggttggttattatagttgattgctttatttactagtacaatgcagaacaaaactaaggtaaacacttgggtgatatcttgttttactttgtcatattttgtggtagactggtaatgatgcttctcatgtgtttttaaaagtcagataaattctgaaacattttaagaatatgagactataattaaacagaaaaaatatcagctgttttgagcctgcctttcttagggtgttcgtctaagtgtctacttgtatgaaacactcatttatatgcagaaagaagctctctgtgtatgttagaaaaagaaagtagttctgaacctttcagccaagttcctaatgctgttgttttataccttagagttttctgtcttggtgaactttaaaaatgaaagaactaactcttattaaggggttgtgtttcctagccctcctgattgagactttctccataatatggtgcaagaaatggtcagtcactacgaaggttctccttttaaccactcctgtctatcacaagaagtcattagtttacagctacttccttcttgtttttataacttttaaacttatcattaaccccattctgttatcccatactctgagatgagcaaagaagatactatccacatttccattgcttactctagagataataacctttttgaaaaaaaaaaagataaccctcagcttctttaaacaacctcttcctctttaaatccatgttagctatctgttgtccaactagaccttcagtgcattcttatggtaaatcagacaaaattattcatagcataatctgtgcaagtaaaattgaacaggacatactgaaattatttattatagcttttaatgttgcttaataattccttaatatttgccccagatttttttcacctagacttttttttcctgttactaaagaaatgttgtaatggactaatcactaatcctcatttccttctaactcagtctcataaggcactgtgtctggacctgttaagtaggattgttgtcataagattagatacaagtatctcagttgtctagacattatataactctctgctacatacttcagactcttgttttaaagcaatcccttagcctatttaaaatgaataaattaaatgttaatgaaaagtccaatgcatttatttcttttccatagtgtgtcattgtcaccatctggatttgccatttcttcccagttctttacatgtataaagttttattcttgttttaagtaagagctgattttcactatttcaattttgatgtggataaaaagttggtattttctgcctctttgtgttcctaaatcttccttctcattttctatctggcttttacctccactaacttccctttctgtaattttaaaatagtattttggggatgcaaagaattcacttgtcaccttttcaaacttgattagttcaacacgtatttattggttacctcttaaatgccaggcagtgaactagcttctggtagtaaagtacggatagccagtctctactctcaaggcacatatggtctaatagggaagacagacaaacaggcaagcatttgtaatgcagtgtggcaaacggggaaagatagggtggcaaagaaagacgtaggatatgggtgttacgtaacttgcaggaaaaaaatctggatattggcatctataattcctaggtagaaacaagatgttccataagagtgttctctgagatcatgtgtgtgaaatttgttttcactggagaaatcagggacatcttaaaagagaggaaagccagcgaggtttggccaagccattttgcctccgtcaacctcagttttgttaggcataaaataagaagtttgagttagatgaccgctaatatcctctctaggtctaaaactctgaatctgagtttttcttttgcagttcactgaaaaatctaaatagcctaaacctgttttgaaatctatttcaacaaatgacccataaaataaataagtacaaaattcaattttttggaaaagtagtctggccgtagaattgagtggccccataaaatattaatttggtcatagtgtggaaatgtgaaatgattgttaaatgagtcaaggccttatttgtggcttttggctcatttagtaagattacccattagccatgtaggcagcataacatgcatggccaagcagctcatgggagcatcctaacaaatgttaaataaaaattatctttctctagccttgggaatatatttctgttatattcaaaataagattgtgctcagctttaaagtctcagtcaataggaaaataattatatttgttatgcttgaaattctgaatcttatctgcaatatttttgttgcctttttggaagtttagaggtaaaatgagtgttggtggtatcggaccatcacttaattccatcactgccattcatataaactcacttgattctgttagaatatgtatatgtaacatttctccttgcagatgtttttgtttctccttatcctaaggtactcaccttttttccttttagtcattaactttggtgtcttaagacattccttctccgcttttctattttatctacatcttaataataaatttaataactgttcttaaaatctttggatgataatccatcaggctcattcagtattcctttagcttatctacagaagagagtatgcttttctctttgctctttttaatgaggccttcccactgtggctctcagtatccaccaaacattttaatttcttaggatctgacaattattaacatctctcaaaccttttctgaattctataggaggctattattataattcaatctatttacttccatgtaaactcaaatggaagtgaatcttcctgaaatggtcactttcccctcctcccaaatatacatctgccattaaattaaaaaacattactaatttgaatgtgaagcctgcatttccataacaccaaacatctggatgaaaagtaaaaaattcagagatgttttcaaatatccgaatattgtgttcataaaacagttaaatgattgtctcaatctctccatattcatctgagtacttatgcatcttatctgtggcacagccagtcctttctgtcaggaaacagcaccaatttcagaactaatgcattcagtaacaagtatgtattgaacacttgttctgtaggaaatactgagctaagtgctgtagaaagtttgaggttaaataattctttaactctgccctcaaatgatttgcagtccagtgagggatgtgacacaggtgcacatgtatacataaaagacaatatgaagtgaataaaaacacaagagaggaggaaagaaagcactgtggaagtttgtggggagtgactacttctggcttgggagggttttccactgtttgaatgaactatgatggattagtagggcttggacatgccagaatcgtggaaatggaggggaatgttttgatcccacaccatttgaaatatactctccttcagcagccgggtaagggaattttactgaattcaaataaccctaaattagccagatgattgcaatagtttttgtattatttttcattatcacagcctttggttgctgtaaggttattgagtctaaatgtgtttttcaggtattttgattatcaaatttatattcatttcactttagagtttcaactttacacaaaaaacatgctaaaatttactctctatggtcattttaagaaacattgttaaaattccaccttgtcatttgcttttcgaatttagatacaaaatgttcacactttcatgtacattgcatgcttaaagcctctatctttcaaattttatgatttaaaaaatctattgggatcactactctgataaacttttaaaaaatcttcaattctaaagtttttgctatttgaccagaatctgtattgctatagaaattaaagcaaaatgaatcatttcttttttattcttttcctttttcttcttcctcctccttttcctcctcatgcttctcctttttttttttttttttttttaacaatcatttctagctggaggggaaaagggaataaactgaaaaaggtccacataatccaaatcggtctatgtttattattcagaactaatttattggctgaagtgactgaaaggtaaaaggtggttacttttaggtaaagtttataggtgtagaaacgatgttaggaatatattttctgtatctgttggctctgcttttgtctgcatgagcttcattctcaatcaagttctcttcattcagtgacaataatagccattagtaactccaggcacacattttactgacttagtaaccccagtgaaaaaacaacacttttaacagtttcataactgactcccattaacctaacttgggttccatctttaatgcaaacagcatgattatctgtgttgactggctaaacttgagtcacttagccaccactgattacatccctaaattaaaatcagggcactcttatcaaaaagaaaggggaagtggtatttcaattaaaaatattaatgttagagtggaaaagtcctccactaaatgttaggatagcaggtggttatcccaactcttaccaaagccaatttatatgacctgatgtagattatttaagccttgtgagcctcggtttccttatttacataaattaggtctcagatcaagttctgtccaaaaatctttggactcttttttttttttttttttttttgagatggagttttgctctgtcgcccaggctggactgagtcgctcggctcactgcaagctccgcctcccgggttcacgccattctcctgcctcagcctcccgagtagctggactacaggcgcccgccaccacgcccggctaattttttttttttttttttttttttttgtatttttagtagaaacggggtttcaccgtgttagccaggatgggctcgatctcctgacctcttaatccacccacctcagcctcccaaagtgctgagattacaggcatgagccaccgcacccggccccaaaatcttttgactcttaatgttttgtggttctgatttcaacagctagagacaaggatgagacatccagaaaatatagaaatttgaatatagaaacacaaatcaagagatacatactgtttcatgcagaagtgcttcaggtagaaacaggagttagcttggcagtagaatagcaaaggatttttactacatcctgatgtactggctagaagctcagacaacttgagagggttgtgtatatgtttgtcagagaaagagagtcagagagattcaaaattaagcatcacaaaccttgttattacaacttctataggtgttttatatcccatgtatatctttgttaaccttctctcattttaccataacagagactgcgtcccaagcacagtcttgtttaaagtaacaaagcttgaatgagaacttatgtctaatttttttcattctttctacaaatatttagagacactgagaaagaatgggggagaaatacaaaagttaaaaatcccaaggctttaccttgaggaagttatacttaacagagatataaataaagcatgacaatgaaaagctaaaaattatgaataccaagtaaattgctatgggaatttagtggaaaggtgattgtcctccactacaaggatgggattggtttaaaatatcttaattgtttcttgttttatcttcaaaattcacgaaaatatatattctattcatagcataggaattcttgtttacagaataaaaaggtattaaaaaaagaaaaaggtattaaattaaggaccattgaataagtttggcattccaggaagatgcgtttatttattcagggcttaagtccttggcatgtctgcctgtaccctattttagtaagcatagtcctagatcaataaatgatatctgcccaatgcatttttattatccacattagggaaattacttagagggtttcatgaatgagtggcatcatcaaaatgaaggtcacctggattaactctataaaatatatgccttggaggggagcaaagaaaaggaagtggtcatcataatgatcactttccatgcataatgatcagtttccacgcatgtactcaaactaagactctacccaacaagttacttgaccattatctaaatgattgtattacactatcacagaagtaacttgacaaattgtgcattgttcagtcagcactcatctggtcagctttgtagaccagcaagtgagtcagacttacagggtaggaaggtaacttaagaggcagaactgatcttggagatgtcttgctttaaaaaatgtccatgaaagagttaccacaatgcaagagaatatctcattgtataaaaaagttaagtgactatagtttcttaaagatatgaagtatataaattatagttaatttatatttaatttataattaatttatataattatatataattacaattaattataattttaaaattgatattatatttttaaaattatttaaagcagtacacacatagacaatataggagtatataaacaaaaagtttctactcgatgccctacacaacatgattcagtgtatatttttccagattttttttgcgctacaagcatagatatgtgtatattttatttatttattaatcagaaataaatgatacatattgttctacaacttgctttttttactcaataatatatggggacaaccttttcatgagaacctcacattttatttaactgtcatccagttgatagacatttaggttaattccaaatttttagccttccagatactagctttttcattcattgtacatatctaatttatgaggtgatttgaggtatcacttaaaatttcaaaacatcaatataaattcttttaacacagaataaagtttatgataaattggtttcagtttggatatcatcacagaggggttaatcacaaaagaagttgactattaggtggttcacccataaaaagtcccagtgatgtattccaaggatattgtagatctatttccatgtacttgacaaacctagttaaccccaaaaggaaaattaaaaagaagaaggcctaaggtcactatcttgaataaagatagcttgctttcaaatgagtccttagaagaatggtaattacaatacattttctatctacgtgaagtcataagccatacatgtcttcttagctttttgaacagttgtcagttgatattcaaagttagaggattgttgtgattgacttctattcaacagtggctttagaattctttcgagatgtgaaaaagtttaacctatgctggctctttcttgatgaggggaatcctaatcattgctatcaggttacaatgacgtgtgctcttatgagtaagttgagccacctctgggccactggactagagtgggttggcccccaacagtgaacagactaaactatagctttagtccaagaatatggaaactgacaacaaattattgcttgtggtctacttccagttttcaagtgcaagcataccaaagtttattttaaatttgagccagtcagacatttagtaatatacatcaaagaagaagtgaaggcttcccatgtttattatttcaataggatgtctgttctaataaagcagaagaatgcatatgatagatcatgtagtagaaatactctagttccacagtttggccttaaatgtatacatatatttgtaaattaatccaaaacacattgtcatggttccaattcctctgaaagctgattgttttcaatcccctttttaattttagaaatatagtggctgattgccagagcactttgaggtaaacagtccaccccatgtataaaaggggcatggaatcatgaatgttcaaaaaccacagaccattatttaaataagttaaagttattatggtcttccctattaattaaaaaaaaagccatctgtgcaaggtgaattttggtaaggtaccaatttttttaatgattgtggatggaatttgcaactgccttcatagtgaaagtacagctcagggattcccaagataaaatgcactgtttatgtaattctgtggccatttgactaaatttctaataaaacactggaaagaattattgttattcaatcagaatttacaaaatttacaatcaaacttgaaggaattggctctccagtaatctcccatttcaactattctgcttacaccctaaacctttatttcatctaaaccttctctctctctcgcttaaacacacatgcacacacacacacacacacacacacacacacacacacacacagagagagagacagacagacagactctacaacccacattttgtcaaaactgccttggacaaatgcatcacaacagtgaacagtgagcaagactaaacacacaaaaaagatcaaaaacactgcataaagaaacagcacactggaagacattaccaatgcagatctagatactcttgtgatgcatccttattttcattttaatttgtgctatttgcaaaatatatttctgttgggtaaataacctataaacctaggctctaaaaatcttggagggtcaaaaagtcaaagggtgcaactcccctgaatttggcaggaaaatgccataatagaaaggatttttacattttttttgccaccgcccctcccaccccaaccagtgttttcagtccattaaaatttgtactccaggccttttccagtttgaagccacactggcgtcagtgatgagcaatccttcttgtttgtgcagtcattcattatctccattaccaaaaggagactggaggacaattacattgtttggacgaatcagagtgttaggaggagtatttgtcatggtggcagagtgcagcacctgacaggcaacgattgatgaccaggaatgagtgtgagtgaccaaagcagcctcataggatgcaaattactgactgtggattccaatttatcctgttcatttttcttgcccgtgctgaagaccattagtggtttttgaagcagtgaaggggtcattactaatgtgggtagactcgaagcaggagggggaaaggaggggaaaagccttctgtaattacacagctttcaggaacaggctggaggccctagccaaaaaagtgtcaacacctcgcaatcagaaaaatttattttcattttatgcttaacccatattaactcaacattatcatctttctttgttaacatttgcagaatattaaaagcctggcttctatattaatacaaatctagttaaccccttttgctatacaggggattttgtttaacctaatggcatttgggtttgctaataagtaattgtgcgcattttggataatgtacgctattatagaagatgaaatacctgaagaataaaatcttagatgattgaaaaacattcactctctcaaatactggaatgattagaatattctgaatggaatactttgttgttcctaatgtcaccctctaataatgttgatgggaagtatttattacaaaaggctttctactttatgaatgactttgacatgctagataaaagtttacttttttgtttaagaaaatcagtgaatttagagcagggacctatttaatagacatatttcataattatgtatacccagtacagtgtcttttaaaataaaggtatgggtctaaactaacaatccttgattttagaatcagagaggaaagtgtcttgataatggaagaactgttcattataaatgttggtgaatttcgataggaagtgaagaattagaaaacaccaaaacctatggcttcattctcttattgttgtagttgaaggtaaaatgtaaaatttctatatgaagtattgcacataattggctccttttgctgtgtgatcattgggtgtgaccctgttagagcagtaacagtaacaatgaaagaatcttctgttgtcccataaaggagtcaacataaatatactgtaagtaaactgtgttgtaattgaatcagttgccatggcttacaagaatagttgtgattatatactacctcactttctaaacttttactgtcaataatctcaaatttaactagagaaggatgattatattgagccatctcacaaagataatttagaataagggctttacataggctgtctagggaggagagtaaaaggggcctgaaaccagttcctttagtgcaacagaagcgagttagatgaccaaaattctgacaccatcacaaaagtgctttgcattctgactgattaaagaaattgcataacttaaactccttgctttttactgctggccctacagagtatgacagaaacatggggctgctaatacaggtttctgggttcttgtccctgcccacatttctcaacacatgataaaaaagatgcaagtaggaaaatcaagccatagactaaagaaatcaccaacggtggttttattcttagaagtaagtgactctttcttaacttctgatccatcttttaaaacatttgtttttccattagcatccgtacccttccgaagagcagaagaaacagttagcgcaagacacaggacttacaattctccaagtaaacaactggtgagtgacccaaaaatcaatgtctttctcccatggctaaaatgagatttctaaataatggttttctctcttttttttttttttctaaaacaaatgaaatcgaggaggataacttctgtgtttctacctcgaggtgtgaaaggggtgattagggagaggaaaaggtaacctagggaaatggtttttgtaggatttattccttttctttttctctctccctctttcttttctcttcttctctatcactcttcctctccacctcacttttcccatctctgatgctttaaaattctcgaattgagccacaaattctgttcaggtcattcctattgaaagtagtcactccgcgggtttttgcacagtcctcatacggagttaccagttctggaaaggattcttttgtcttggctttgagcggtgatgtagatacaggctttttagtatctcctaatagaaatttatttaccctaatatttttttaaataggagaaaaggtttttccatttttgcgatttggtagattactcccgtgctggtgtatggaccatccaccctttgtacacggcttagagggtaactgaggaaaaggaggggcagaggattaaataaaatgatcacagtggccaagaaatgatataggaattacttatcaaaatactggcccaggttttatcagcagcttaattttgttcagtacattcttggggtgatgttcagattaattgaactgacagttctctttcaaaattcagggaaagtatttgcacggatttcaggccttatacaaacttaattacatggaactccattttatcattctaattccatgtagcagaggttgtatttacaaatgagaagtctctgcctttattcacagctttccttaatatatttatcaaagcaggttcatttacaaagtgctctatctgtgggatacaggcaggcagacattaacaaagcttttaggtttatcaggctcgctgcctgatgagctacccgagggtcaattgattttgtggttctgtgattcatttttttctcatttttctaggatcacaatgagagacatgcttggagaattagccagtttgtctgccttatctgtcaggcaatttttttttttcccagggaagtcaagctacttaaattggccacaggaactgccgttatctgactttaatgcaccctatagtgtggatagcatttcaattacaccagtaaccaaagcttagctgcagtccttttcatgcctagtgctgtacagaaagtgatgtgcctacctacagaagcagaaaattgagttgccttgcttctgtcagggtgattaatgcagaaataaactgctaacctgaaaagaaaggcagaaagaaaagatagacaatacagacttgaattcactttaattttcttctaaagattggaactgtgtacatttaaagacaccctttagaccaaaaacttggaataaaggcagtacatccccctctggagggggatgtgtatgtgattatacattgataggcgcttcatagtgtaaatatatatgtaaacatacatattctcatttatgttcctagcacaagttatcagtggtctgaaacagtaaaataaatgtattctttgttaactacaggagacttgtttgctctgcacattcttttatagcatactgattaccagactgagctaatatatacacattggtccatgacgcagttaacattgctttagaatcataatttttgtacatttgaggcaattgagggagcttgtgatgggaatttctgagaaaaataaaatttccgcatggatatttggcattgatatttgatcttgttctttttgaaaatactgttccttatcatccattacctatagtttttgatatactcttcgcacctgaagaatgaagaatttttagaatctacaatctagcatttcccacaattagacacctggctggaactggaaagaacacccttcctttctgaattccattgagccccaaggcatatacacggagttcagtgagtgtgagagtttaggtttcttgtttctctattatttgagccatatttgccacagaatgccaagggttaggatgtgacagtctgtcacacagcatacttcccataatacagcataaacgttgacacttctgtctctacaaaataattccatcttcctaattttcacacttccttcagaaaaatcctataatcctgccctcgggtccaagtcttagttaacggctaccgtaactttgataataaggtgttactcatgaggatagtatagcaaatacctctaaaaaactaccaagaatttaatgtagggcccaaacttctggggatttcagaaagaaatttgaaagtgaacaccacttattttagtgcattttgaacttgcccaatgccttgatgaagtcagcttcaaaacagagaaagctattcaatctactttcaaaagacctcacagtcactgttcttaactacaaagtaatcactaagagagatgagaagagtggactagaaactatttctccaggccctgagagtgctcagtcaaaaagcagaggggatcagagtgtagttcctaaacaaactcattcagtcagctatactaggaaataatgcccacttctccgattgagaccaggaaattaggcttgtgtgctgcaagatttgcacccaaggaattagagcagtaaaaaagcataaaaatcagacaatcatggaagacttgcggttctggttctgcttctcacttacctcttaatatagaaaggccacacaaggtcagggtagttaagcagcactgagaaataacatctgtagtaacaagcgatggaacatggcttcacgcacttgatgagagcaataagcaataaaaacagacctgttaatatcagccagtaatgatgaactttagaagaaataagcaaaaaggaagtttaggagataattaagagaattaaagatgccttgtgtctttgcagtcagtgctagaaataatcttaatggacttttccagtgtatttacagtagggagtatgcagaaagtgatgatgcaaccaaatccaaatgtgcttcaggaaaggagtgaaatttatgacactcagtcattttttcctacagttaactcttggaagtccataaatcatcaatcacctaattaagactttcttttaaaagatgataaccagatcttcaatgtgtgcacctcactgtcaaagctaatcacaagtgataagactcactttctatgctggtcagttggtggagagtcaaatcagctgtaaaacaaccaaagtacacgcgttaggagagaggaatagcaacgaaccaaatatcctcaacctgaataacctccttgcaatggaaaagcaaatatggtgtaatttgactgaatattgattaaagctctaaaggtaatatagcatgatgggtaagcagtcaggctcaggaatcagaccgtgtggggttaaaatcctggttccaccatttgatagatgtttgaccttcagcaattactaaacccctttaagacttagtgctttcatctgtgaaatggagataatggtcatatatatctcatatagttgtaagactttaagaaactctgcatgctaagtggtcagtatggtgctggcatgtaagatagctattgttaaaatagttaaaataagtaattgtaaaaatgaaagagaaacatgatttcatacaatgatataaagaagacattaagtagcttacaaataggaatggagatttcttccaggggtaaataggcatgtttaagggggaaaaatttagtgcagacaacttactgtgcataacttctgtattaaacaaagatagacttttgtagcttctcagatgatagttttttttttttttttctacagttctttgatggcagggaggtaagattagggaactgtaggaggtaagtggcttcaaataactgtgaaggttaggcgttttgaaagaaagttctggatattaacactctggtattttctcaggagacatacttataagcatttattgacaaaagacaaagaaggttattttttaaatgaggaaatccttgcttgagtcatttggtgagttgcatttatacacatctttagtaacagtaatcattgaaatagaggaaagtctttgacaattaaaatcctttaagctaaaattacaaaggaaaattataagacatctccatgttctcatgtaacttttctcagtgctatatcagaattataatattaacttaaatgttcctatttccagattaattttaaaaggaaggaatactgtacttttaaaaactcatgtcactgcagtaattacagcctagttgtataccaacaaacacaacacacagggtgacttattgacagtatacaggtatactaggaataaaggatttactttcttgatagaaggctgtctccaggcctccagataaaaaagcatgaaactgaaatttcaaagaactttccagttgaagatggttcagagagttcctttgtataatggcctctcaagctgagattaaatacctgtgtcctgtttgccccaccttcccatcaaaatggtctcacaacaatcattctacgtctaacagcttttaataatcaacacccactttgtatgacttcttcatggaaagtggcagttttgctttacctgtttccatttggccccattgatgaatttttcaagaatatataggagcttgttcaattacgattaaaggactgtgccgagagaaaagaatcagtttccctttctagccttcttctctttcccttcaggaaggctcattaaccacccaggtgacttggttttctaaggtgtgaaatggaatgatgctgacacaaaaggagaatttgtgtgtgaaaacatgttgtaggttaaaagtgctctgaaaataaaaggtagcattgttaggagaacttctcagccctgattaaaatatggacaggaactgagtggtagcctaaggaaagcaatcatttgcctcctggatccatcagcccagatagatttgggtgcccagatgcttttctttgctgcttatacttgaagggcaataatagtgttctaggtgggtttcaagacagagggtcagtttcaggccttggtcagtgaatctccaagcccaatttgaagcctaattagtaggaggcagggtaagtgctagaagaggttgcacttctttacagcaaagaaaagtcattttcaaaggtgtgtatgttgtcattccactgcaaggagagcagacaccaggaaatatgttgtgatattaggacatcaagagtaagctgggaattgaggaaaataatttcatagtaaacatatggaataattggccagtggtgcaagaaatctaaatgaggtacagagacagctggacacttttatctcaagagagaaaggattgaaggatagagtgataaaccagggaggtggggtcgagataaacctaaagggaacaagcctgctggactaaatatcctctctctgctcagcaatttccaccgcggccatttgttaaacgcatagctgccatcttcagtgattatttccaagtaacatctatgtttctgaataaaaatccatttgaatctcaagtcagatttgccaggtgctagattcattgtcagcatttaatgtgctgaaactgccgatgctgatgaaatgaatacaaaaaagctttggtgagctctaggtgaaaatgcttctctttcagatcacttcctatgccagaaaaatcagtggccgtggaaagaggcagagatgccaaggggtgtgaatccaaccagccccatgaagtcttttgctaaactagagcattttcttgccgacagtcactcatgggttgaaataactgggcttgtgttagcagtagagtttctaatctctttgcatctctgtccagtttccagtcattctgtctccatggtcatataatcatttcttggagacctacaattatttctgagaagaaaaccaaaagaaggcggggaaagagattaaaagatgttaaaagaaaaacacacattattaatgtttaaccagagggatcgccctgaaatttaagtgggtttcattttgctctgtctacaggaaatgtaactgggggtaaccagggcattgacacatggcataccaattgtgaataagaggaagcattaccgtatcttcccattttacttcctgcagcagattcatgaaattcccacactgagccgaacactggatgtatttattgtacctaggcagctgtgcctccaatccattgcggtgtcagaccagcatttctagacacccttctatcttgtagagatgggagtaccatttccagaaatttagattcagaccaaatttgggcaagcagctaagactcagcaagagccttttaaaagtggtaaacaaaaggagtagagggggaaataaaggaagggaatgccagcgaggggactcaaaggggaggtttgctgcaatcctttacattcaattataccagctcctttgtgctttttcccttttgctctgcaaagaaagaatgaaatatggttttcatagcaagctggcagcattatctcaggatgcatatttctttgctgggttggaatgccaataaggggagaaaaaaagttcctagtttagaggaaagtacagtgctacagagaaaacacaaaacaacaaaaaaggaatgcaacaagtttctgaaacagttccaaaaaatgccccttaaagaaaatatttaaatgagaactttttggaagataaaatttctcatgctgaaagtaaccattttttgcagagtctctaaatatggaaagaaatttggccaaaaacgtagaccctttttgatatttgaagatttttagaattatcctcctctctttcattgatggagacaataaactccagacaagtcctgtgttaggcacaagcctctacctacttctgcacttcattataccagtatttggatgggagacaaagtttgctcaaataagtcctttatccatctcaattggcatgatctacatggtttctcaaagtaacacagaaacaaaagtctatatttcagtgggttgcatgatttaaaagaatgatattgacttagcgatttacttatttttaaacaggaaaaaagttgaagataactcattgcaaatattacacaattatcccatagcaactgattcagtaagtattcctagccccagtcacagatggataaagtaaaattgtattttaaaaaaacatttttttaaaaaaggaattttcaaattaccctctaacttattttctagaaggcagaaaatagaaagggggcttgtaaatgcaaaatttaaacaagcccctaaattagaagctattgaaaggaaggtaaaaagatagatcagaatataccaatatcatattgtttactttctctaatttttttactcttaaaaataagagtcttgggggccatagcctggttctgaatcttcagtcctttttactatggtggtgcctttaccagtaatttttttttctcatttcttccattacccacagtattgagtagtctttaagttctttccaaaaattcactctcagagaaataagtgctttatgaatagtctttagaccagatcctctttcacttcactcattcattcaatgcattgattcactggagagcagccttctaaaaattacttaattgagaatctgctctggtaatgagtaaatgtaggtcctattaacctcgtgatcttgaggacttgttttgttgttgttgctgttgttttcattgtgttggatttttcaagtataagagagtgagcatcggttaggtggcgcttcctggtgcttactccaggaattccgcccaattcgcgacactcagaattgttccctctattctctaaataaggaaaatcattttctaatctgcaaaattattagaaacctgggtagaaaaatacatagagccttactttgtaaaaaatattgctttctccaagtctttttcctacttcactgtttttactgtaattataatagaaaaccttgtttccagttttgttttgttttggttttgtgcataaatcagaatcgtcattgctgactgatcattcggtggagattttcagctaactcccagccctcatccagaatccttaattctgcactcaggctgaaacacatgcaaggttctttctcttttttcctttgcaaggtaaacatttagagatatgagatttccctgtgtctctagatacactttatcttttagataagtccctgcaggctgaggtttcaggctgtttaatgtcgacctcctaagttccaaacttccttaaagcctttagataagcaaccaactttagcagtaattactcaaggagtggatggaatagtgaattaatccccaaagatctggattcaaatctacttcaaaacccacacgtgaaaaatctctttaatggtcttggcttaatggtttcaactcaattcttgaggaaggaatgggtcttccttgactaagagtatcttgtaagaatgcctgctagagaaatcctttttccgtgattgatagattgatctcctttacagagatggtcacagatgtttgtatacttttacctatccagtattgacattttggtaatttcaaagtcaaactgtcttatattttgaacctagattttggatattagttcacttaaaaattataaaacacatgctacctttcttgatctctgcacatggttttctaaaattcagaaaaatacgctcttccaaaagagaagattctgattccagtagtctgatggataagcatactcaacctgcatgcaacacaatgcataaggaggtgggcaaaatagtcatggtggtggtggtagtggttgtggttgttgttttgatctgattctcatagttttctttgtcaatgcagttaaaaggatgcacagggattcttgagtgcccatgggcaaatttccttttcataaaggttgtagaaattagcaccatggaatttggtcacaggtttcctgggtgacctgaggctgggttagttagggtaaattccaaatactttcttagccgtgagttactaaatcctgatagtcttggatctgtgtaactcagggtagctctttgcttggctttgctcattgcaggtttcctgttatcctgtgatgttcccatggattctgtgtttccgtgtttgtgttaggtggaatgggttgctgcagaagaagaatggagggggagaaaagcagaaactgcctgtggaatagaatggcaaaagtcatagggattaactttccttgtgattcttttttcataatgaaattactgaagcaatgtcagtaaacaggaaacaagtgatgtgtaaaataattagcaccaaagggaacataataggttacttattaaaatccatagatggattctatgaccccatcaagtccagggaccagagatcacatgactccgtgtgccttttctgaggtgagcaccccaatgcactttgtcagcttactggcttctgacattaaataagcttcaggtatgatttattgagtagccttttgacaggagtgagaaactgaaatcttctagtccttgctgagccctggctctattctcattaccttctccaagtattacatttagtcaaccgagttatgtgtagttctgagagaatctctcctgctcccagaagtcattgttccactcataataaaattatgctatcaatttgccacaagagaaacactggagttcactaaattattgccatgtgttttgcactaaagacaaagtgataccaattaaaaaaacaaccacccctggattctatttttaatggtgtgcagggaggagcgagactggctggcaagggaggtcatgtctcccttctacacattacaaatttcattttccttaattagaaaatggcgcttatggagaatgagcagggggtttaagtagggaaagaagaaagaaggaaacctgaactgagctctaaataatatgtcagaaactgacaacttgcctcccgcaagactatttcatttgaaagatttgctaggttacattaggctcagatagattttcctggaaatggggccataacccacagactaaaaaaatgccccagttccaaagctctgcagataaggcacatccatactttggttccatctcagcaaccagtacttgtagctcctacttagggtaacattttcaggatgctatatccctagggatttgagcatctgttactatgtaagagtgtcatgtccttagattatccatgggaaccaatatcctgccatcgcaatttatcttccacttgattaatgaaagacttgccaataatttggccacagaaggaaagcttacccgtcccataccctaagtaagtaatgcctgccaatttaccatcaagttagtgatgaggtgaattcagaattttagatattataaataagtcaaatcccattacaacagaaaatctttatacaataaaaatttccagcccaggcagtagttcactaattttaaataatacttttaatgacacaattttattaagcaattgtgggcgagccccttgcagtatattacaatgaattgtatttgttctgaggataaacaggtacaatttcttgagaaaattggcacatcatggagatggtatgattttcccaataacaccagtaaatcattaacaaattaaaaaaaaaaaataaggacctctattgctagaccttcctagaaactcttccatagcccaatagcaacacttgcaaagacagcaaaatggatccaaagagaaaatggttctcctagacatcacaccagaataaaagtaggttgtgttttatgagtgacagccctgacctttggctctgtttccaaactagttgaccatctgaaataattgccagattgctttgggattttttttctgccttttatgtgacaaagggattattcagaaccgcagtgtataactcttagtaggtatgcataacttttcgttgggttgaattcaaataagctagagagtgggctggagaagtaaacatgcatgaaagccagttattgaggtgagagggtagctattagcatgcattttcttggaggagattagattggaagttagttttgaatcaggaagaactgttttagtagtcatatggaaatagtacgagagaccatggaagtagggaaattgagtaaaggagtctgggaggaaccagctctgcctgatgagagaaagacatttgcaagtgcacgaggtccagtgagaaaggctgacacccctgtccacagagctgcagcggggacagcatggaggaaggttcagtgtttgacaaaagacgatgcagtgtggtgcgtgaaagagaacgggctggacatcagcagcttgggtctaattccagctcaaacaacttgtgtgatcttggtcagtttagcctttctcagtgtctattccctcgtccataagagaatggggactgggtgatttttaaggtcctttctatctttaaaattctaatattttatgattctaagcctgtgaactgaaaataaaagtctagccaaagcaagtgagaggaaaaacgattttaaccattgtattttgaattgattagaacaagagatgcagaggccagtcgtggtagatgataggtgacttacacagaacctgaatcagagatttagctattaaaatgaagaaaaagaaaccgattttatctctattgttataactgtggcaggttttggtggctaattcagcatgggacgaaaatagaaaaaggagctacaactctgggctctggcccctgggagcaggggcttggggattctttccacaatgacagcagatctgagtggggcctgatggtttctctgggaagatgattttgttttcacaataggtagcataaaataaagatgagccctgtagggaaagaggtcagaataacaggaagcactgtgggaccgcacaaggggagggaaaggtaggtctgagggtatagatgttattgcagtcctgggagcagatgagctcatccagaaaaagagaggaggctttggtgacagcgggtgcttggaggagcttgggtcgcaggggcaaagccacactttgatttagagggtccctgaaaaggacataccatatctaggcatagaggaccttcctaaggcagaaagctatatagaaccaaatttcaaacatcgtttaaaatctccaactgtggaaagaccaactagggttggagaaaaaaaaagtttgacatctatttaaagcacaaaattcttcataaaaatggaatagtaggcaaagtaagaagcctgcctttcctcttgcaagtttacataggataataaatgagtaaactttttgtgtcataaaaattttgactcaaatagacaacccccaattttccatagttgtgagggtaaaaagtcttttaagagtgtggaattacatcatggtttttttttgtttgtttgtttctctttgtagcatcctgatccctaacaggtccacagcaaaacaacaacaacaaaaatcttcctaatagtatgttgttgatctggctgtggaaagcatagacattttgctgtgggtgagttccactctaaagtaatttgcttcaacagtgaccattcatacaattttggcttgtcactttcatagcaatttataaatttttaaaaggcagcagtagtgaaaaatgaaataccatcttataaaaagtatatcttatttagcttttatgtagaaactgtgcacagtgccttatcctggtattttgataagctgtttcttaaatcccttcttgcaaggtagatacccctattcagaagagcaaacaaactcacataccaggtcaaagttacatgtagcgtttcacaaaaagctattgaatttggaattattgagatgatcagaccaaatgatttcttcacccagtcaccttcatttgtcaaggttgtctagagtgactctagacgttgatattttgaggactgtctattttgttaattcctgaccaaacaacaagggagggacaaatttgagaatctgcaagtcactatacctttgctatttaaatatataaatcagtgggacatttgtggtgtacctccaatatcatatcccacctcaaaacacagtttaatcagtctttccttcacccactcactaaacaatctatttcctaagggcctctttcatgggttgcttgttcaccgtttgtgttgacatattgttattgccaaagttcatctgtatcaagaagtctttcaaaaataagcatattccttgtcaggtcttctcattggttaacactaatacagaggaacccttggatctcaaacaaatgctttttaatgagtttgaaattcttctgaaaacagttatcttttccccttgaatgcaatgaatgaatcatccttgttatccatccagtcctgactatatttggagaaatacatgaaaattgtacaatttcctcagaaaactgggcattcataataaaaaggaatagtataacaggttgagtcattttatgagaatatgttattttgtgactcttaaatctttatttaaagaagtgcattgaatacaatatcaaatatagtcagttcataattacagtagaactacattttataatacatctttcacatggttctcaggaacacattcctctaccaaaactcaattgcactcacttttggacaagcctgtgctcaggaaaggagaaatggttgtttaccatcaactttatagaaactgtcaaactaactgaagaaaagttttgctccattaagaaaatgcacctccctcaggagatcgagaccatcctggctaccatggtgaaaccccatctctactaaaaataccaaaaattagctgggcgtggtgacaggcacctgtagtcccagctactcgggaggctgaggcaggagaaaggcgtgaaccccgggaggcggagcttgcagtgagccgagatcgcaccactgcactccagcctgggcgacagagcaattctctatctcaaaaaaaaaaaaaaagaaagaaaatgcacctcccactccttgcaggcagaaactgtggtcgatttgccatccaagatcctgggtgcctgccatagtgcctggtacatagtaggaaactcacctaatacttatcgaataaatgcagacagagcaagtaaaatatttgatgtctgtattaaaagatgccctaaagggtcttatctgagcagcaaaaactgttcaatggtactaatgctttatttgcaggtaatggggaattcataatgtaaaataatattcctgtcaattctgaatagttgcttataaagtgaagctcttaactgagctaaatattggctaatgtaaataaaataaattataagtgggaaagatattttagataattgaacctaaaactctaattttatttaaaaaaaaaaactgagatacagagggggaaaatgattttctgagggcattagagataaagccatagtcaaacagatcaaggccccagatccagagtcatttctaatacaccacacactgcctccaaagttttttcatttcaattgttaaattatctcagaaagaaaaaaataatacattaaaggatgcagtatgatcatatgatgagcttcttttctacgtaactttatattgctgttgtaaccttggttttaagaaaagttaaagctctctctttcctgattattattagatttttgtgttcatgaatgttttgaaaaattaataactaagacactgaattgagatgttttaaacaaattttattaaatgaaatatttacagtccatccaaatggatatttgtaattaaaaaaaaatgcaacatttaaggaacctcaacaagtcttcaaaaaatttagtttgggtttgggctgaatatattactggatggcttttggcttaaaaattgctgtatgcagaagttggggagggaggctgaacaaaaacatcataggcacatacctagattatttaatgaaaagaagaatttctcctccgctaaaaaaaaaaaaaaaaagaaaaaagaatttctcaatctggaaaaaagataatactaactgaaaacaagctaccattggaaacttaacaaccagctaagtggctcccactaccatactgaatctgtgaccttggactctaaccaattatgaagacccagggcagcgagtgaacaaagcaattacaatgggagtcaaactattaaggagccaagagttcagtagctttatgtctctgccaaggtatccctagaacactatataataggaattgaataatattaacattcccacatggtagtttaaaacaacttacaatgtattctaatccaagcagatttttcattttgatgactatgggagtggttattttatttttagatgtacttttacaaacatctaaattgaaataactggtagcataaaattgccagtgatttagctggctatgaacttgtaaccacatacacttggaagatttttctttctccctttagctctcaggtaaatttcactgcatgacagcatttcatgctaggcaaagctcatacaggagatgaaaaagcatgaagcataacaaacatcacaaagccagtacaattacttgtttataaagaaaaacaaggaatgtaagataagtggaaaggtgcccgttgaacggtattttaaatgccttcaagttaaaaccatcagggatcagaaagcagaaggcaaattctagaggctagtacaccaagggaagaggctgatgaattgccttgtgcacgttttaattaaactatcatcttgagaattttttgtgtattgatttgcacagtacttaaaaaagcttcttttccccctacctccctcctttgaatgttaaagctttgtgccttcagcctgactctatgaaaagaaattactcatctttggaattgttacggaggaaaaaaaaaaacacaaatgggtggatatgttctcctctccttttcaatatgtttaaatttcaactgttcatataattatgctggcatgtatttcttcctggctctagtcatgcagaaaaattttaaacatgagaaattggacaactctaatgtggtgtaaaatctacttacgcattgtatttctttcaatattcgttaccaatagtatgcacattgttaaaattaaaagaaaatgttagcttttatgccctaatgcatttatgtgatatgcatagctgacaaatattttattaatgttgaaaagaggaagtttgaaaaataaaagaaatgttaaagataggggtggcttcaggcagaggtgacagtgacaaccatttaataataatcaccacttgtatcgcaccaattagaagagcactttaccaacaagacttagtttcctaacacccttatgagttacttactcttctgtacagagaagtaaaccaatgcataaattgaagtggttttctcaggggcttttggaaagtcatataaatagagtcaaacaaaaagcgttaggatactcaattcacaagtcaaaatgtgaaacaggtagtacgatttcactgttaatcccttctgaataagttaaaaatctgtgtctccaaatttccgccccccgcccacccccaccacacacacacacatacacataaatgctaaacaaatgggaagaagaatacttggcactagagtctgggattcattaaaaaggattatctctttctgaggtatcaatttctcaatggtctctaaaccatgcaggttatgtaaaaatgcaaaatgacttgatggaggagattaaaattccatgatgtagatggagatgtccttcctcagtgactagattctcaggcaactatacatatatgtgtatgggtatgtatgtatacacatatccagtctttgtgaatagtggccttgggaagaccctctaatttttagggcttttttcttagaccacagaccctatagaaagccgcactgctctgatgctgagatagtgttcctacttgttcaagagtgagttcaaaagtgagcctagccacctaattttcactagcagcacagactggaaatgcccagcaggattacagctttgagactcactctggagtacaacagactatcccgcccctctcagatcagaccctaaagtctgttctaaaattgtccactgtgggtgctgagagaagggggcccaaacatagcgtgtgtttcatgtcaaactaatgggctaccctggagagatttcagagttctcatttgtttactcacttgggccctcagtcaaggtctgatctttggaagagcaaatttttccaaattttgaataatctctttctagcaagaggctatgaattcctttgtccatcactttttggctactcggagccaccttcaacataccactcaaagcttttcctcatttaacaataggctgtaatatactagttctgaacctttgctgggtcatggacttctctgacaatgtaatgaaacccacatatccccagaggaatatgtacatatagacagacagaagacagacagacacacacgtgcacacacacatgcacacatacagttttgcccacaatcttagggcccttcaatggaccctctaacaattaaatccaaaaacaaatgaacaaaagccagcaacaacaacaaagaaacttcctattctaataagtttggtggaaatatgttaactaatcttaaaaaaagaccataatcactattcctcattttcttggtggatgaaatttaaattaattgaatttttaaaatggcaacagatggttctcactttattagattttaaattcataaaattatgagcaataccttttggtttgttctgtatggtacagccagggccactatagaggcctgagcactctgtacactgcacaattccagggcgcatcatatgcacagacaacgctgtgatcagcaccttcagagtcatgcaactcggcatctcttatcaatgtttaacacatggatattgaatggcaccacccaacagcacatcaattttagcaaaatgctatttcagtcattagcgattaagtctgctttggttataattattctcctctaaatggtgacttttttcctaacgtttatctctgtatgttaaaaaaaatatagtatatgtctaaacagccattagatcttaaagaatatcactattacacataaacttttcttccttggtgagcttcatgctaatagggattttgtgcactgcctttcagtgatttgtcaccaccttagcgtccctctttgtgaaatgtctgattatctgcatatctgtctattaatttgtttatctgtccgcctatctatagaaattttaaacggtgtaataactttaagaatagcgacactaatgtagtattagattaaaagaatgttactttatatgggtgtaaatgtaatttagaggcacttagagaaagctctatacttagcatgattcttggccagtggagacaggttgatcccactcattttgggattgctaatttgtcgttaattaggaagattgattctgttctgtgatgcataggcccaaccccatatgcatttttctggtttccggggcacttccctaattgccattgttgtttcaaatgtgcaacaatgtcacagggccttacaaaatagaagtgctttgtggcttctaaaaagcaagcatcaacgttgtttcaattttgttgtatgccattaagattatgctggtgttattttgaacaaacttctgcttcattccattccatattttaaaagttacaacacaaaagctgtattctgatttgaattttaagtgaaagaaacgccttggtagcaaaaattctttactctgttgtcttgaagtaatgtcagcctcagatacagtagtacacccatcaaggttgtgctattctgtacaaaacagcatttattttcaatatgttaactgtttgtttgtcttcccccatgatatactgagtttgctgctataggcttttttcttctctcctctcttggctgatgacaaattttaatcatttgactgtccttcacgacaattactttaagatgagttatattttctttattggaatgaagtcagggaatctatcaaaactagtgaaaggaaattttctaggaatgttttcaaacatagacattaggaatgggctgaaccaatacagaaaaaaatgtggaaacttgggagtgtgaaggaaaccacttactcactgcaattttgatgcctaccattgccaggcaggtaactcaggcaactttcgaactacgtggtttatttcagagtggtggaaactgggtaattaaaaacaatatcaaacccacaaagagaggtctaatttcacttttgtatttcacctgctatataatgtgatagataaaataactcatgtttgtacttatagaaagatgtgcgtatatatgatgagcatacatgaacagtatatgtttacatttaaagttagtgtcccagtcttgtatctttcctcttctttaacaaccttggtattttggcaaagctttcgtcattttttttgcttatgacttcagaaacaagttggaaattcttttaatgggctacttttaaatgtgctaaacataacctcagaaacaaaacaacaaaataaattaaaaacctagacgccgaggacatgggaatgaggaatgagcgataatgcatatcgctcatcgagggtctttaaacctatatgtttgcaccttgtcagcgtaacttacagctttaagtgcataaaggaagagcctttggttgtgcctttacccatggcttagtgacccttgccagcctcagtgacctctcctggtattactgggagttctttggtggtactttggcagctcctttttatttctgggtgacccttaatgttttatataaccattccttgtgcaatcagctctacatatctctgtggtttattctctgtggataactttttttttctctctctctctcttttttttttttttttttaagactgagtctcactctgtcacccaggctggagtacagtggtacgatctcacctcactgtaacctctgtctcctgggttcaaacaattctcctgcctcaacctcccaagtagctgggattacaggtgcccaccatggcagtcggctaatttttgtatttttagtagagatggggtttcaccatgttggccaggctggtctcgaactcctgacctcagctgatccacccaccttggcctcccaaagtgctggcattacaggtgtgagccaccacaccgggcctctgtggataacttttaatcctcaactgatttcttcttgacaaccgatattttctgctgagttgtcacctctgtcatcaatctctgtatgtttagaaaatccaaaccaatcctaatattagcccacatcaagtataattggagaaataggtttgctgcctccttcaaaaccacatattcagtctgcccactaatgttccttaagcatctaccattgcataaatacctgccatggtgccaggagctgtgctaggtgaggtctattcagaagtgggacaaagcggaccctctgccttcatggtgcttccagttcagaatcaaatgtaaatgacacaagtacaaaactattacatcagttgtttagaacttggagtgtattctccctgaagtttaatgttatagttatatgcagaggcccaaacatgcccacaaaagcctacacaatactctcgtacaaatttcatctcaaaatgtagggaaactccatacagttgggggagaaaataaaatctaaaatgagaaaaatagttgcatgcacaaggaagtttatactccatacccacaggtcagagcagactgccttggccagagctgatatttattggtctttggaagggagctctttcctttctggttcctccacttcttccttcatcttactgactcactacagtgaaattcagctgttgaaaagaatgagacacatgtaagtaacatgtctttaagttgagagatttcttatattgatatgaatatttgattggtaatatgtctgcaaatatttataatgctaagcgctagagagacatcagcaaaccagagttgcaaccctgccctcatggagtttccagtctattgaggaagacagaagagttatataattagttattgtttgtttttatttaaaatgtttataatggaataatctatgatcatttagacatgaactgtgagttattttattttgcttttctttctttcccttctttctttttttgatctttttttataagcagtgccactcattttccaagagcgtatgagggttaatggtgcagtcctcagccatccagaatgaaggaattggcccacaggggaagatagaagatactattttcaattggttctaactaagccaagaaaaacaatattgactgtgttctaatcataccattctttaaaaaatatctaagtactcttctatgttatctaattgttcctcagaagactcttctcaaatatgggtcacatctttttaaatctccacttatatacaagattaggtaacagagggtacataaactctctgacattacttagaagaatagtttgcatacacacacaggtagtatttggtactttttcttaaatcacttcttatgaagaggcagtaggatacagtagaaaggagagattttggaacataaaggatgtgagtttgcatctggcctcactattaactatcggtttggacctgaacttggtccctcagcttcctcatccatcaaactgggataatgattttgattcagaatattactgtgagaactgtatgacagttggtaggagctccaaaaagtaactcttgttactgttgttgttttaattgttgttatgtcacattttctgttctccgtctattcctggaaaaaccctgtacatttttctgcatatggtaggagattaataaatagcattatttaacagatagcacagaaagtgaatttcaggaatttcatactccctttctgcaaatagttcatcttactattatgcaacgtttttgtttttcataagatttttaatgcttttgatgctggagtattttcacagaggcattctgaaaataaagacaaatgcctctggtaatttgagcacttcatggcttctaaatgatggtggtttatgtcacagcaaaatggtcatgaaaaccagaaatcttggccggctgtaaatatttttttcagcagtattttttccttcctctaagcatttgtttatttatgttatttatcaaatatttaaatttaaatacctgagttttataatgtgtaccattgaggtacaaacagctgacaggatctattacaggcttctaaatacagagaaaatgacttattgtggacatcctaacacatgtagagaagggaacagacattattttcagagatttaagttaacattacatcccagagagagtttccttggtcacttcctctatagtctattgtttcttatattaaaatagaaacacgttttctcatccctccgactgtcatatttcttaaagatttaaaaaaagaaaaaggtgttaacgtcaagatgctgtgagagaagcaacacatctaatgaactcatacagggctcttgaaacagtacataacatctcctttcaaagattaacaaggtctgaagatgagaataaacaacatgtagatgttattttatggtaatcccactttgcgttagtttctttttttcctttcaccttattttcccatcagagcccttccttccttcgtttccttctgcccattcttgccttttttccaggttctctacctgcctccctcagatcctctctgtggaaacagttcaccttgcttcctcaggccacttatttctgtacccctggtttatatgctcccttacatcagacccccccatcatcactcatcagaccctctctcatcttcaggggggctagcctctcagcaggattggcaggccttgcaaatcttttggctgctgtaataaaatctccagttgctgagatttatgaggtcagatgcatgtagaagaggaagcacctacagttcatgaaattgtaaagaatgccaagcacatcggtaggaagaaaagatgcccaaattctggacagtttgtatttttgccaacctggttcgtgtttcccttaaatttatcatccaggtattgcaggtattcaaatggccaattcagatgctttttggagctcttgagatatccgtttacataattaatagaaatataccagcaggtgactataatgtgattataaagtacagtcctggctgttggggtgtattgaatacttttaaatgaaatatgtggagtgtgtgcacgcatgcaatgtgtttaaatgaatgcagcctttccaatcagccagaaagagagaaaggatgtaaattgctagcatgtgttgttcaaaatgcaaaagtaggaaagcaatattgatctgtgctttggatgtttatttacatcagttgcacagtgttaagatgtctggccataattatcaagacctgcccacctgtcaaaccgcaattgggttatttccccattgtcttgcagcagtaaatcttcaggtctggatgggcattagacaaatggaaaaaggctactttcccagaacatgtaattcattatggaaaacaggtgcctgctgaagatttttgctttaatgcagacgtattttattattcataaaatattaatgtgaatagtcaccaccagagtcgtgtgggttgttttcatctaaaattttcagttttaatgtgaagagagaaattgtaaggattctccaaaccttgtttttttgaaaaggtaaaaccattccataaatagtttcattcccttgctctcccaaaataggttccaacgaccctggctctgacttacataatgtacaaaaataagtctgctttaatgttgtatgcagtaggtgttctgtccagggacaaccttgtagtagggacagagtgacctttcaagaaaaaaaaaaaaaggaaatgaaatatactttcattttccagaaatatgcatgcaagtaaaaatttgacagcctggaagaacataagcaaatatatctttttatttgaagataaaaagaagcggggctggataggaaagggaaaaaacctgtgaaaaaacggatgatgcagtttttacgaataagcagcttaatgtatcttggcacccacagtaagccttgtaggagctcaaagtgcctcaggcaatctgtgagcagaatagcaattttattactttgtcattaaaccaatttcacagcagtattgtttgttaatgagcagcggcaaacgagcgaagatgtcacacactggaatagcagagagatttgtgacccaagctcacagcactaagatggaaagaccacggctataaaaaaggaaatactttgggatgaaatgcaaagtctatacagcagagcttgtgtttatgagctaccattttgctaagagctgtgagagaaataaaggtctggaaatatgcagttaaaacagggcctataaaattaaaaccaaattaaagtatagcagaggattactgcacagactgtactcgacaaaatatattttaagtgacgaggtgaaatctaaatcagttttgtttgaatttggttggtatttatgaaattcaataaaaaaaaatgaaaaaatatccaaacaaagcagccgcctcacccttgtgtggtctctgagccataaacgtgcatcactttgaggaaattcaacttgccaatccttaaataattagcaacttcttgattcacagggtgcgcccctccatcttcatgaaagccttctctgttactttatctcttcgtaaggacgttgcccatgtataataaacactcaggcggagccctcatctgcctgaggctgggagtcaagtgcacctagcaaggctggaattgagctcatcatttgataggactttctctttttttctccttttttacttttctttttctctttttctttctgttcctgttttgtttttgtttttgtttttttgagctagggctgcccttacaaagaacttgggagacagccttgagggatacaagaaacagtgccagacagtcactgcatccctgcaaggcgtcccgaggtgagtgtgctgcccgggcggtcttgcagtgctgatgcgcaggaagaagtagttcaggccaccagttctggcatcagactcacctactccagaagggaggatggggtgaaggtgggagcctgagaggaaattaaggaaggtgatgatcaatccataactgtatctccgtttgcaagagagattgattagaaatatttctggttgtcacacttgctgcggagacaccccacttctttgtcagggaaactcatccatttggagttgagactgacccgatttgtggggcctagatgctaaaatgtccagaattgtgcagggattgattccatgggaaagtcccagcaggtccgctcccgtaagctcacagccagtcatggtcaagttcggtgcctcgtatgctttgaggttcgcggcaagtctatgtagttaactctcataacctttgggacgacaggccagtcctcactggcgccctttataattcaggttggctgcctatgtgtatttcatatttttctctcatgaccccagcttggattcttaaggtctttatgaattttaaactttggtttggttctattgttttctctgctttcttttctgacaaaatttttaagtggtttttggactgatttggtgaaagggaactctgcaagaaatgttcatgaccgcgatctcagccgtgcacacagtggtgggagttcagctttaagactgttttctgcctgacagggcaggacccccagacaaatcactggctggctctgtggtagttggcagccattcaagactggtcttgtgccaggagtattactagatagccagacagatcaattcacttttatattcccgccattatttatagcccactgtatatctactcttgcttatgaagtaatgattagcaaatacagtacacataaaacatgggcatttgttctggaaagggctttctcctgctgatattgcagatagtttcacaggtcacagaaccttaaaaaggatttaaagggcatgtcttgtgtagcatttgttcctttgaaaatgatgctcctttcccattttttagtaattgaagaggatagaaaggttttctcattgcttacgtttcactgaattctctgcagccccttttcccacagatgtttcagccaaacctgtatggagggaggtgacatggcatggcttgctgtttaaaacagctacggtattttgtgcttcccttttgagtgtgtcaaggtgaacaaaaggagagcctctagaacgcatgggagggaatttgggacaggaccttttacatgctgggggaaactgacaggactcagtgaggaaagacttttgtttgtgttttcttctctctctttctctgcagagcgcatgatctatatcaacatgcttcctggtcatactaaagaatctcagctagtggtgatctaccagtttctgtgaggattattactgtattaatgcattttgggaggtgttcattcagttcagagtgaatgctttggaagacattgcacagcttgaatcatggggcatcagggatagcttgacttttcctgaaggatgtatggtggccatagactagttggttggaagcttgcattctgtaagcctggtatcaaatgcacacattaagccatgttttcctagcagaatgaacatatatgacaaaaagtaaaaagaaaaaaaaaaagctcagaaccttagaacaggatgatatcatcagaaagaataagggaaagtaggccagaattagaaaacatcaagatcattggaaaactgctatacttgcattgcttcctccttggttcattgtacaatggccttaattcaggtgacattgcaagtaccttttgtgccctccagaaattaagcgcattttgtattgtgtgtgcagcttgtttttcttctgttgcagcagacaaaattgtgacatattattgctaaggagattgacaactcataagaataaatattgtctgtgggcaagatttttttgtttgtttccagagaacattattaatttcagattatattaaagacttacatggcaggagactttcttctagataactaaaaacactgcgtagaaagttatactatgtttggccgggagcggtggctcatgcctgcaatcccaacactttgggaggccaaggcaggcagatcacaaggtcaggagttcgagagcagcctgatcaacatggtgaaaccccatctctaaaaaaaaaaaaaatacaaatattaggcgggtgtggtggcatgcgccagctactcgggaagctgaggcaggagaatcgcctgaacccgggaggcggaggttgcagtgtgctgaaatcacaccactgcactccagcttgggcaagaaagagcaaaactccatcacaaaaaaaaaaaaaaaaagaaagaaagaaagttactgaggtttccaaagggacttacagaatttcatacagaaaacaggagtagaggtagatactcctcaaggactttttgttggtttgtttctgcccttttagatgaactcccgtaaaatgtaacatttaaaaaaaaaaaggatcttagtagttaaaacgtaaaatgaggtgaaaacaaacaaacacacacacaaaaaaaccttttgattctgtataaaaatacctctttaccacactatcttatattttatagccctttacagttttcggggcacttttatatatgctgtctcacttgattctcacatcagctctgtgaagtgaacaaggtttttccctttttacaaatgaagaatcacagactcttccaggcttgagggcttgttcactgttgcaaagctcctcggggtcagactggaactaaacctttaggttctaacagaccaatgctctcccttctactccttccagttcttttctatgtgctgcgttatcctgtggaaagagctcagtttaattttttaagattgggaaggcaaacttgccagacaaaaatgatatccctaagccaaaatgttatttaagcatattcatttccatatcagtccacatcagtgaacatggaagtccttggatactctgggaatatctcatcatgtctgaccttggagggtgagatttcccacacggaagccctcgtacgtaagggcaaactaagtcgatgtttaaatcatcatttggcttcctttggtttctctttatagctgctcttcctcgagccttccaaccagcacttgagtctttgtttcttgttgttttagtgccgactatctaaatgtagtcatcttgacaggaccactcacatttcatttttttttttttcaacaatgccaagaggtcactagcgtatcaggctccacactgtgttttaagtatggagttatgctaagtggtgctgaaacacaagctctgggaacaacacaaaaggtgggggcacactttgggtgaaccaaattctttcccactttggatcaggagaagacagaccgacagtgaggcagaaagcaaccttcaactcccaaagttaaaatcagagactactaagcgctttggtgtttttccttgaaaatgctaggaagatcacttccttgaaattatttcaaaccacatgaaatagcatacggtatcaggaaaactgagtctgagtatagttaatgacttctaacacaagctgggtggctgtcccttgaacagaatgtatgtttatgcttcatgttctattggaactgatcatttcgcattttcttttccatgctgcttcttttggtcctgtgattgatgtaatcctcagggtcacatgggctgcctctggtcaatcctacatatttcacaggcatcacaagataccttttcttggtgatacctatcatcaaggcaaacatctcattaaaaatttatccaaggtggtttggcagctttattctacaggggctgcatcctagaaagctttatatgccatgtttgattaacaaatggagaatttactagatttatttggctcttcgaggttaaaaatgaacaacagaggtttttttttgtttttgtttttgtttttgttttttcctggcccttctgaaacctttggggtgtgcttttaccaatagaaaacaagatctgttacctcccggccgtgagcgctggttaaatttcagcttccacccatatttgtcagactggtcagttccagtctaggtaaaggatgtagaacaacagattccacatgacttccatagtagtttttctttttaaatttaaggacttgattactttataactttttattgttttatcctcagaacacaggtgattcagagagtatagttctcatacactaagtcaagactgtattcctactgtcttcatttggtgaaaatgagaaataagagattgttatctgccaaaggaagcatggaggtccattttcccacatttgtgatccgtaagtcatcatcccatgtgggctcaacttaaaggatttttagcagacctgtttttatttatcagtgaaacaggttctgcatcattctcccctttagccttctaagatctctaagaattcttttataaaaagaaaaaggtggtacctgaagatcagtatagaccgggcgccgtggctcacgcctgtaatcccagcactttgggaggccgaggcgggtggatcacctgaggtcgggagttcgagaccaacctgaccaatgtggagaaaccctgtctactaaaaatacaaaactagccgggcgtggtggcgcatgcctgtaatcccagctactagggagactgaggcaggagaatcgcttgaacccgggaggtggaggttgcggtgagccaagattgagccattgtactccagcctgggcaacaagagtgaaactctgtcaaaataaaaataaataaataaataaataaataaataaataaataaataaaagcagtataggttgctaagtgttgctgggactttaatctccagcctccatttcttcttgtttttcttattccagcatcagtatccatgctccaatgactatgtagtttaacttccttcatccttgacttcaaggaacaataactagaagggtatgttgttcttacgtgcctaaatatttggacgaataatttgtgagctctaaataaagatccacctattgtgtttatgctcatccatgtcagtggaaggagaaaatgatactctgaaagacaaaatctagcaagatagcttaaaattcaggctatctcacttattacttgctctatttcatctacattctaataatgggtcattgtagataaaataccaagtgcaagtcaataacacaaattttaatgttcatcctccaatgtttaggtgattatagaaattagtgctatgactggaccactgtacacataaactagccactaatcagaattcttttggtaatattgaggattttttaaattactgtttccaatttttttttttttttttgagacggagtttcactcttgttgcccaggctagagtgcagtggcgcaatctcgactcccacaacttctgcctcccgggttcaacagattctcctgcctcagcctcctgagtagctgggattacaggcatgtgccaccacgcccagctaattttgtatttttggtagagacagggtttctccatgttggtcaggctggtctcaaactcctgacctcaggtgatccacccaacttggtctcccaaagtgctggggttacaggtgtgacccaccgtgcctgtccctccaaaatttcttaagtacataaaacattgataatatttgtacaagtatttgtccaaaaatttatccaaatatgcccattatttggataaatctttatttatttatttatttttggagacagagtctccctctgttaccttggctggactacagtggcatggtcatagctcactgcagcctcaaactcctaggatcacgtgatttttcccacctcagtctgcagagtagctgggactcaaactcctaaactcaagcaatcctcctgcctctaggcctcccaaagtggtggaattacaggcatgagccaatgtgcctggcctaaaatctttaatctttacaattacgaggtaggtatcatctccattttacagatgagaaatggtgagtcagagaggtcatgtagctgagaaattgcaccagcagaattcaaacttaccacctaacttcagtccggtaccttttctactaagcttatgactaggagtacttgctctatctgtgcatttacttaagtagttttctctatctggtatgttctctctccttctgtccttcccattccctcctgtcagaatccttcaaggaagggcccaaagcttcctctcctcctcccgctctcatccaggttatctccaccttttctgcacacccatggccactcttctggcattgagactctttcatcttattgcatggttattgctttaccgctaaactccaacctttctgagagcaagactaaatcttcttcatccatgtatgccttgcagtgtctacaggattgtaagcattaacatttatttgtagaattttttaaatatgtttccttgtaattctcacctactgttctgatgtctttacaatacaaattggacttcacattgcatcttcaggttaagtctttgaagtagactatataatttattctcattttacatttgaggagattaagccacagaaaagttaaagaacttgtccaaaatcactcagtaagagatatagccagagttcaaacccagatttccaaatcgcatagtcttcattaaattgtgctgcctctttcatcacacaaaacttaatggatagagggctgtatgtcttgtttctttaattaaattcagagatccctaagatgtgaaattaatcccaatcttagtgctttttttatttgacaaatgtggcttgttatacagtctcttctctatttacttcctgataaggtccttgatgcaatgcccagtaggcagcagacactgaataaatatttgttaaaggggatcaagaattgtgacttctagaatttctgcaggcaatcaaagattattaataagagaaaggagatgaaccaggggaaccagaagaccatttgaaggaagataatggaaaattttcttttaggtgaaatagagatgagataagcaaagcgaggctaccattttgaaattctctctgtgtgtaaagaattcctactcatgtctctggtatggacttctcaccattgtgttaatttgcttcaagtgttctcttgcttccctctgtcattgaccctgaaactcttttaggttgtgttcagtacaatgatgagttagtgcccttaggtgacattttacccaggtgtttccctagagtatgattggagataaaaatctgtttaggatttcctttgtaggacaattcaagaagtcggaatttttaggacagttacagtctgcatttaaggatcctgatggacaggctgaataaacaaagataattcaaatttcaaaagcactattcatgtataacccttagaactgatgaatgagaaaattagcatgggcctgttgaatcaggttcagagtaaaggcttactttcgtttatttttttcctcaccagctggaccacattcccacactaatttctcttaattttgaagactttaaaatgccaaccactacagaattccatgcacattctatgtttttctatattcttccttagaacctactggctttcaaatttagataagtgaaaagttctggtctataacttttctagagatgaagtaatttccaaggctccattttatgtgtctgctctaataattggttcaatttctctatctgactgggaaatagcggataaagagtctgttgggtttaagatagcttgtgatccggttgctgttggttcccagaaggtctttcagctgcaggcctctcctgacaagacaggaaaaacaaccctaaatattcctaatttcctagcccccaatcatttgcacgcatgcgtgtatgtgtgtgtgcgcatatgtgtgcatgagtgtatctgactgccacttctgccacttactaactggtgaatttaggcatattatcagattttgctaactctcagtttccccaaccagaaaatggggatgccgataatgttatccactccatagggtttttgtgagaatttcataagaggatacatgtatgcattcagtttagtgtctagctcaataaatgttaattataataatatggatgaaagcaagttatgaattatgaagcccccttaaaaaaggaaattttgttggctgtgcgcagtggcttacacctataatctcaacagtttgagaggctgaagtgggaggattgcttgaggccaggagtttgagatcagcctgggcaacatagcaagctaccatctctacaaaaaaatttaaaaagtagccaggtgtggtggtgcacacctgtagttctaggtacttgggaggctgagacaggaggattgcttgagcccagaagtttgaggatacagtgagctatgatcacaccactgcacttcagcctgggcaaaaaagtgagaccctgtctctttttttttttttttttttaattgagatggagtctcgctccatcacccaggctggagtgcagcggtgcggtctcagctcactgcaagctctgcctaccgggttcacaccattctcttgcctcagcctcctgcgtagttgggactgcaggcgcccgccaccacgcccagctaattttttgtatttttagtagagacagggtttcaccgttttagccaggatggtctcaatctcctgacctcgtgatccacacacctttgccttccgaagtgcgaggattacaggcgtgagccactgcgcccagcctgagaccctgtctcttaccacaaaaaaaaaagaagaagaagaaaaggaaacttctttaatgtaataaaattatgagcattaactgacacctgaaatttttcacctaaaatatacattagctaccagagttttcactacatgtttcactttttctccaagtcagaatttgatggactgtgtagtttagaagactgataacccaatagagcttgacaaccatctatgccagattttctatagtgctaactttaaatattttgttttgctgtcctcctaagcatcctcatctttacaacatttgccctgaattttggttcagccatggttatcatagtaagtacagcacatacttccacttgactcaatgagccctatttagtcaagagactaaatccaggtcagattcatggactgtttgcttcacttaaatgaatccgtgataccaccattcataaatgggaatgggccaacccctgctggcataatgatcagtgggaggaggagtgggttgggcactgagcagctgacgattctccttacttctggagggggcccttgagatgacagcatataggtgggcagggcaaggcaactgtgacacctccctggggtccttttggtgccagggatttacagagcctcagctgtcaaagaacaataaattttccttcaaaatataaaacataaatcagtgtttcccaaacactgaaaggcaagaagaaactaaatccccataataatgaaaagaatcctgttaattaaatcagcaaggtagagagcttccctcctagcacacagcccagctgaacagtagaataccttggagactgaaactgaaatccaagctttttctaggtttcaagccagcatcctgagggaacattcaggagaaaaaaataaaaatcttaataacaggacaagtaaacacaacttttttttttttttttcccagaagttgtacttggactatgtttatctgggaagggaagttgcaaaacaaattgtaaactaggctcagtatatttgtgccaaccccttatcagatttgcaccagtcacggagaagctgaaggcctgttgctgagaattaaaatgcaaaagaacatacacaggatacttgaggaaaggagagagagatttcatttcttctgattatttgtttgtttgtttatttcagtcatagcctatttcaatttatttggctcctgaacatcctggctcacgttgtttataacaacacgtgttgacttcacacgtctttctttttgtcctgcaaagctattggtatagatttgtggggttttttaatgcttggttaattggctagccttctgcgaaagagtgtgttgctgcggttgaggaaagttggaaaaaaaaaatagaggttaaggtttcttatgactctgtcacgtttgggaattgagggccatataatcttactaccctcaagccactgatagcaatttctattcccatcagccagagccctcccagggatgaaagccacaccctctcggctccacttcagcttttggttttattctccaggcctctcagaatcaagtcactttcccccatcctctactaaccttcacatcagtttttactgccagagggagcacttttcaaatgggaaactcagaaactgagacctcccttcagaacctgtccatatttgaaaatgcaaaaactacccaactctcttctagacctcagtatttaatctttcacgtagcaattaatcacataccagttgttgcattaacatttttgaaaagtatattatgcatgtcatgggacatatttgcagtatgccaaagttcagtccgatttatatttgcctacagcagagatgtgtcttgaatactctggcacaagagttttcttattatcatctgtgttctccttggattcttacgcttctccatcttcctttgtccagttcataaccacacatgtacatcctcagaaagatcattttcagtactgttggtggctagtgctgctcagagaccaacagtggggtgtaaatttatattgataagtagaattggggccacagctgcaaggttgccaacccctcagatcccaccataccaccaatcgctttgaccttggaggtgaggatggcaggaagaaaggaagtggccaagaaactatggctcattcctagctcttcataggaagaacaactttaagtggcagcaagtggacacaatatgatatcagtttagtttgattcttggggcaaagcaaaacaagatggcggatcccagctcagttccaagagcttctcttccatgacctcagctgggttgtgtatcatggtctgagttcttttccccagggtgtatttttttccttctgacctgtgtgcttaggaggaaaaaaatctccttaagcttttttttttctccccctgagtgtgtgaagtcaagtgggatttaaggtcacaagacacatttgtgaaaaataggtgcatatgtgtgtaaattcaatgtatgtgcatgtaggcatattgtaagaaataagttttgaggtttttaaaattattttttttactctgttctataatctttcccataggactttaaggaaatagttgctttaacattctgttatttggaaacggccagtaggtgatgtaaaagctttgtttcattggtattgctaatgaatgtcttaagtcacagatatatgagtggctattaattgaagtggaatacctgtttaagtagaggctgttaactgtttcctaaaggccaaaatctatgcttgtttaatggagaatcaaactaagtatcaatgttatgcaggtccaaaatgtgtgtccaaatttcacttttaattttttaaaatataaaaatataatctgcaaccacatctatggattaacttgaaaacatcacatagctaacatttattgagcatccactctaaacaggagactgagctaggcgctaagaaccgagtaagtctgagttggatggtagcagtaagcagctcattccaaatgtataccaaatttaaatattagaaacaacagtatagttctgccttagaatttaaatataccctttgtgttattttgtatgtccatatatggtataactgccaaggagtttttcttctgctgtatataagtttttgagtgattaaccaaaggcaggtgcggacagtggaaacaagcactattaaaaaccttcaagcccttccacagcctgagggacgggtacaacacacagcaccattttctgtttacactgacatcactttgacagtttagcaccttttttttcttttttttttttttttcaggagtggggggtgagtagcaagtcttctgattaggaattttcaaagacaaacttacaaacagaagaaataaagtttgcattccttcatatatttagatatgacagattaaaagcaaagcaggtatgcagagcatgtttaatctctcaccaaggtggcaatctccaaatgctttgatgtcgcctcattgcaaggcccctgagacttttccaggaaccaaattcattgactttatgtggcttgcccatcccttctggtgttcaaaaaagaaaggaaaaggtccctgcaccttcttgcctccttcctttattgtacagtttgctttgtttgtttgattttaaaactgccattatgtgaaagtgttgcaagtataaataattgagaagataactctgtagggaaaccacttttgctgcctttgtgcaaaggcagctcattacggctctaagctgcagcattccataagagcaattatgcaacatcagtatgtcatggatattaaccaaggggagtagataagagataggaaaataattttgtaacttatttaattaaatgtatttggtttttcaaatagttcctcttgtgtgtaatttacccagccactccatggttgctgtggtctttgcaggactgttgtccagcatttgtttttggcattcctcctcacttttgtgtgcacctaaaatgtatttatattggggtttaatttccacccaaggagaggttacccatgaaaatggaaccataatttggtcatgaggtttttttatcccccctagggcttatatagccagttaatatatgttaatacaacaaagtgaataaaaggttaaataagtgggtcaggctcagaacgagtcctgtactgcttacttctgcttaaacagaaggaaaagcccataatggcgcttgcctgactttcacccccatcattttaagaattgctttgccaattcttcacagcaaatagtaattttaagtggaccaaaacagagctcagggtgtttgcactccatggtaataatagagtagctgtgctccctggagtcaataagcccaacaattgagtcatttttgcctcctgtgagtgaatcactgctgttagcctgaatgacaggattgcttatagaaccagagcccttcgccgggctgacctcatctcgggacagcgaggttcagagggcaggcaggtggtgtttaacacagttataagtaaaagctgattttgtacttgtaagctctgtaaacaagaaagtagaattgattgggagtgtttgatgtacattgctatacattatccaaagcagcacttcctcttttcctgtctctttcctcttctcatttctccttcctcttaacattgtccctacctcctcctaccttctacatgcatgtgtctccaacacatgtaacagacatgctaaagttagatggccacacacagctcagtcacagttctgattaatgaaacatccagaaggtattgaaaatatatatgtatatatgtgatatgtatgcatatatatgtatatatacatacacacacacacacacacacgttattcttaagattattcttcggtttcaaacagctattttgaagcagacattttaggcatagtaaaatacccaatgatcttttttttaaaaatatttcattgagtaggaaaaatatgagaaaagtaaggaaaggaaaaggtagagaaaacatttaagcctaatataattccctaataatcaaattacctttgagatagaaaagttctttttttttttttttttttgagacagagtcgcgctctgtcacccaggctggagtgcagtggcgcgatctcagctcactgcaacctccgcctcccgggctcaagccattctcctgcctcagcctctcgaatagccgggagtacaggcgccgccaccatgcctggctaattttttgtatttttagtagagacagggtttcactatgttggccaggctgggcttgaactcctgacctcgtgatccgcccgcctaggcctcccaaagtgctgggattacaggcgtgagccactgcgcccagcaagagatagaaaagttctaaagaaccttttcagccacagcacattttaggggtcaaggtgtcatatttggggtagtcatggggtacttatgaacaggttagatataaacaagagccctacaagtggttcttcatctctgaatctgacttggggaaatctaaagatggaaagaaagcctatttttaagttgataaaaggcttaaaaatataatttatgttaaaaattaggatgccgcttcattttcttttcacatccttggaacccgagtgcccctcaaaatctgaacaactagagtcaggaattaatttgtaccatcaccttctcttggagatctgtaatatatatcactctattaaaggctgtgacacaatctgcagcagagaaagtgacttcactttgattaccttcacatttgttttctccatatttttttgacctaggcccctattctggggaaatacctattgactagagttcctcagagcacatttgggagcaaaatgtgcttacaaagatatcagaaaaaaatatttttaaaaagctttttgttttgggggttgagacaagttctggctctgttgcccagactggagtggagtggcaccatctcggctcactgcagcctccacctcctggtctcaggcgatcctcccacatcagcctcctgagtagctgggaccacacagatacaagccaccatgcctgactaatttcttaaggttttcgtagagatggggcttcatcatgttgcccaggctggcctcaaactgcgcggctcaagcaatcctcctgccttggcctctcaaagtgcctctatttctcctttgtctcctttcctttctgagtctcacaaatcttcctccttcgctttctattctctatccctctctcctaacaccccccacccccacccccacacacacactcataacacctcattgatctcagttctcattcctctccacttgagtcaactgccccatcatccccagtacagttatgtcccggactgtgcatattgcctgccagcctagaaaagccagaggcccaatttcttccaagtcacatctgcacccacgatttacctggcctctctaatgcccagatagattcgcacctttaactaatacctctagtctgtatcttgagttgtttgtgagtacaaaaataattagaccagtgccagaaagcctgagttatttcccaccttagttctgtcccgctccagggcaaatcatttcatcaaggattcagctgtgcctcttataaaatgagaacaagaaaatccttaaactcagggctcttttattctcaattctaagttatatccgagatgaaggaaccctattttcattcactcatttagttattcactcacaaacattttattgagggtgtactatattcctgacgcagtgtcaataataaaacttaagatgtggcccctgctctctaaggctatctagtaggaaagtcagacgagtaaatcacaattgtgaataagtactgtgttgggcatattagctcggtgccactgaggaagtgcttcttaatcagactttggaaccagggaagttgcctcaaagagatttctgtgataagcactttgaagggtgtgttagccagatggccatagcagaaagcccagcccaggccaaaggaatagtgttgtcctggttagttagcacattaactttaaaagtattaattgctttttgtttatttgtacgttacctgactctaaagaatctgtggcagttaaaccaagtactaaattaaggttttgttgttgttgttgttttgttattattattattattattttgagatggagtttcactcttgttgcccaggctggagtgcaatggcgccatctcggctcaccacaacctccgcctcccaggttcaagcgattctcctgcctcagcctcccgagtagctgggattgcaggcatccaccaccatgcccggctaatacttttttgtatttttagtagagacggggtttctccacgttggtcaggctggtgatccgcccgcctcggtctcccaaagtgctgggattacaggtgtgagcctccgtgcccagccaagttattttttgatagtgttgctactttatctgcattgtgaaagtggaaatagaaaatagaaatgccatcatttctatttctaaaaattaagttaaaccaccttaggaaattctgataggagatgtgaaatctgaatatgctgtaaaaattctttcaaattgccgtacagtgtgtttgcttttttgtctgttgtagatgacggctttgtgggtaatgtcagaatcaaaggttgatgtctctatttctcacaaatcggggggaaaatccactaactaaccctctaaagctaaaatatttaaggactaaagcagatgtggcataactgctggtttgctaggtctcttgtggtttataaagatatattttatgtcttttatgattacgggatgatgccgaaaattttgggggtaataataccgtcacattggaaagactgcgtataacatctctggagaagatacagaatgccacccggctgtcaaatcaaagtaaaagatgtttaatttgtcattaagaaaaggcagtcaggaaattttatttggaatttggtctttgatatgtgaacatcataaatgtgaggatattaagtcatgtattcatgaatagattttttttttgctttctgacataatataatatgttttcataataatttttaaagctattgttagatgcgtagctgttagaactataatttatttaaagtgagttttaaaattgtttagatctttgatttttttttccccattggcacctttactagatgccagtataaactggttaaatagcatttggtttaaacagaaagaatatacgtatgcatatttatgatattttgtttgttggatctttttcttaatattacttgactttctgtgttttaatctcattttttcatattttgggttgaagccactctaaagtttaacacctaggagatttctcacttatggttccctttaaaagtgctaaaatctcagcctctcaaacaagagaccaagctacaatttaaagaaagcggtggtattgataaagggccctaagaatgttgccaccttccaaatgtgtcctctgccacatcctttcttttaaagcagcaggagaattgagaggaggataagagcctggtccatccaaacacttctggcatgccaatctggtcttctgaagtatcccctgctgctttagaaaaaagagatccccagacaaatgaaaggcccacggggacattcacatgcacagcaccttccctccaagtggctttagattgccggtgtgttggggtggtttggcctgagttgaagaatagagacttgagaaccatttgtttccacaccattttgggtgaagtgctatatttttcaccttaaaagcccatttaaaaagaaaaatatggtttgaaaggaggacacaatttggaagccatcacacttaatggaggcccttttaaatgtaacactttgtcctatcaattctcttctaaattagttgtcactacctggagaaaacccacccttgattgttttatgctattgcttaaaaatacatagtcttttatatagattttcctattccagttttaaaaactctctgataagttccattactaaacttactttcgttaagtaaggagtggaacgtaatttgtgtagcaacacccagtgtaacatgtatgtaattatcattggcctctaaatctagttgcacaaattaactcaaaatgtaaagaaaaagcgaattggtcctattagaaacaaggccttgaccacagaggtttttactaacaatcgacttggccagtcatggtcagataaagaacttcccaaaatttacaggataatttggaagaggaaggaagtaatttttttggaggtagccagcaggcagtttatcctgttacctactcctgcagctctggaatattcatgtagcttggaaaataggaagaaattagacgttttgaagttaagtccctaccttttgctcttcttttgtccttgttttttttttttttttttttcttgagtggctgacatactttgtcagcctgaaagtcctattgtcaaaccaaaggtaacatttgaaaaattgagtttgcctcttcccaccacaacaaataggaatttctcatctatttccaattttcatcaactatacaccgtaacatactaaacataaattctcagacttatcctcttaatatcttttgtatttgtatctctcctttttcatctaagtttaatttatcagcagttctcccaaccaaataccctacttctttttcatttctaccaccttaatcagagctcgttttgtttccctcttctgcctggattggacaagaactttccatcttctcagcttctagattctcatcagttcagttcatcctatacatagctcttggaaagatcttcctcaaacaccatattttatcattctaccatttaggaatttcaagaattcaatttatcactcaagaacctctaccagattgcgtgttaatcatagccatgttttccagatcgaagctgggagccagtcagagttcaattcctttatcctcccttgcacaacatcggccccggtctggactggtgctttacagcatgccatttccttgttttctcttcttccaacattccacgttcttttaatctgcttcagctttcttcctccaagaatttgaaattaatctttatctttaacttctttaattgacttcatgacacttatttactgactatggactattttgacttgtaattatttgtgtgttctccaattgtgattttcagtttgtttctgtgggtgtggaaaataaaaatctttaaaggcataacttgcattttcatatatatggagaaagaaactcatataactatatatgtatgtattgataattttatatataactttgtcttatattctgtcattaaatttgtcttatgtgaagtatagaatatggaagatttaccaatgtgtgacacatagatagattactatggaccttaaaaattatttggtctaattttttttaggattaaaacaggatgaaaataagccttacattatatctgctcctttatacctagctttaccttccgccctcttcccatgccaaacccagtctctcattgggaaacacacacacatgcccctagagaaagcatctatgaatacaattctgtgaacgtggaggaggtaggtgattagtaacttttgactggccaaagggtgatgtaggttaaagcaagaaatgagggtgagaaaaatctctgttcccctagatagaggggaagggagcaaacactagaacatggcatgattgagtataatagaagtgagaatgtttagcaaccattcttttctcctttgtttctggcatttccacccctccccaccccccgacaaaattcctgtctttgatctatgcagtaatatgtctaaatatcctagaattggtaactctgtctgtatgtatgtgtgtatatgtgtctgtgcgtgtccttatcacccctacttcagcagcagcacagaaaactgagccaggtgttaatgaattcatctctggcaaagtttattgctctgtgtgtgtgtgtttccatgcatgtacatgtgcacacacacacacacaatacacatacatatacctacatacatgtggctgatgacttctcacagtgtatctcaaagcattattgcatgtcccacttggttgatagggcatctctagcctgacagatttatctgttgagaacaggattatgcatttgaaaccagtttaattcttagcaagacaatgcacatgtcttatgtagattttgttgttggtttttttctccttcgtaagttactcggggaaagtcatgtcaatataaatcagtggtaatgaaatcaacattatagcatctttgataatgcatttgctaaagcctttctggacgtttacccagctctcaatgattgatattacaggcagtggataaacatttttgatggatctgtttgctcacagataaaaaaaaaaaaagaagaaaatgtaatccttttatctctttgattcaaagagtgtaatgccattggaaaggaagcagttcaaatgtggtcatcataggttggtggcaccaaaaatagaaactcacttagggtaaaatttgctgtcagaaaaaatggagcattctttctgaactcaggagcgtgtggttcatgcgagcttccttgtagatggttgctacaataaggcttctttcatacaggtgtgtttatgccccaggcttgctggccacagtccattccatttacagaagctgaattaaacaataactactgcattgcaaaaaatggtgggggtgggaggaaggggagggggaaaggtgagcgtcaaaggagatgcctgagagctttgttagggccaagaaaaaccctgttgcagttgtcagagcttgttgatgttgctgggaacggcactttttttttctcctggattttgtggttctgccttaggaaagaaagtaaaatagaacggaagaacaaagtcctactctataaatcagcagctgctccttgccagatcaaaggagtgacatttttgctcctggactacttgtccacttgagggcttgacaggcagctaacagctggcctgctagactgtatgggagaatcagcctacatcttcttctgagcagatgacaagctaatcagagacatatccatagcacagggcatgtgagtgcaccttgatctcttcaaacatatctaatacataattgctaaacagcttggtgcatttttggccagttaatgcttaggtggtttccattaagaagtaggatagagaattaatacttcaatcaaaggtgatcatgaaagctaaaaagctactagatttgttgggatcttttcctcttacagtaaaatggctaggaacataatgggagttggctaagaatgtgtgcaactgattgtgaagtgactggttgatttgcaaagccaggtcaggctacagtgctcagatacagaataggtaattagaaatcagtagttttgaaaatgattgtgcctgctttttatgttgatagagttaaataaacttgtaggtgtaccttctgtgtctgcaaaaagttattttcagaagcactgtaaggtgtgtaggtatccagatctggaattttaatgtcagtagtaaaagtttcaaagtaattcagtttctagttgacttccatctgcaataaatcatgtacaggatgaggtaatatactacaacttatgtctattgacttaggattttatctttaagaggatagatcctagatgtgaatagctaaggaagtttgagtgttttctcctcccttgctttcaaatagctttgaaagatcacttttatagtgcatgataaatagctacatatgaataatctgatggcattctgtaagagtaacagtgcttcaaaatcgtaacctgctgggatgttttgttacatgccatcaagtgtgattgtattcatggaatagtgtttactgttgctcaatattgtaaaggaaataaaagataattccctatctgaggggaaatttctcaaatattttaattaaaaggtccctacagttacccatataaaccttagtcaaataagataacaaattttcttgatctcctttaaaaattcttttatgtataaaaataattatatttattaaaaactccaacagtacagaattatttggaaaaaaagatagaaatctaccattctcctatccatgcctgagagatagcctctgttaacagtcttcacaaaaacattttactggcccagcttttcctttaagaggtacagatggagtacaataaattaaattattataaagtgtttattgcccaaggcaagtgagtaaaaggctgtttagatctaagatacctaaagagaagagtatgtgcatttttttgcagctgagattcacaattaaaacttgatctttgcaagtttctattcttaagcagagcactagaatttgatatgtgatctagagcaaggcttctcatacttaaatgtacataaatcccttggagatcttttaaaatgcagaatcagattcagtagcacaggaatggggacggtaatgtatttctgcatctctaacaagctcaaggtgatgttgctactggtccatggcacacatgtaaagtagcaaggatctagagaaccatacagagagtgtgattccaaaagagctcactcccctatccacctcccacccctgcaggcagatgcctgccccagtgtctaaaatctccaccatagcattgtacatttggattaaactccgatttttagaaagatccggcgatatgaacacacgctacctgtaggagtacaacacagttattaccctgtggccaatccagcatagatttgtttaacagccacccacctattcctaattactatctatgagagaacagagctatttaggagcattggataggtgcattttgactgtaagctaacatttaatgagcttgctatgtgccaggcattgtgctaaggatcttgcatacaaaatctccctcaatcctcaaaaccacccaggcccagttatttcctcagtttacagataggaaacagagtgaagcttgggaaggttaagaagaactgtccaaattcacacagcaaataaagggcagaggacatgagcccatgctcttcaccgtattgctctatgcataagtctggagtatacaacaataatggagaagggcatgctcaaagtagagtattttagtaaagaacctccaggagcccttgtaactttagggaagaattagatgaaagtaagaatattgaaagaagacagtagaaggccatcacttacttgataattttgtccagggccttttatgtcagcatgaacactccattattcaagccatattcataaaggtacaaaatgttgtgattccagattaacatcatgtttttatattataaatttattagtatttagttcatgtgtttttaaaggtgtaggcaaatctagtattctatcaaattataaatcaaactattgcttagggaaattcattatgatccatgagtctgtccctaagtaacatatgaatctcattcatttaccttactttgctcacggttgtctgtgagaaaggagccattgtctggtcaccagtggaaaacttatgtctgcgacatgactccatcatttgcgtgcccaagttcatcttcaaaggcattaagcttgccttattcactgatttaaccattttaatgtatcttactgagaaaatcctactctcagctgtaaccatagcacagagaaatacttgctttttttgtaaagtaagaaaacatggagaaatttgataagtgacttgccaaggctgaagtttcatcatttgaaacaccagccaggagcaagtgctgtgaataagcactgtggctgatgggtcccagggctggggacagtagggaagcagggccttttcatgttttaacaggtccccggtcactgagctacctacgcctttccccagttgatctgatctctcttcaacggttcagtccccttccctgcgcaaagcaatccatgcagaatcttcaattccagctattcttgattcctcctcagagtgttcagggatggcagctttccaggtaactccatggaggcctgcactttctaacaaaaggaatgcctccaaaaggagttggttaccaggtgtggcatgaagttagtgaaccagaaagaagggatttatccgccatttaaaaagattggggggtggagaaagaaaggaataaagaaaagaaaccaacaacaaacaggaatgacacctaaatctacttctatcaatctgaaccatacttcggagtaaaaagtctttaaagaaaaatcatgatggtcagagttcagttgtagaaaagtatgcaaagctaccaagtttagactttctgaggacaggagaggtctctgggaaatagctcttcagcaaggcagtaagatgagattacagtgatatttgctaccttgggtttatttgttttaatgtattttttcatctctgagttgagtcagaaaggcctcgtgattcttggaacatcattgaatttatttctataattaagttatttttaaactaacagtcttagtatataatttttaaggatcacacatactcatgcattttctacttaagtaaaatttagagaaaaagtagatagtcttagtagatactctcccaagcttttgtatgggcctggatactaactttgtgttcaatacaaatcaatggaactagggctctttagggtattcattccctaaggactcactaatgaaattatgtgtagccctttaaaaaaagtcacaatgaggctaatgaaaattttttttctaagtgaaatctagatagagctagacactaagcttactggtacattttatggacaagttgtaaaaaaactcagaatgttttttaagaactgtttaatattgaagaagactttgtaacttaaattgtttaaaccgatagaaaagtagattatatgcctgcaacttcgaaatcattctggtatgacattaaaacttagagaattttttaatatcagatacagatgaaaaatctaacagtctttggattggaaataacttgtgggggttttcattaaagttgggtgcagcttgctgcattttggttagttggatgtcttcagcaatttttcaaatgttttgggtttggcaaagtccaaaatgttttttgccaagaccctcttttccccttattttttaaacccgtgtgaaattcaaggataacttaatccatatgtgtctgattcatttacacttaactcatcaaaatgttattttataaggcccatttaatatccatggaaccttttgagtctttttaagacaagtcttttgtctttgaaccagcaagttacatttttccatatgaatggagcctgaaccttgaaagactgaagatgagttgattttcaacttagcttcttcaaattttacgtaaaatcaaagcttgatattctatttactacttgagcattgaaaaaggtcattctaaaaaatatagattagaagatgtggaaaaaaatttatttcatgtaattttgagaaaagaccatatatggaaatttcatcttacaaatattaaataaataaaaattatttctagtttgatttgttttagtctataatttaaatggctccatgttatgtatgtcagtgtattttctaagagtggcctctgagtcatcagtactggtaggaggcggtaatttcattttttaatgtcagggttttcttacagtcagctcattaattgttaattttcatagtaatatctatgatgtcaataaaatatcccaagatcaggggaattgacaattggcaggagttgcatgttaagagatttctgaaaatttggggcccatatgtttttaaaattctgtgtgatttgaaagaatgtggtagaattatgaatctgtcaagaaatagcactatggatcaaaaacattgtttgagaacaaaaatccagagaggctaaatggtgcccaagtgaaaaaagcaaaatctctgtgaccctttttaaaaggacctagtgaaaaccttcagaggcttctattcatatttgcttaggagaagtgggtaaagaaaggccattgccataactgctagtgaacatccagtccatgccatggtaactagttgaaaatgttatactggagtggcatttccaagttcagtgcttctataaagacctgctagctcacagaatgcttttttaatgttctgcattgttgtgtgtcccccattgaacaaccttttgagcggacctcgtttttactaatgtaaacattctgactagtatccaaagaaatgacctttgagtgaacctctaaccttccccgtaagtatttgtttgaagacagtgtggagttctcctgctgagaactaagaaccatgatgccttgcagctctgtgagtaagggagtgtttgggggaactggagagaaagacataaataagggaacaacctccagatgtaaagaataaaagagtgaaattaaaaagggaaaaaaatagcaattcgttttacccgaagagttagcctataccgaaaaaaaaataaaaataaaaaacgcaaaacacaaaaaccaggattagtagcacataaaagggggtaaaacccctgccgagtgttgtcctctattagaaacttcaaggagaagagccttctctgaccctcctgagcatctctgctggtttcaaggtgagctgataaaaacggttcctggggtggaaatatcaggtcagtcctccttggttgctgtaaaagtggtggggaaagagtagataattaagttctttttctgattggaggagggatgcttctggaagtctttgtgatctagtcagatattcattcctcagcaacatttcaggtgacaggtgggaagaaagatgcagtttcaactctccttttgttttcacctctacatagctgatcactttcttttttgacaactgagctacactttcttaagtaataaagaagtccattgttttgcaaacaaacaccatatgcaaaagactcctttggttttctcccagctattattcctcagcttaattgtattcccaccagagtgctcacaggaggcccgaccgagtggggcctgactgtcctcctccaaagggacttcagcttcctcggaacacagagctgccagcacacactgaatttttctggctaatttcaaagagtgagttttcagttcctgcctgtggccccaggtggactcattaatcatgaagtccccctgtgcttaagatctgaaactggaaatattgacagatgttatcaatgggtatatttttagggagaagctagctggatgctccctgctcctccgaaatgcgtggtcagtgaatcgtgtgcatgagctcaaatgtgtggggaatacacgtcgttaagtgcacagggacaagggtaactcacaaatggtagaaaattgttttgtttttattaaatttggagaaataaaggagatttcttatcatcttactctgtttgtacatgaatatttgatgggcattattaaacattaaagtaacatgaagtaggcacttatttttggatttccaacaaaattagatccaggcttcttagatgaaataactgcttctcctttgcattcctgcgattcagccaccacctgatttgcaaacgtttcttgagctctaatatcaaacatgtgtacctgaggctctgtctttctagtgggttgaaaggtggctgggtttatggttggcagttaccttatcctctgccctgggtgtcccagcttaggctggaaaggctgcccccagctggcactgacctctgaatgacccctaactttacaggcttaaactgcaggagttgccgaagagcagaagtctttctggccagcacttattactgctgtgttggtgataaaacttcagacagcctaattgatggctttgctgacctaacaataccttgtgaaagccgagtgctagagcctggtctccatttatgaccagctgcaaggggaagctgggtctccctatcacggggagtctagggaaagggggaaagtcttccagcctgtgaactttaaccagattcctacttgtgcaagaagcagaagcacaatttgaagttaatagaagctttctcatggagaactttattccgtccctgagctcttctagcaagttgttttggagttgactacgcagtgacgacggagattacccagtcaactatttttgaacgctgaaagggaaaatcacctttaaattgaaaagataattttcagaagagatttgactgtattttgtgctcctcagcattcatgcaaaggtgttcgcagagtacagaaacggagtatgatgactggacttctctgttctctttcaggtttattaatgccagaagaagaatagtacagcccatgattgaccagtcaaatcgagcaggcaagttccaagtagtatctatatttatgtcccacaggcacaaatcctcatcaagttatactccagtagtttcctcatctgataaataagtgcttccaccaggcattctggatttttttttttaatgtccccagaatcccactcaaggaagcaacttcagtaagtggtgctaattggagatttcccaccctgactctactgacactgctttttattttctttctgaattggtaattgggcacaggtattaatgccacaagcagcgtgtttgtgagctctggcattaccccttgcttgtctgcatccaatcattagcacactctcatttttctgttacccacagctccttggtgtatgctaggctttcctttctgtagcatctgctgttaaacttattgtatccattcatttgctttggctattcataatatcctattaaagcctgacttgctgcattgccaccattattttttattaaagaatattacctttgtataaaatgcttcacatccatgctgctaaaatacatgtgagcttttctcagaattctctcaatttctctaaaacagtttttgtatggtactatcagaaccctcctggtatactccaagtcgttttattttgaaacagacatttcctcagtttactgagggtttgtggtctcctgcaataaggcttatagggaaaaacagttttccttggggtgatgactgctgccactaacaacggtgttaaacttgatggagattttacctgtggcctcgctttaaaggatttgtgaaaattagtcatcctttggcaaaatttccccaataacgccaaaatatgttcccactattggaggctagggagaagaacataaaacaatggaaatattatatttactaagtttatatttccttggtgtgaataaaaaggcaagcttttaattgagtctatttaaccttgtgaaattgtattcaggtttaaaatgtttgtgtaaaatatgaacattttgtattaagccaccagagatggcagcctcagagaatcccaaccaaatggtacattgcaatatttgtatatggggtacccctaacttctccagccttcgtccccctaatcaagagataagtaaaaaagcaagggctgcagaggacgaaccccctgggaaactggccagtgaagtctttcttccagaacatttttaaagctactcacacaccttcactcagtcatcaagacactcagacaaaccacacccccatttgtagagtgccaaccacattgttgctataacgtttcagtgctgcagcgggaacaattgctgattgtttggtatatcttttcttctttctcctctgtgtcctcgaatgaccacaatcaggttttcttcttgatccttcagtgagccaaggagcagcatatagtccagagggtcagcccatggggagctttgtgttggatggtcagcaacacatggggatccggcctgcaggtaggttggctcatcccgcctctgggcttccctgggaagtgccacctgctccaccagcctctccatccactctactatcccactgtcatggtgggtttaacatttgcctgctgcctgctctgcctgctttctttacattgggtgggggaaaaaattcctctttgaaaaagtaaagattttaccacagtaccattatactctgccccatacacatcctttttcttttttctttttaaaccaaggcaataagtgaaaaggaatctgagtttccttctattttttcaccatcaattattgctgattttccggcctcttcttggattttatctcctttctaggacctatgagtggaatgggcatgaatatgggcatggatgggcaatggcactacatgtaaccttcatcatgtaaagcaatcgcaaagcaagggggaagtaagtacagtcgggtgcgatctgtcttcactatcacttcagagactttattttattttttataatttgcccccattttatttttccttgcccataactgcatgcctttccaaactaaggacctgtttttaaatatatatcacccatctctgaagtcacagatgacactgatgtgcacttttgaaaaggccaactgacaagcctgcgtgtgttttaagcaggtgggactgccttttagcctatttactgtggccccaatgtgcacaaacacagacatcaggcagatattggacatttaagaataaaaataatgtcttgggggcaccagttgactgagagaaattaagcaggcttcaatgaagcgataaaaaaaaaaaggaaaagtagaactgtcctttgagtgacataaatctgtcagaatacgattgatgcccaaattatcttatatgcaaagatgaaatgctgcagttcattatgcctagtctagatatatgacagcagtgacaccattgattcttcactagggagtcggtgtgttttgattattttttacatgtgcctactgacttccgacatgagacagaaagacaggaaagtcagtcaataaatttaaagggaaagacatttaggagcaactgaatatgaaggaatggatttttcactgaggctgaatggctgcagttggattaagaaacccattagactttaaagcttcaagtgtttttgacatctgaaaaaaattcagagtctgccaacaagatatatcctttgctgaagacaccagagcataaaaaaattcatataacattgaaacttccttgtttaatgaggctgaatataacaacacgtaccttgattaaatcattctctatatgtaaatagaggccaacattttataggggagctcagggggtcaccacggcacaccattgatgaagccaatttccttccttccttcctttactaatgcagtcaaaaaatgtagaaagcaatgttccctaaaacagctatagagaaaacatttgctcagcttggatagttcttaatataggccatataatttctagcctatttaattacataacatattttatgcttcatgaccaattacattaatagcttaatacagaagaatattatcctctcttgatttgattatgcagccacacaatatggtatatttggtacttaattatcatcatccattgagcaggctgctgtggtagaataaacagagagctgggactatgcaggctgtgttattgtctttagatggttttgccacttctgttaataatggactgcggatctacttaacaaaatgactgcagcatataagcctttagattaccagcttacagtgtcaaaaacatctgttcagcttttcaactgtatgcactggaggttaaatagaggtgaataaagctgtccttttagatccggggatgtgcaacagtaaatataaccttaattcaataaacaggtaacttgtaagagaaatcagaatccttacaattgctgacttcccaccatttaactcataactttgaatgttgcatatctcaattgagaatttctacatttattacattttattcctaatatcaaggcattatttggggggattttcagagataaactaccgggcatgtcatatgacctcacattgacttcttacctttgacctttacaatctcttgggtgtactgctataggaatgcctctaattcaaaaagggggcttcattttaaatacacgtaaaagctcatttcttcaaaatgaatatgctgtaatgttttgtgtaataaatttttcatgaggaaatatagatatgataagatgtcaattttattttattctactatctacaatttttgtccaggtctacaaatgcaacacagaaaaataaatgatctatcaacagttaactgataaaactcgactcaaaatttatattcttattgcatttatcaaagaaatgtactgaataccattttgaaaaacagttccactttatgacatttagttgcattaaatatttagttctgttgtgttgcattatactgctgtgcgatgaaattaaatgcaaactacaatttgaatgtctgcaaacattggcaagaatctgcagctaaatttaggtataagatttgcagtgtctgttgttttttttttttttttcttttcatctttgatgggtaaagtataaaaatgtttaggaatttgacccgctttctttttccctctctattttcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttg

SEQ ID NO: 36923 - DNA, 6727 bp, Homo sapiens
ctaaaaaaagaatcccaggattttacctcctgtgtgttttcttcttgcttcttcatggtccatgataccagctgaggttgttagtacaataaaaccaaaccggccggatagaagcagattattctgccatttttccagatgtttgagttgcacatcaaatctggggctgattactcaacgcttgtttagcctacctgtgaggttcacaacaatttttcccagctctgtaatcatcagtgattcaaatttgccaatgtaaccatacttcaccattacagtgagaaaccagatgatgattttggagcacagcctaataagaacctggggtttgcctcttctttcggcattgttgatgctcttgagagcatcaggcaggacattcatgtgcaccattgtggcggcacgaaaagatggcggaaagagccaaacgacaaccctttcattgctcttgacaccgtgggtcaggaatttgggtaaagctcatttggatggctcatttttgttcctcgtggtgttgggaaggcttgacgagagctagagatccaagaaggcctcactcatgtgttggacacctcagttctctttggacttttttctatccaagtggtttctggagagggctatatttgggagtgatctgtcatacttctctttgctatcggatttctatcttcatcatgccatcatcactcaggctatcatcatcacccggtcttatcagatattgccaaattatgatgtcataacttactatgactgtccccactgtccatgaaaaaacacagaaaagattagatacttctcagggaggtccctgttcatctttatggcctcactttagtcctctcagaaggtactctttttcttcaatcttcctcagtgcaaatatccaccctcaatcaacatcaacatgggttggtgttactccaattcactcctctttttcttttctttttttttttgtttttgtttttttgagatggagtctcgctctgtcacccaggctggagtgcagtggcgtgatcttggctcacggcaacctctgactcccaggttcacgccattctcctgacttagcctcctgagtagctgggactacaggcacctgccacaacgcttggctaattttttgtatttttagtaaaaagacggggtttcaccgtgttagccaggatggtctccatctcctggccttgtgatccgcccgccttggcctcccaagtgccgggattacaggcgtgaaccaccgtgcctggccttcattctcctctttctataacgcaatcttaggatgcaaaaccaagcaaagtctgaattaatctatctagaatagcaccgtggagtcacagccatggtcaggcccctccaaagaacagactggatttcggaacccatgtctctccctgccacaagcaactagtccatatgcaacttggaagcagccactgtggatcttggcttctttcttgcttcctcctcaatagttactgccactgatttagtgctaaagagataggaacatcacttaaaaccatctctacacataaatccacttagaataattttttcccctggaggatctattattgaagtacaaggctttactgtttattctactgtagacaccacaggacaccatgttcttggttagaattgagtacttgagaaactatatgaataattgcttgttgaacagtacacgtgaattatctctattttccagctaaagattgagcctaaaatgattagtatttttgtaattttgaatcatttgatccatttgaagttggattagtgacaaagtcttattcatttttcaagtgttagttctgagggcttctcccagaactagcagcaaccagcgttgctgctagataatattgcacctttaagctaacaagtaaaaagctgatcctctgggttgatgttgtctcatgctagggctctaggcagagtgggctggagttcagtccccagccatcttcttagcagggcattctagatgtttaatcttttatgttgacgtgttgatatcacttccattagccatttgttagaattactaaattaaatttacataattcaaggatctaaaaagaccagaagttcagtcagagccatttttctgagatatttctgcatccctctgaagaagataatttgtccaaacttaacaaaaacaggtgttaaaattgagtacgttctgagaatactcagactttttttaagactttttttagtctcaaaccctacatgaaatacaatcccttaaatcttccaatcttagagctagaagaaaagtcgagcaccctcactttacccagaggcaattttgtgccccagatgacaaagctcttagatctactcatttgcttatggctccaccagtacttctaggtcaggccctctttcacctgaaggattagccatacttctggaaccattttccaggttccttgaaataaatatcttcgctttgctggggaccctagtttcctgttaagtagtgaatgacccttctttcctcccgccagccacagtcctatttcacagaggaagagaatgaccagcaagtcaacttctactacagagaagcagcaactgataaaaggccaaatcttacaaggtgccaacgtgaagaaaaaggcccactatcctgcagccaactcatatcaaaagttaatctgtttagtcctctctgccggggtgaatctacagtttttctttttgtctccctcttgccccatcaccaggtggttgtcgttgtccttcccggctagttgccaataaagttgttacaaagtgaccttgagtgtcttccttggtgcacccgaaaccccgccttcttcatccgggtgctgcggcgcgaataagagccggaccgcgcttgcgcattgagtcccactccttcgacctctgccgcagcccgtgccgccgccgcctcctgggaaggtaagtggagggcacagggagcccggcctggccagggcggagcggcgcccagtagggacccattcattgtgccggcgcctcactgggcacggggcccaagctgacggcgtgcacgggagcctgcggggcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctggtgcgtagcccaggcagggtcggggggattgaggggtgggcgttttggcctagagcgtccacgttgttgaatggggcaaccttcgggcggggcacaccgccctctcgggaacggctttctccttacctattaacccattgccgttttcttcctaatcttagggcatctcagccctctccttgccactagggcgaggcagagcagccgaggcctagctgtcaggcctcactcggtgtaggtcaaactctctggtccctagaccaggagtggccctttcccccaccttctctcagcctctctgttggattggggtcgacgcgaaggttggagtactgcagaggatgtagggggccgttgaggcctagttcacctcagcagcgctttccagtgcctgtctgtaggtcaaactcgttgctgcagagggagggactttgcctttccgtgtgggggcggaggaaggtggtgggggaacgagcccaaagtctttcttcctgcctctggagtattattttcataacaattttgcaggcttaaagtgaggtctagatctggaggatttgtcttagagaatcaggttttggttcggaagggtttttctgtgaccttaatttagtggacactcaagggcagagaagttggactggaatatgtccttatggtcagatatttcacagattattcttaaactgatgtagaattgcttaagttccttttttagaaatttttttttatgattaatggtcatatagaaatagctttgaaatggtcagggctattaactgctgggctattttgaatgataaatgtttattgtgacgctcctaatatacttgttggtccacttaaaattgccaaagaacgtgtggtatttattgcttttttctgacttgacttacggcactacaataatggaaatgtcaaaagcagttcttactctctttgtaactgttattagaaattttattcaaggtagcaagcgttacaatttcattagcatgaaactttattaaaattgcttatgtattaaaaatgaccaaacagcaaagagtcaattcagaagtttctgattcatttttactgcttgcttttttagaattcatggtaccagaaaagtcattgaagtcttacctgtattctttcttaatattgaaatctttatttttttttcattaatagatccgagctggatccagagttgcatacagaccaatttctgcatcagtgttatctcgaccagaggctagtaggactggagaggtaatagtagcaataattgaaattaggtaacactaccaaataagggtagggttttgattagagtgaaggaaaaaaactttattaataagagtttgagggcaagtctttcccacccttttatccaaaaaactagatgagccaaatagccaaaaatagccaaaaaactagatgagacgaatagagaaatttctctatccaaaacttggccaagtatttatattcaagtctattgatttaagttgcctatatttaaaattataatagctacagttattgaaaaatgtactctattggactggatgcggtggctcacacctgtgttcctagcactgtgggaggccaaggagggaggattgcttgaccccaggagttcaagatcagcctgggccacatagtaagatcctgtttctacaaaacatttaaaaattagcccagcctggtggtcacctgtagtgttagctactcaggaggctgaggtggggagctggcttgagcccaggagttcaaggctatagtgagctatgatcacaccacactgtactgcactccagcctgggtgacagaccaggtgagaccttgtctcttttaagaaaaaacaaaacaaaaaaccctactttatttaaaagcatatttatatatgttgtttcttaattttcaacacccttttaagatgtagatattgttatccctgttacacaagagtgagattattctaagctcttgatttgtctctttacactcagctacaaaataaaaaagtagttatcattttgacaatatggtatttaattaaaatagctacctgtggttactgatacgacctttacctttattttctgttttccagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccaggtaatcatttctatccctaaataagttaagagcatgcttgcagtagttggaaacttagctactgaaataatagctactttgcattaagtgcttactctgtgtcttgcattatatttaaagggctttgtatgcattatctcacttaattctcataacaccatttggggtgttatgagaataacatctatgaaggactagagacacagaggccacattacttgcccaggtcatagctagtaaatgtcagaaaatgaattttaactaagtctgacttcagagtctgcattcctaattgttaagctattttgggaataaaattattagagcacattccttaaaaggatcaatttattttatttaagacctaaactgtcagatcttaaaaggtatagatcatattttcagatggataagaatgtcagaacccatcaaaatgaatgaaaactaaccatttatattgacagacagctccctacctttacaccatattatcaggattgaaggagaatagtgtaagagagatctaggcaaatactcttccagcagacttttcagtttacaaaaatccccacactagtaatctgattctttaacatttaccaaacatgttgaaattaatatttcaaagtaacagtcatatgtggtctcttttagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactc

SEQ ID NO: 36924 - DNA, 6727 bp, Homo sapiens; identical to SEQ ID NO: 36923

SEQ ID NO: 36925 - DNA, 13664 bp, Homo sapiens
agctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacgtgagtggggtgtccctgggcttgggggggttctagaatgatgctgaaaggcactggttccatcctctgcccattgtgcagatggggacactgaggaacggagaggacaagaggttgctggaggtcacgtagagagctggggggaagagctggggctggaactcagctatgcatgcctcccaaagcctgttttctgccaggcactgtgggaagctgagatccagagaataatggtcttgccaatgtcccctgcagggcatctattatggggaataagcttggccagcagttcctcgccccttggctgtagctttttggcccttctcagtcctgcctgtgccgccagctccctcctcctgcagccctgcaccctggggaaactttgcccgctgtccccagccaccctgaaccaaatgcccagcctgtctgcagctggctctgcaagtgtgtgagcaggactccctcagggagccccccatattcacactagtttccaaataaaccacctctaggaatcaagagaaaggccctcttccactcttttgcccctgagattagacaaagataagggagtgaaaacactctctggggctgtttgaaggcagttttcctggattacagtatgggctggggggcaagcgctgggctccatggtctctaggcactgagaggtgtggcgtgtgtgtgcatgtgcgtgtgcgtgtgtgtgtgtgaaggtgtgtatgtgtgcatgtgtttgccagcatgagtctctgtgcttgtgtcaactgtgtgcatgtttgtgctgctgtgtaagggtgtgtgggggtgagtttgcaacacgtgcccatggctcctggcttgaatggggtctggactggggtcactaatgacaagcagatgctggtgactgggtggcagctgtggaaaagaatgtctcctgggctgcttagcatggcaaattggccctggtggcagctgcctgctgtcccagacacggcctttcccagctcctcagacaagtgcaaactcaggccgggcttgggccacagcaggggaggatttggcctgagagactggggaaggcttggaggatgtctctgagggcccaagggacaggtgagcaggcctgggggtgcccttacagggagggagagaagccaaggagcagagaggaggactcgtctagagagatgaggctggcggggctgtgggcagggcatgtgggtgtggggacggtgtgggccatctctgagggcgcctcagagatggcagatagtgattacagcagctgtcctctcgcttcccagccaaagttcagatcctgcggctggcagcccaggagaggctaggtgaaggtctggtgcagagggcagctggctcagcctggccatggggggcttagcacttctgtgtcacggtgacacctcacccaacctcctctgcagccaacctctgctaggcccaagattgaagattagctccgtgggctggagtttagactttagccagtttagacgtggccgcgggggatgtacgggacagagctcaggcaggccacatcaagctctgcccccccaggcctcagttgccagtgggtgcagagcttgtggcctcagggagttctgctgggtagggtcaagctcacactgaagcttggctgggtatgatgggctgggggagcgtccctgtaggggagtggatgtgatttccaggctttctggccccgtctcttccctcccatctcacagggcggagcctctgcacctgctggcgaaggcttcaccctctagtatgcgcatccgaggcagaggcgggagggtgggccccttctgtgccatctggaacagaggccacaccagcctcccgtgccccattccctccctggccttcattttttatagtcaccccaatacttgggctgggcgtgttgcaaatgggagagaaagaggagcagcctagtgtggggtccggccctgggctgagaggcagacacctgggttcaagacgtgtccactgctaacttgttgagcttctttggagctgcggaccctgaccctcgagagggaactcaggtcttgtgacctcacagccacacccagacagccagctcacttcattgctttgagcttatcacccatcccacgaaagctggctaagagcagcccagcaggggcagtgctgaacataagggcgcttagcatgatggtgggggctcaggcgctgtcctgtcccaacagtggaagggtggggttcaggacctcaactctgggcctagaaatagagaaggtacccctctaagggctcccgtcagacactggccctggaactggaggggcctcaggggtggcctggatgcctcaagaggagcagggaacagtctgggcagcaggtgacacactctctttcatgacctggggtaggctcctgcagcctctctggccctgagccccagcccagtcaaaacctgggtggggcaagtggttggcatggagatttccaaggaaaacagagaaagatgtggcaggaagtggttggggtgagtcagggggtgtcccttcgggacatgctggggacaactttctcctgactgactcagggctcaggatatgccctagagagaccgtgggcctccgtccagcctgcaaggtcccggctagttctaagagccaaataccaattttggctaagggtgagaggctctgaggctggggtggacactctcacctgtccctgtcctagctcagccactaacaccatgtggcatcacacaacagactggcctgtgtggccctagttcctgtctatgagatagggacatagcagggtgtggctgggctctgagaagtaggagatgctggtggactcaggattcctggcatttgctggcttttttcattcttctgctgtctggtctgctcagccggctccctgcaagcatgaccagggactgctgggtgctcaatgcagggctgggttagcccggctccctcccgagagaagcccacagccctaggtcaagataagccagtgcccagctgcctgtgatatgaagcaggaggcagatgcgataagaggtgtcagggcgggcccgggaacttttgaacttaaggggtgggagggccaggaaggcatcagggaggaggtttcgtaggagcctgaatgtggagacactgcagagggaaggggcagagggactgtgtgagcaagcacaggctaggaggaggtgagggccgtggtacgggagttgttgggtatggtcaggctgggggtgcatgggaggagggtggtgagggctcaggattcgggccaggggctgcatccgggggaaggggtctggattcccagagcctgtgatttcagcccgctgggctcaggcagagggcaaagctaccctcttcggggtcttctcccagccctgctaattccaggcctgactgctcaagaagtgtttctacctgcagcatcaggggcctgactgaagccctaagttctcccctttatcccgtttttctgggcttcagtttccccagtcatagagtgagaggcctcttcatgccaccagttctcccgggggtgctgctgcctcctccagagctcaggggagggatggggaaaggaaggcagagtttccatgtccctgcccagcccgtcctgcccagggaggggctgggggctgggtggtgatgccacatctgggacatataattactgtttccgccagccccagatgagggggagggcacagagatggggagctttgtggtggagacttccctcaccatggaaaatcctgacgctgcttcccctttagggacctcagaacagcccagccggtcccagtgttgcccaccctgatgcttggccctgactgggatttgccctgggaactctgaaggggccatgctttgagaggggacacggcctcctgggatacctgtctgaggggctcaccccctgctcaccactcccaggccacagcctcctgtcacaccttgccttcccttctccaccccaggcaaccttctagcagcatgaagtggccattagctcactgcaagccaattccagatggtacccccacttagtctagggcccccacccagcaggggccatggcccttaccttctggaagcaccaatgagtctggagtctcctgagtggctgggatctgagccctcacaccgggaggtgaaggcaggaaaatgctgtccgcgaggccctgcaagtggccaggatcccctcagtcagggcttccccatggggatgagaggggctccttgcccacatggagtggtgcccagggggatcatgaggggctgtcttcactcagccaggagctacagttctgtggggtgggcagactctgaggctgaaatctccaacttaaaagatatccggaaaggccggaaaatgcccccggcccttccagcagctcctttcagtgcctgcaatctcgctgtcagggccccttgaaaggcagatttctactcagtgtaaagaaggttgttgttgatattgttgttgacacgaagaaggggctgtctctaagtcaataagctccctgccattaggggtgtgcaagtagatgctttctggtgaggaggctgctttgggggtgctagtctatgcgggggtccagtggggtgggtgacaggttctgcagcataggctttgtgtcatgctgagatcagcaattctgatggcctgcgggggatcctgtgcttaggtttctggatctggggctggagagtgaccaccccgatgtgaggcaggaggcacttttggagactgcgggggctcgaatctgggccaaggcctccattttactgatggggaaactgaagcccacagaggcgtggagacttgtcaaggtggcactgcctcctagcccttgattattcctgctgctccaaagtgtacacacatggcacaaacacaaacatgcacacacatgtgctcttacgtggaggacacacacacatggtacacaaagcacattctcaagactgggtggtcccactcagactctgggacccaaggagggttgggcggggattcctcaatggagccttttcctctccctgccctggagttaggaaaagaaggagggagggagggaggaagccattgctttgtgtattgtttcttgtcaggaagatgaaatggcttctgggagcaaataaaggccttgttgagacctgctgctttctcacatggggggctcatttttttctcttctcttccctctctagctggtagtggcagctatgtgggtgtgtgacacagggagacagtgaggcacccagaagtgccatcagacataccagtgcaaacacacagcacagcctccaggacctcatgtcctgcagggatgcctgtatgatatagctgttcccagggaggccgaggcacttggtcagtacctcatcagttgatgaaaaagagtgtgcattctctaattcaggggtacagggttttcatatttttctgaagtcaagcttgttaattatggggttcaaaccctccctgatcatgttattggtagttttcggctgcttcatttattctgtacatttctaatagaagattgttaacatttttcactctggtggtagggtgatccagtcctccttgtaattttgtcaattttcccctcatttatttttaggctatgttgtttggtgcatacaagtgggggatttttgcagttcctttatagatttttatttttttttttgagacggagtctcactctgtcgcccaggctggagtgcagtggcaccatctcggctcactgcaagttctgcctcccgggtttatgccattctcccacctcagcctcccgagtagctgggaccacaggccaccacacccggctaattttgtttttgtatttttagtagagacggggtttaaccgtgttagccaggatggtctcgatctcctgaccttgtgatccacccgccttggcttctcagagtgctgggattacaggcgtgagccaccgcgcctggccagttcttttatagatttttaaaatgtaattattgtgtaataaaccacttacaatctaacaaaaaagagaaagagggagtcagccctggacacatgtggtcatcacagacacagcagacacttatctacaaagacacacagaggcacacaaaaccaggaatccccccatgtccacgtgtgaacacccatggaggagtgacactctggagcccacataggtcccctcactgcccagtgctgagtcttggaggcactggggtgggcagggcaggcctcgatgtctcctatcccttgagaacgaaagctcagagcctcagtcaggcctggctctggagcctgctcttccccaaggccagggcaccagggtgcccaggccaagtcaggggccccatgccttggaagccaccctggttggcctgtctatgggtagcagggagtgcttagagcacattgcctggagagatcatccctgggctgccctagagccaggacacactggcagccacagaaccaccttctgccagctcccaagtccaagctgggaatagccaggtcccttgactgggcctaggagtggccagcccattgacctgtgagtgtagggtggcacagactatggggcaaggatcctggctttgctgcatcctccctgggcctcagcctctgcgtcatcatctcactgagccatcgcacaggctgccctctagggctcccagaggctaatgattggcccattgtttcccagctagaaagtgaagaagaccgccctgggtccggagagcatctctggagccaggctgcccctagcaagggtgggagttctagaaaattagcattctctgccacttctatcagcacacagtaagcctcccctcagaggcgtgggcagagaaatggcagaggtcccccactctgtcttcaccgagctcccaggccaggaggagatgcacccacataggccgcaggaagattgatttcctacaagatgcacagagaattcagtgagggcatggtgggtgggagcagaagttaattccagccagggatctgggaaggcttctaggagctggtggggtctgaactgggccttgagtagtgggcttacaagggcttagcacaaaatggagagcttgtatctttctgacacttcagaagaaatgtgtggattattctttcggtaatacttgcattcacaaaacccagggctgcagacaaaagcgggaagacaattgagaattgagaattgagaattgttctgattcttacttttttttttttttttttgccttaataagacctgggccaggcaaaactacctggggatgtgcaaatatatatgtacatatatataaaacaagtgactacaatgggaactgtccttgtttaagcaagttttcaaatttaatgggttgtaaacagtaacgtacatttgaagtattttacctgctctttcctggacattgagtttcaacaggcctttgagtgccccttccaattctgaattatcaagtgtttccagatgtaaataatgcaagtgtattagatagttgaaggaaggttgtcagtagatgttgaagctatcaggggaggcttcctggtggtagtggtagtgggtattggagaggaaggctgtcagcccatgtggttctcagcagtcacgaaggcacattccagaattcccagggcaggtggctgacccctccccttcccaaggactcagagtacagggcctggaactatcaccctctgctctgcccactttgcatgaaaagcatgttgtctttgggtaggggctggggctctcgcacctggttaagaaccagaggagatgagctctttctggtcacatctgtgagggatggggctgggagggttctccaaggcgggagccacttacagcgatgactccattaatcatcggggaagggctggtttcaggacttctgccagctagcaattaggccaaccctggagagcagaagagagaggaatagaaggagccacgagcttcctgagggctcagatacagagggacaggggcctcacaggtgcaagtgtgggtgggcatcaggactagccgggctggcctcaccagcctcaaccccattcagcctgtcctaactctgggcaggcttctgccagcagctccacccgccgtcactccttctgcctgtccccagatcctgcacacacaatgagaagaaccaaaacaagagtcactaccactgccccatccctcctgcgtcgacaactctttccaaaagccctgagacggcccctttggcctttgaacctcccagctgctctggagagcaggcacggacaatgagatccattttgcagatgggaagactgaagaccagagggaataggccatgctcatggtgccagaaagtagaagagtcagaacctgaacacagggcttctgcctctttggcccaaccttgggacagaaagggaactgggcattggccagagggctggcggacctaagggatgtagccctggggtccgccaggaaaggcccaaagctggggctgcaaggcaggggaggggatgtgagtcattccctgtaacccagggctgcagacaaaggcgggaagagaattgttcttgtaggatggcctcagggtggggctgggaaaacctccaaggtgtgcccccctaccttggattttgcaaaattctctatggccttggagacactcccatatcctgaggatgggagctgggtagtttgtctcccagctgggaagtgtttgggtgcaccagccctgcctgggagaaggcagcctaagtggcctcaagtgggcatctttgcaagtgagcctttgctgatgtggtccatctcccctgtgtgagtgcacttagcccctgggacggccacaaagcatagtggaaggtgctggggcttcctggggaggggtcctccgggggcagctgcatggggagggccttcatgacctcacagcagcttccattcccttctctttccatgagtcatgtttctaaaagtggcccaggagtaagtggcagccagacggtggtggcggggcctatctggccaggcagagggagggtgaggctgaggccagcagtggggaggaagaagagagaaggagagacagggagggcagggccagaagcaatgggagacaggccttggaccaaggaaagagacggggtggagaaggagagagagagggtggagacaatagggaggcaggcacagaggagaaagaggggtggagggagccaggacctcaccgaaggcctcctcagccctggaatttagatgcagtcgggcatggggtggaatgttctggacttttgggtatgaagccgtgtcccctgctgggccttcccacctttttgcatctcttctcctaggagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcaggtattaggggctgggctggagtttcattaacacagggggtgggttcaaggcctgatttccactacctgccgtgtaggcttgcctgggaccctgtgatgggctctgaaggcccatctgagggtccgcccttcatgcctgggcctgggaggcctgggtatccttggggtcctgggacacagtccctgcctaccctcctcaccagtcctcaccacctctctcccctgcagctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctgtgagtcaggggccctcccagatggaggtgggggaagggagggcgggggctggtggggtgccctgccatgggcagccagtgggactcccgacagggctcttgccattgggtggaggatggcgggtcagcgctgggggctgggggcagggtcctgccctggagaggagcacagggacctcctgcccagcttggggtcagcactcctctttccctgggtctcattgtcccccaccctgattgttctctttctccctccaacctctccctcctctcactctctcttcacctatgactctctgccttcgcccctccctctgtttctttccctcacagattgactacactggctgtgggattaaccctgctcggtcctttggctccgcggtgatcacacacaacttcagcaaccactgggtaggagacccacggggggtggggtgggaagctttggtgtcccatggtaagcctgaccccaccctcacagtgtcccttcctgttctggaggctctgggagacagccagaggacaggaaatcaggaaactgaggcctgccatgtagaggcaggctgggggtcacactgccagcactttcaggcctagtctctgccctcccagctcggccctgccccatgctgcctggcctccaggtcttcccagctgcgtggttaaaagtggggctccaaatcctggctcagccactttcgggtttagcatgaccttgcgcagtgtgcttgagctttggtttcctgagctgcggagggggatatggtggtgcccacctctcagggtggccgagaagaggaaagggctcactccccatctgtaaactgagctcaacacagaggaggcgctcagtggattttagctcttatggttgtggatgtggatgtgctaggccagctttgcattagacaatggtctctggggcccttccaaagctgggagtgtgggggcagtggccttcctcaagaaggggctgctactgcccatgcctgagctgggccccacagaggcaaggagttgaccctaccacgtactctggcctgggccggttctgaggggcaccggaatcatgatgttaggatttggctctcctacctgcctccatcccaggtgggaaaaacctgtccaacggggtggtgggctgtggggtaacctagggaacgcttcccaggggcttttgagtggagccctctgaacacacctgctctgttcctagattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 36926 - DNA, 63491 bp, Homo sapiens
agttgaatgaaggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccaggggaagaaggtaggaacctctaagtgtcctgttggggccctggtcatgggaagggagactggacctagcaagtgggagccccgacccacctaccctgcagcttcagccggcagtgcccaccagccctccccctggaactcacagccaagacttgcatctagaaagcaggcaagggctcagggaagaaccagtgtcctatctctccatctctaggacagactcgggggcagccaaatctctctggctccctggtcttaaccacacacatctctacttccctgaataaaagctccctgggtaccccttccccataccccaggagagtgtctgatgcaggtggatacaggggaaagatcttaaaattattattataaagttagctaaccagctgttaccagttgtagggcaataggcaagttatttaagctttctgtaccttatttcctcacctgtaaaatagggccaataataatcactaccttggaaaatcattgtgaaaattaaatgagtgaaagtgtttggaacactgcctggcactgtgtagaggctttgctccattattattagaattctattcatgttattatccctcaccttctaagcctgagctctcagctgggggtttgtagacagcattgcctgagaactgtttctggaaatgtgctctgcggacccctgcgtcagcatcctggggtggggagtaggagggagcttgtgaaacagtcactttctcatggcccatcagacctcctggatcagcctcttaggggcaaagaggggcctgcatttactcaccagctctcgggattgtcctacgtgctcactgctctccaaccacaacgacccggtactgccatcccagtggcatagacaggctgccgtgtcccagatccaccacccacctaccgtggcgatgacctgaacccctctggacctcaggttcttgtttataaaggggggctggtacctgcttcgtgggaagttcaacaagatgatgcctgtgaagtgctcagtgtgctaccccaagcccagaggctccccgataaacatgggactctgatcctcagacaaccagtgatgacctgttccatcaaggttgagaaactcaaggaagaagtaatttcttagccagggtcatgcagctagtgggggaaagagcagggtactgctattgttgttaatttggaaagaggagctttatttctcataaagggttgcagcctgcagggtggccattccgagaggctgggaagcatggcctctggccagaatccagaaactgacactttgaggaagaggcaaagggagtagaaatttatgctgagcagcatggccaaatatacatattcaataagctgtgggaggggtcatgaatatttatgaaaggagaaacatctacatgcacagttgagcttcatgcctcttacaggccccaggtacaaaaaaatgttggccttagtgtgatctgagggtggagttttcagccctctgatgtcaaaggtgaagcagggagcacgaaaaccctcactgtgcatcctctgcagactggctagaaccgctccatgattggtgatctcttatcaagaaagaatgctggttggtttttgtgttaaaaccacaaaagggaggggcagttggttgaaatcagcatggagtcttttgaaaaggcctgtttctgtttagctcttagggaattaggataacggaggttatcaagggatggcacactacggggcacgtgcgacctcccatcccgtcatggccagaaacccggttttcaagatttctctggggtctccttggccaagagggggtccgttcagtcacttgccagagtggaggggtggggtttgtttaaagttttatttttatttctcatttttattgggtaggattttgaccccattctgcttgactccaaacaacccagcccatcccacccttcctggtccatagctctgtccacagcatcttcctcagccccaccccaacctcccacagaaggctgttgatcaggcaggcacctgctgccctatgccagggcctatgtggagctggagccaagggtgaggagacacagcccctgcccttgaggccgtccctgtcagttgcagagactaataggcaggcaaaaaatagttggtagtatgtgtgaaagttgaagcagaggtgactgggcacatgacccctgggccaggagtcaaaacacagcgttgttgcttctattcctcttaggcaaggtctggactttgcttttaggtgaactcacctttgtcccctggggaatgtcaggggcataggctttgcctagaatcctaaacccacactggcaggggatggaagggatcacgtggttggttaaggccaaccagagcccacccttggagccacagatctgtctcccaatggcatggctgttactcaatggaagggagagtgctggacatttcattgtaatggccccccaggaggagagacagcgttctctccagctgtggggtgggcagagagaatggaagaacactgaaagggtcgagggtgtgacagatagaccactgggccaggagtcaaaacacagacattgttgtttctgttcttcttaggcagggcctgaacttcccttggacttggcatttttttaaatctgcccctatcaagggcaccaaggtgggtaccctggcctctatcagggtttttgcaagaagatattttaacacacagaagcaatccctctaacactgtttggaacattccagaaacttcaacatttgacccactgggcatgcattgatgccagagaggtgagttcaacccagatgtctggatgggagccacgttttaagcccttgcattacacagcaaggccacaggtcctgcggcagcagtgggttcaagaaaagcaccttccatgggcctcagacaccagccagttcatagacaccaacagagtgtgggcacgccgtcctccaccccaatcagcagtggccagtgccctcgcccaggatagaggacacaaccacaagcttccagaggctgccctgcacaagtccagctccccaggctgtgaccgtaatgccacccttaaaggggctgctaaatggaaaatgttcctgagcacagctcgcatgcactgccgcttctgcaccaattcgctcatttagtcttcaaacagctcttggacatggagagttttatcacccagaaatccagagacgtggagaggttaagcaagaggctcagggtcacccagctagtaagggtggagttaacatttgacccaggctgccctaagagcctggcctctcaaacagcaaaccccactgccggcgcttctgaaggtggaaacacaacagtgctcacatcccacctggagcccctgtcggggcatctcatttaacccctctgagcctcagtttcctcagctgtcaagcagcatgatgatttaccttccacagcaggctggggcgaggtgcccagcactcagtgggtgctcagggaatggcacgtggtcctgttgctgctgctctagaggctgcaggtggagcttctgcagggcaggaggcggcagcatagccccctggaggtttggacacttggctttcgttctgtaaaacatttctccaaacccaacaccacccaggttttttgtggccctgaaagagtcctgtcctctgaccctgttgtttaccaagacactcatcgctttgcattcaccttcattaagagaaagttgccttgactgaaacaaaaggggaaaaaaatagaagcactatggctaaatttgatgaatggcctgaaagggtgtgttcattctatcagagcccagaaggtacacatctggctgggccctgctggctccctgaacaattttccctgccgatgatggatgggcctgcctggtgctcagggccgccaagcccagcagaggattccagctcattgcgcccagctcagtgacgtgtgaggacctcatcaggaggcgctcacagcatgccatcccatcaccctgactctgcccaccgcctcagacggcttctctgaggagaaaggggccttgcacctcacttctgggtgccattgggactccacagctgggttcccaaaggactcctgtgcccagagtgggaggctcaaggacaagaggagaaatgtgtcaggagctcatgggggtgaggaaaaaatatcccccccaacaaaggcagagcccccctcctgcccagcagcctccccactgggccctggtctctgggatcattccagcctctccaccttttctcactccatttgcctgcctgtattgccctcctgatttctatccaccgccaacacttctctgcattccagccgcagggcttgccccacctgctcttgtaagtttctgacagcatgtgaattgaattccaattgcactgacagatattccatcccaaggtgtgagggaagatgacggaaaggaagaaggggaatgtcaattgtcgagctccaaccccaccagcagccactatgctaaatgctttcttttggggggggcataggggtagtacagagtctcgccctgtcacccaggttggtgtgcagtggcacaatctcagctcacaacaacccccacctcccagattaaagtgattctcctgcctcagtctcccaagtaactaagattacaggtgtgcatcaccacgcccagctaatttttttgtatttttagtagagatggggttttgtcatgttggccaggctggtctcgaactcctgacctcaagtgatccacccacctcagcctcccaaagtgctgggattacaggtgtgagcccagccctaaatgctttttcatgctgtccctccagcacatccacagcccagcaaagtagaggctgctgtacccacttcttgggtgggaaccactcaaagctgctctgcccttcatgccaattccagtcattacttgcctgggcctcagtgcaattcccaagacctctcccccacctgacactgagctaggcatgtaattctcacaaatgccccatgaaagggctaatattctcatgcccatttcacaggtcaagacactgaggctcagaggtcaccagtaaggaagtggcagggctagtgttgcactgagctgtgcctagccaggcagcactctcttgggcaggccaggcacattgcatcctgagctcaagttctccccaccaccctgcaacccccgttatgcagatgtttggaaagcatccagactcagggagaagaggcctggggccaagtggagcctctagcactcactctctgggtgatgtttaagctttgctttcctcatccctaaaatggggataaaaatagcacccactttagtattatcagtgtgagaactaaatgagaaagttcttgaagtgcctggatgcatgcttgcccttgggtctcagtgtccccatctgggaacagagaggtttgcattaaatgattcccagtgccctccccaaccatggtaaaaatgagcttgtcactttgtccatagcaagtctcagtgcaaaatgaaaatgtggggtcccttgttcaaaaatcattaagaatctcaagacagcaacagcagagcattaaaccaagcacagggcccttctgagctcagagccctgtgcagctgcacaggtcacaaccccagaaagctggccccagtccttagtgccagccaaggtgacatctgtgcatgggaggccacattcctgagggctctggtcaggcgcaaacacgtatgctggggttgtgagcatggtttcccaagcgctaaaatttgtcatttagttccgggctccccttttactctatctatttacccgctagatttgaaagtccctgaatgatttcctccccagcctcagcaaactggtaaatatactgtcctccccttccctgggaaccatgccgccacctccttcactcccaccttcagaatggcctgggctgaaactcctgaaaaagttagagttgacatttctcccctggggaagtccaggggcagaaggtgagtgtagaggaggagtggggactagactggctgcagccaaaaagggcatttgaagacaggcagagtgacctttggaggcaggaaagggcacagttttcctgctctccaaggcctcctaatggggcttttatttccatctgtccttggccttccccaagctgggttcaaggtttgaatgcccagggctgcttcaaacaggtgtacaggttgggcactgcacaaaggcaacaagagaacgggttagtgggacatccggcccaccctctaccagtggagccatgtgcccaggtgctggctgggtctccccaggaggagtgctgctccgtcattccacagcgtcatccctcacagccctggaaccgcctcttccaagactaaaactttccccatcctgtcttatggctggaagcccagcttaggagggagaaggaatcaaaggagaaagaaaggaaaaaagataccggctcagccgagacttcttccacgaagccttccctgagtggatctcaaatatctatatggggtgaggggcttagataagtggacaagaacagggcaagcttgtctcagaaccgcatgtgcattaccaggcctacaggttttgccaagcctgtaggattaccaggggtggctgggaaggtcagagagattagaagggggtcaagttcctcagggaccccatgacaccatcactctccccacttccccggactagggcaaaccccatcacactcacagagctctctggtctctcctccacgctgaccactctgtgatttcatgtatagttctgtgatttatccatgagggaagggaggccgtttgatttttggtttaccattgtgacatagaaggtgctccattaattaattaaggaagggagggcaggagagagggaggctgatttcccaaaagctaccctgagttgaaggccaaccttatggaaggatccatgcagaacttcaggctggggggaagggacatagactgaatccctcagtttcccccacatgtccctccttcccctccaatgtctctaaggctctgatccaaattctcacattccccaccctgcctccacctccccaccacacacacatacacacatttacacacactttccacctgcacaacttcctggccaaatgcaaaatccctcatggcttgttcatcatttattcaacaaatgttgactgggcatagggacccaggcactggagatagatgagtgaatggcacttaggctcacccttggggtgcacagccccatgggagagaaataagccatccccagggacagagcaggtgctgggtactatgatgagggaagcagataggacctggggcactgaagggggacccacgaggccgagaggtaaaagacgaagaaggattaatcaggtcaggaggcggggagaggtttccagcaggcaacagcatctgccaaggcctggaggtatgagaggctgcggcatgtcccaggaactgaaagaacttcttggttttccagccctcttcagcctcgtaggggcccccagattcctggttctggggttagggactgccacagatttggttcggtggcaccttaacttctcccacctatcctgcacttaccctgccatgccatcctctcctctcaaaaaacagctatgtaaagttctggtacagtggctcacggcctgtaatcccaacagtttgggaggccaaggagggaggatcacttgagcccaggaattcaggaccagcctgggcaaaatagtgagacccatcactacaaaaaaagaaaaattaattagctgggcatggtggtgcacatgtagtcccagctactcaggaggctgaagcaggaggattccttgagcccaggaggtcaaggctgcagtgagccatggtagcaccactgcactccatcctgggtgacagaataagatcttgtctcaaggaaaaaaaaatcacaactatgtttctgcctcagactctttgatcaaggagaacattctttttttctctcttctttcttttgctcactattcaaaatagagataagagagaaagacagagacacagagacaaagacacaagaggcaaaacacaaagagaaaatcccccagaaacagaattgaagaaaccccaaacctgtccccctgacttcaccccctgccccaacaccaccctccaggtgcccaccagggcccttcttcactcccagatgttctaagacctcaagagaggaagaggtcacagggggcccaagatgggcaccttccccccatcctcgggccttggggccaaatctcatttccaaggcagtagagagaaggaaattattttaattctttttaaatccactttaatcttagtccacctcctcctaatccaatcttcctcgttcacgaataagaataaaatattcgcctcagaggccctgaatgagggaccctgggcaagatggcctccctctctgggctcccactctgggctccatgtcaaagcagagaaggtagctgtgctgcccactggtttagggtaaagtgaggcaggagagaaaaagagagggcagcaacagtcattcttcggagggccaattctaccccaggtgcagagccagggcctcatgtgtgcagcatcactggcttctctgagcagcctggcatgggtagttttccccatttcacagccatgaagggctcagacaagataacactgtgcaaaagcaggctagtgttcagattcctccacatgcaccaaaagccaaggccttacagaaaccttgcacaacacagccaacctgggcctaccccccttgagcctcactcagtccttctcatctgcaaaatgggcacttcctgaagataaataagaatgccttctaataattgaacttccatggaatcctcaccacaaacccagccacaaaggtatcgatgtccccatttcaccaaagcagacgctcgactcaaagaggttgagttcacgtctcaagatcacagagccaacaagtgccagagctgggacttgaacttggatacttctggctccacagcccacgttctcatggacttgtttttcaagcgtcaggattgaagctgttcatcttgtttttcaagcatcaggactgaagctgttcatgtcaagccagaataaatcttcaccttgtgcaaggcagagttaatagtaggtagtggctccactcccctgggagtagcactgaagaggggcctaaagttcaggagaatttaatttctatcttgaaagggtttggaggtggtgcaagaggggccaaatcaaaagccggttttctcgcaggcagaaacccaaaaacgcagctccctccctgggccccagggatcggctttcagaacactgtgtctcccaaactaacataaacaaggggctttgtgtaagtaagagatcagatctcagggcctggggcggagagaaaggcgaggagctggaactttctttttcatctaaaatctaagatgacagaggctgccacagggaagctggaagagcctggcttggtctaggtgacatccggctcctcaggaagctcaggacggggcctgaggtgtcccatagggatgatgtcacacctagaacctgcaggagctcagccagaaatggggcagtgtctgtccttttgagggaccatccggggatttttctccacccacctgagctctgggaacaggtaggggtcattctgagttgtatgatgtggtgcacgttcaggaagaggcctgccattgagacctgcaggccctgaaccggccagcgtctgtgaaggtcccatgctgactctgccatcacaagcaggcactgtgaagtgacacaggagtttcctggggcggccataacaaacgatcagaaactgggtagccgaggccaggcgcggtggctcacgcctgtaatcccagcactttgggaggccgaggcaggcggatcacaaggtcaagagattgagaccatcctggctaacacagtgaaaccccgtctctacaaaaatacaaaaagttagctggatgtggtggcgtgtgcctgtagtcccagctattcgggaggctgaggcaggagaatcacttgaacccgggaggcggagcttgcagtgagccgagatcgtgccactgcactccagcctgggtgacagagcaagactctgtctaaaaaaaaaagaaactggggagccgaaaacaacagtttattctcgcacagttctggaggctagaagctgaaatcagggtgtcggcagggagtgctcctcagaaggctctcagaggatctgttccatgcccttctcttagcttttggtggtgcctgcaatccgtggtgttctgcccttgtcatcacgtggtggtggtggtgatggtggtggtggtggtagtggtggtgtgtgtgtgtgtgtgtgtgtgtgtgtgtgtgtgtgtgtgttctcctcttataaggacaccagtcagattcaattagggcctaccctaatgacctcatcttaacttgactacatctgctttccaaatctacatttggaaataaagtcacattcacaggtaggagctaggacctcaacattccttttgggggatacaattcaacccacaacaataacgcctggccccctggacctctgtacttggtggacattcttctcgggcacctgaagttctacattcctctggctgagacccatccatcctctgccagctgctctcctggggcctcaagtccaatgtagctcctgtccagctgcagtgcgttcccatatggcaaagccagaatgagctactttaattctgaatctgatcccctcttctctccggtaaaacccttcaagagctgttacaaggaacaccacaggccctggctgatcgtgctctgggctccctactccatacacactgggctccacaggtatctctgacagcccaatctcttccccacctcagagcttttgtctccactgttccctccacctgtgcacctttccctaggtctcctcatgattgactccttctggtttcagctcagagacaagtccttttttttttttttttttttttttgagacagggtctggctctgtcacccaggctggagtggtgcagtggcaaaatcttggctcattgcaacctctgcctttagggctcaagtgatcctcctacctcagcctcctgagtagctgggattacaggcacacaccaccatgcccagctaatttttgtaatttttgtagagacagtgtctcaccatgttgcccaggctggtctccaacttctgggctcaaggaatccacacacctcagcctcccaaagtgctgggattacaggcataaggcactgcgcctggcattctctatcttccctccagctaaaatccccccatcttggtcccaagtcctgcagttccttcacagagcttaccaccatctgaaattaccttctttggttatttaactgtctcaaatctagctttccccatcagcatgttgtctctgtaagggcacaagaaaatctttagatccaaatgacaatgaaaatactatatattgaaacttggaggaagcaactaaaatggtccttaagaagaaggttatagttttaaatgcacattgaaaagaagactgagacttactgagctaaatgtcaaagttacaaagttggtaaaagaacaacagaaacaatccaaagaatgtaaaagtcatgaaaaaattaaaataagaaccaaaattaaagaataaaaatacatgatattgaagatggccaaaagttggttcctttaaaaacgtaatagagaatgatgtagttggctttaagaaacatctagaaaatattgttgaacaaaaatcctattggcttgggccagacgtggtggctcacgcctgtaatctcagcactttgggagggcaaggtgggcagatcacttgaggtcaggagctcaaaaccagcctggccaacatagtgaaaccccatctctactaaaaatacaaaaatcagccagatgtggtagtgtgcacctgtaatcccagctactcaggaggctgaggtggtagaatcacttgaacccgggaggcggaggttgcagtgagccaagatcgtgccattgcactccaccagcctgggcaacagagtgagttaataacagttaaagaaattgaatcgtcctggtgcggtggctcacacctgtaatcccagcactttgggaggccaaggtgggtggatcacttgacgtcaggagttcaagaccagcctggccaacatggcaaaaccctgtctctactaaaaatacaaaaattagccaggcatggtggcaggcacctgtaatcccagatacttgggaggctgaggcaagagaatcgcttgaacccaggaggcggagtttgcagtgagccgagatcacgccatcacactctagcctgagcgagaagagcaaaactgcatctcaaaaaaaaaaaaaaagaaagaaagaaagataagaaattgaatcatgagttactatcagaacagcagttttataggtgagttcttttaaactttagagaaattcatcagtttgggttcaggcagagtcttctagacaatagaaaatgagggaacacttcctgcttcattttataataataataactgctatcaaaattaaacaaggacaatgaaagaaaagtaaattacaggccaattcactcatgacatagaagcaaaaaacaaaaaacaaaaaaaccctaagcaggaatccaaaattccacagccaggacctggcggcacagaaattctttttagccacatcccactgacacctcctctctgtaagtctggcctgggacagcatggctaatgggctcaaccctgaaatggctacgggctctctttcctctggagccagagccaggccagagtcagtggaaagtttcagcggcagtttttccagggatctcccatccaggctcagccaggtgaatactagagagagactgacttcccctagtgactgatgctgatccggtccagcccactggcacttcccaggtacagcaggctgcagggagttgtggcacctgcaggagccagagccagaaggctgtctgaggcagatgtaacgtatagaccttggacaggccgtaagggctggacttccgccttctgcctcctgcccatcagtctccaccatcccagggcaaggacttggcagctgtggtaagctgagcacttgggagggttgagcctccccaagactcacctctccctgggagatatggccctagggtacccaatcctagggaggggaatatcagggaaggcttcctggaggaggtgccatctaagcagagtcctgaaggaagaagccaggcaaaaagagggcaacagtgttctaggtagaaagatctgcttacacaaaggccagaggagagaggccttgctggcactcagggcactgagagcaagttggtcaggccagagcagcaggcaggggctgggcagggcaggatgaggggtgagtactgtaagagagaggacacaggggccagaggttgatgaagtcagaggaaccaggccaaggatcttggcacgggagggctgaggtcagctcactagagtcagctctagcacagcatgagaagcctgggcagtgaagtcagacaacccacagtttgactcctgctccccatctcactagctctgtaaccttggccacctccttgatctctcagcctcagtttcctcatctataaaatagatcagtaatagaatctactgagcacagtccttgacacatagtgtgagctcaacaaatggctgctatttttgtcggtgttacctgacaaaacaggcagttggctcccttgggctagatttcagggcagagtcacggctggcgatatggagctgccgaccatcatcaccttccagagaggtggtgactgaagccccattggaggaggtaacgggaaggacagcagtagaaactgttccctgtgcgccgtcaattcctgcagcgtgggagtggagagtcaactagagttgctcctagaaaggaagagacccacatggctgctggcacaataaaaataaacatgactccaaactgtgcataaagatgactgataacaggcaagggggcggtgatgagaggtgatttgattttttctctttattttccaatactttccacaataactttatttttattattttaaaaagtgaacttagctcttttttaactaagtgaacttagtcatttttcaaacttttctcatttctttatttctcaaataatacattattattgtagaaaaatcagcaagtataaccactgtgacactgtggcatgagtctgtgcagattttcacccctccatctggttacctgggtccttttttttttttcagggtctctctctctctctgtcacccaggctggagtgcagtggtgtgatcacggctcacttcagcctcgacctccctggctcaagtgatcctcccacctcagcctcccaagtagctaatactataggtatgtgcctccaggcctggctaatttttctatattttgtagagacgagttatcacgatgttgcctaggctcgtctccaactcctgagcacaagtgatctgcccccctcagcctcccaaaatgctgggattagaagtgtgagccactgcacccagcccaagacatttttcatgggtacatagcattccactgataccaacatgccacagtttttttgaccaatccctgatttttggatatttaggttgttttcattccttcacatcttagtagatatattttggtgcgcatcctttattctttctttgggatagattttacttttaggatcatgggtgggtttctatgaagttggatgcaaaatgctatgtgtatgtgaggacatgtagactttccaaagagagagagaacatggccttgtcagatccttaaggtagctggtttcccagagttaagaacctactgctatgaaaaaaagaagaagaaaaaaaaccacaatctgcagtgtgtgactcatctcctccctgtcttcattctcacccagagcagtttggcaacaaacaatttcatttcaaaaaataatttaccatttagttagtaattactatgtgcagaactctatccaaatactttacgtgcaccatcctacaacaaccccgtgaagtcggcactactgttatccccattttacggaagagaaacagctcagagaagtcaggtgccttgtgaaggccacacagcaggtcaatggggaacccaggaatcagacccaggcagccgtcccagaactctttctctctctgagccacccacttgcccaggtgtcactgcccagtgcagtgggtggggttcccagaacccaggaagcaatccctgaagcagcatttccccacctgctctcaaccaagttgtcaaggctccctgggctgagtttccatcagggacctgcccataaacagatgatgcggaacatcaagagtatctgcctgattggaggagccatccaggttgggcaaacatcacactggctggactgatcctgctgaagccacaccagtgacacccccacctgttcataatgacaccctctctgggaatacagggccagttgtcaagattctgctgatcttagactgggagtggggagtgaaggggatggagctggtgttgggggcccctggcagggcctccttgcacattggagcttgtattagttcattctcatgctgctatgaagagataccagagactgggaaatttataaagaaaagaggtttaattgactcacagttccatatggctggggaggcctcaggaaacttacagtcatggcagaaggcaaagggaaagaaaggcactttcttcacaaggtgacatggaggagaagtgctgagcaaagggagaaaagtccctaataaaaccctcagatctcgtgagaactcactcactatcatgagaacagcataggggtaacagcccccatgatccaatcaactcctgccaggtccctttccatgtggattatgggaactacaattcaagatgagatttgggtggggacatagccaaatcacatcagggcttatgtctgcagcagcccagaccagaggcagcattatctggtgtgaagcagccaagtcaaatgccagaagagtggctagagtttccttgaggttaaccagccactgcttcaaccagccactgcttcacccatccactcaggtggaagagggtggcccttggaaatttgagaattcctctgggaatatcagtgataaagcttttaacagatggatttattgagcacttactatacaccacctatgcaagcagcttcagttatctcatttcatcttctcagcaacacttttgttatccccatttctcccatgagaaacttaggcatggagaagttaagagggtgacagagctaggaagtgtcagggtagagatctataccaaggcagagcccacagccttctctttctatccctcagcaaatccaggatactcagggtcaagttccaaatttggactctaccactgacagcgagcttctcaggggcagggccttcgtcatccctgcaggctcagcctcatggatgggggtaaggggtccggcatgagacaaacctgggatgccacttgccagccgtgtggccttgggagagttacttaccatctctgagcctcagtttcctcatctatgaaaggcaacccccatttagtaacccccatttagtctggtggttgtacgcgggtaatgagatgactcagcatgatgcctggcctatggtgctgtatctggtagatggaagtggttgtcattggtgctgttgtcatttctatcctgcacgtaattcagctgctgtctcctcaggtccattacaaatcagtctccagaagggaatggcctcacacggcctatctgcaactagtaatgatcatgatgtgctggccatcttgtcagtaatgtgcacttcctgcacactgtatgccaagtgccattctaagcactttacatattaaccagccaagaaataaccccagaagagaacagctgcctcctgccccgaccctctagggaggagacaggggtcaagaagccatgcctaggccaacccatgtgtacaagacctgctgtaggaagaggtcacagatggcctcatggggggattctgggccccgactttggtcccatatccatgtgaggaacccaaaaaatgactttccctcctccacgaccccctaggtggctctgaggactcagcgaagtcattgccagaggtcttgaaaaacaaaaagcggctgtaggagatgttgggggaaaccttcctccatgccaccctagggcctagggcagtgctcacagtgtttgttgactgactaatatttgttgactgtaagtgatggttccatttttagagcatagcagctcaggcactaagctgtaccagccattttttcatatgtgtataagaagaagactagaaaaataaataccaaacattaatgctaattatcttaattgaggaaggggcaatggggtgaggaggggagatatcatggtcacttttgtatttttttccactttctacattgtctacagtgagcattgcctacattgtctacaattaattttatagtcagtagaaaacaaacatttctgtaaatttatgatttacctcattttacagaaaaagaaatgaaggcccagacacgttacgccatttgcccaagaccacacagccagaagagagtggctgggatggacctatacctgccatctcttcacctgcatctgctgggaaccccatccctcagcactggggccatttccagctcctgcatcatggggcctccttgtcccctttcccatgaccaggccctgaaaatgctcccaccccaatcctgccagctcccccaactcctgagaaagtcccctctgagagccaagagtccctgcagatctcaggaaggtgtccaggggaaagagatgcatgcaaagccccattccagctctgccaactcactgcttattcattaataaaagaatgcccaggctattttgggcacctgtaattttctacttgaataaccaggaaagtggctgcctgcccgctcctctgccctgcttatggcaccagaacaggggaaacgcgatcttgcctggcgtaatgggatctgggcgaggtctcactgctgatttccttgcctttgcctcattccagaaagcccaggtgtcccccatgccacctccaagggggtctggggaaggagaatccaggccaagtttggatgttgtggactaggtggtttcttccagctccagaaggcaaatcccagctctgccacttgccagctgtgggactttggccccagcttctctatctgtaaaatggggataactataccaccttgcaggtttggtccaggggagctgcctggctcttagggtaattgttgctgttgctgttattgttattccatagataaggaaggagttgttctgggaaaagatctggcctaggaggcttaggatctctcatttggctctactgctgactagctatgtgaccttagacaagcccatttccttcttattttaagcaaaattgttctttctgtttatcaaggtaattcatgatcattattgaaaatttagaaaaatgaatgacgaaaattaaaaatcagggtaactcttaactactatttattgagcacctactctgtgccaggccccatgttaggtgctttctatttattatctctaattctcccaagtctgcacccatttgtagatgagaaaactggagctcagtgtggtgatgtgactcatgcaaggtcacacaactggtaagtagagcagaaatcacacccaagtctttcattcttcaaagtctgttggtttggttttctattgctgcgtaacaagtgaccacaaaatcagtggctgaaaaccacacacatatcacagtttcccttggcaggagtctgggcaccgcttacctggtcctcttctcagactctcacaagctgcagtcaaggcatgagttgaactgtgttctcattcagaggctcgactgagaaagagttcacttccgtgctcattcaggctgttggcagaatttatttccttgcagttgtagaacagaaggccccagaggtttgctgcttgcttgttggaggctgccctcaggtcctaagaggccacccagtttcttgaggctgcccgcagctccttgccatgggggcaccttacctagctgctaacttcattgagccagcaaggagaatctcttgttagtgtatgctagcaggacagagtcacatgtacatgcacacgtatacacacatacatgcacacgtatacacacatacatgcacatatacaaatccatctagcatgatcatgggagtgacacaccctcacctttgccatattctattgttaaaatagctcccacccaccctctactctggagaggtagaggaccacaccaaagggtcagcacaggggtgagagtcatggaggccacctaggggtctgtctcccacacccacactcttcccaccacagccagctcccctttcctcaacaacatcctcaccctcaccctccaggagaaaactccactctaggttggcaactgcaaagttagctccatgttacaaacatcgtggcatatcctggaccaaggaaatggagcctcatggaacactggctcaagacatttgacccccaacccttgctaccatgctgtgtaaaaaccagagagggaatagaaatggacaggacatagtgcccaatctcagaaaacttaccaggaggctggaaagatgccacagtcaagtgttcttttggttgcaggagccctgggttaagggggaagaaaagacaattttttggctcttgtacgtgaaagtctaggagtaatgacatcaagcaaggctggatcctgtgtcttaaatgaagtcttcaggacctagtccctctctcagggctctacttttctctggttgacctcattcctgggccagtcccccttcatggaaactcccagcagctacaagattatctcattcttaaactacaagagtgtgaaggctggagggagaaataggtattgggggtgggggttggtctgttgacaagaagtcacaagaaaggaaattgagagtagactgaaatgtagaagggctggaattcagatagaaactttagcctgtactctgtggtccaacattttccagtgtgttccacaagactttaataagtgttaggtgagccaagagtttcaggtccaacagactggattaagctcacttaaacaggtttctctcctgcagggcctcttgtattcacacgtccagatgtgattctccaaaaggagagctacagactatagcattccctaaggggcagctctcaattctacaccttgtgaagtgccactgtgggtcatagggagccattgaaggcagcagagcaagagagtaagacagcgaaagtgttctaggaagaacacaatggaagctctgtaagagatgtctgcataggccgggcatggtggctcacacctgtaatcccagcactttggaaggccaaggcaggtggatcacttgaggttaggagttcaagaccagcctggccaacatggtgaaaccccgcctctactaaaaatacaaaaattagccaggcatggtggcaggtgcttgtaatcccagctacttgggaggctgaggcaggagaatcacttaagcctgggagacagaggttgtagtgagccgagattgtaccactgcactctagcctgggtgacagagtgagactccatctcaaacaaacaaacaaaaaagagataacagcataatcatccatgcaaagagcaatgacctcccagaccagagggtcagtggcagaaacaggaattaaggtatacagtggagttgggatgtaggaaaatacatagattaactcagaaaatgctgctgccttggtgatagtgacagtgacatttagttttgattttagcttttctactgaaagcaggggccacacaaagagaaagcatggactgtgaagttcagcaaacctgattcttgggtctactactgtgcctttttggcaagtcactgtacccctctgaaccttggctcagtgaaggcttaagcattttctctcagggtcctggtgagcattccaagattatagagagggggtaaggatgtctcactacgagttggacttccacttccagccatgatagaggacctggtgccacactagcactaccactaaaaacaacttgacacttggcaaaataagagacaatgttctcaggcagtggacaataggtactgtgatctctgaaggaaaggaaacttacaaggtgagcccctcatcacctggactctcatcctgggacaatttcccaactatggcacaggacgatggagcccaaacagaacatggtagtccctctgagctcaggaggcagagatcagggtttggagcaactaaagcaaaaggaatctgcaagacagggcactggagaggagggagccgcatagatagggagccccaaaatctgtgtgggggtcccccatgacccacaggttcttgcccaaggactgggatttgcaggcacagggtcagactatctgagacttaccagagagcagctgttatagggttaagagtgaactggggctgggagagtcagctggggctgggagacattggagagaccttcatcctagacatcaagctgagacaccagaaagctgtgccttaggtgtgaggactatactgtggtgtaagggatactccagagctgcataacaaagcctaaaaccaaatccttcaagaccctcaggggagaaagtttggaggtgagtcctaccaagttaaagggacttggaaagagcctggactttgcaggagtgcaaaaacaagcccatggaacttcaaagggatcacctaataattgtactgcctgctaaaacaaaacctaacactcatcagaaaaagataacaaaatccagagtctccacaacacatcacacacacacaacctccagtatacaatcaaaattgtttagacatgcaaagagacaggaaaatgtgatccttagtcaagaaaaaagcagccaatagaaactaactccaagatggtctggaggtcagagttagtagatgaagaccctgaagcacctagtccagtgtttagcacatagtagatgcccaacaaatgccagctgcttatctccgtgtgagcaaagtaataatttattccccaaaatctttgaaacacaaggattaataaaggaaagtgcattcagtccacacatcctgaggtcccgctgattgatcttatggggcccagggagtgggtgaggctgtcacgtgcaacaatgagagaaacaagttatgaccctgccactaactcactgtgcgagtccctcagtgctctgtgcctcagtttctccacttatataatggagggtgcaggcagatcatctcaaagggccctttctctccagaattctgagtctgtctggcacaggacctgttatcagcccaggacatgctctgagctgaggcctggaagaaccggttggagaaggaattggatctgcgtttaatgctctggagggagcacgagttgggatgtcactctcccaagtataataatgttgaattgtgggcagagactgagctcattttccaaaggaacctttcttgagaaatgtctcctagcaaccagctccaccgagagtacaatcttcagggacctttacagaaacacaaaggctttttgtggctccctccttcaaaagcccaggtggaaactgctcatcagccgacatgctagtgtgaagctcagagagcaggcggaggggcatctggtggggcaggggctattgggagggcttccacccacggcctcaacctctttccttttggtgaaaatagaagtagtccagcttcagggctctgagcatggtcttccaacaggagctcaaaacccagttactagttggggagccttgaggaagttacttaacctctgtgagccccatctgtaaaaagcaggaggttggtgctcctccacctacatcccttttattgatccagcacacccacatgcctgttactgtgagtgctgattgctcacagctgcacccttctcagacaatcacccatggatgctgggaagtacctcacttagagatactttgggggttgagcccatcttgcaggttaccctcttcccattgtcctatagccaatgaccaacagatatggaggtacaaaagcccagcccccttgcctatggggggatgatgctgcagtgccatctactctccagacttcccacggcatccccctgaggctagacttcagctgagcccacatcttgacttaacttcttctcctgctccatcctgctttcctcccttacacttttaaaggtttcccatgagagctgtccctcaagaagtcacttgcagcaagtccccatttcaagctctcctagaaaatctaaagacatgatggtacctaccacttgggccacggtgagcatccaataatagaatgcacatgaaggactcagccaatgcctggcacatagtaggtgttcagtatacgaacatcattgtcctccttctcattattctcatcataactaaagacaggcctgggatcatagggagcttctaatgtgcacaagcgcaggggacagtgttggtatggggaaataattgcatttagactgcttaatacagttgaggcagagttatcaacttcctttatttcctaaaccaatataacaaagcatttctctaattataaaacacaggttcattgaaaaaacgaaactcaagaaatgcagagaactatgaaaatgaatgaatacattaattaatgaataaaattccccaccacttgtttataatcactggggacattttggttcatattcttccaaacattattcacataaattcacataacatacctatgtatggacacacatacatatacacatatctacacccacaaacatgtatatacacatatctatacccacaaacatgtatatattaggttggtggaaaagtcattgtagttttgccattactttaattgatataagtaatactacatagagataaatatagatatgtaagactgaatacataaagtaacactacatgtgtaacaaaatatataaccaatcctgtaacctgtttttttcacttaatttttctaaatagatagtggacatcttccatgttagtaaacctaggtctacaacatccttcttagccacagactgttacattgtatagaaatagtacaatttaatcaatcccctatcgctggacgtttaccatattgccgatctttttattatcttgaacaatgcttgttcatgcacattcttgaccatatatctttgtgaaatgtgttcaattattttcttaaattcttagaaatggaaaagcacagatatctgcctggtttgtagggctttcaacgcacgtttccctgcaggacacctgtactatcaacactccctccaggagcacaccagagtgtctgtttcctcacaccctctccaacactgagtatcgttatattttcatttttgccaatctgataggtgaaagataataccccattgttgcttgagcgtgcattttctttgatttctggggaggcagagcatctttcttacgtttgtggaccgtttggatttcacctgctgagaactgcccttgtccagtcattggcaaagcctgttgggtgtcttctctcttcccccttccctgccctaagccacagactcagcagcttcctggtgtgttatttcacaagctctcaaagctctgcctcatacaggattggcctcccaggaaggcagaattttctccctctgctccagcctgcctgagatgggattagtagggatccagttccttgacctccaggagcccccttgccaagtcccctctcccggccccatccacgtttacaccacaaagactttgaaaaccagatctgcttaacgaaaatatcagtttttgccaaaattccaaacccacccagcaaatacattccggggtgattattagcatgacttgaagaatcttttcagaagaacttgtcagaatattcctttaaaatccagtacttttgagaagtttaacatgcgattgtacatataccaagatccagcacagtggaaaatatcccagccattgacctagaaatcccaatggtaagaatttaccctctgggtgggtgcgcttgcccatgtacagaaagatacatgtgggatattcattgaaaccttcctcataacagcaaaatatatggcaaccacttacatatccatcagttaggaccactaaaataagttaccaatgacctctgctatgaaacattgtgcaaacagtagataatgtgagtctgaatgtgcacgtgtgtaaacatgtcctcgatgtgccatagagtgacaaagcaaggtgtagcctggcacattcagtgtgagcccatctgcactttctaaaagatagatcagaatcattctagatgtttatagaagcagagacaattcctggagagatgcataagaaattacttacatcagttttttctgggaggaggatgtggggttgaagtatttggagatttggggggttgcactttacacccatctgcattgtttaataactgtgaataataatttaaatggctttatcattatataatgaaaatgcttatttaaaagcttaaaagtgagcctatgatcaataacagaattgtggtaataataatgtgattattaaatagcctattgagtaccaattatgtgccaggcactgtgtattctctcattcaatattaaaacgagcgctattttgatgcttattttatacacgaggaacctgagtcttaggttaagaggcttggtaaggctgcatctgattacaaaacgctggctctttccacagggcatggctctggtgcccgaagggagacctgtgagggttttgtcgggtcctgtgggggtccttcagtgagtcccttgtggtgggctggaggcttcccacctggtggcagctctgttctctttgcctgccccctgtggcatttctccccctgatctgtctccttagagctgcaccatccaaagcagtccacttaattaattatgattaaataagactaaaatttcagctcctcagttgcactagccacatctcaagtcttaaatagtcgcatgtggctagtggctaccatgttctcagaaagacagtgaacatatccatcctctcagaacattctatcgaattccctgtcccagctttggagccaggctgacctgggctcaaacctgctccatcactgaaggagctgagcaaaattcactcaacttttttgagcctcactattctcatctgtaaaatgggatgacgatatagctgccacactgggctgttgcaggggttagttaagatcatgcctgctgcatgggtagcccaaagcctgtcgcatgagcagctgtcacttaaaagacagagaggaagataggactctgcagtcagatattttatgacctcgggcaggtcttctctgaggcctcacctccttgtctgtaaaatggggtaaacagtacctaccctgaaaggttgctgtgaggattcgagagcatctatatagtagatgctcagaaaacagtcaagccccttttcccctttccaaaaaagggtttcccctgtcaggcaaagcactatcaaaagacccagaagaaggaatccagaaggccaaatatcaaaagaaggctcaatctccaaaatgaaataatcatgggatattgtcctatcacccattaaattgcaggggtggggggtaaattgaactttttgccgaagaataacacgcatatttaatactgcacctgggctgggcatggtggctcatgtctgtaatcccagaactttgggaggctgaggcgggaggatcactggaggtcactagtttgaggccagcctgaccaacatggtgaaaccccatttctactaaaaatgcaaaaaattagctgggtgcaggagaatcacttgaatccaggaggcaaatgttgcagtaagccgagatcacaccacagcattccagcctaggtgacagagcgggatcccgtctcaaaaaaaaaaaaaaaaaaaaaaaaaaaaaaaaaaaaaaatggtgcacttgttttaagtataccacttaacacatttttagaaactgaaaatacctgtgtaaccaccactcagatcaagaaacagaacatcaacagcaccctggaagtccctcctgccccttcccatccactattgccctccacaggggcaaccactatcccgacttctaacactagagattagttttcaggagacaaacctagattcataacataaagccttgctgaaggtgtggacaatcccataatctcaggcacggatggcaagtatggaaaatgcagccattttggaagataatttggcagcatctactaaaacttaaatacatgtacttcctggtctagcatttccacttcccagtgtctgccctagagaaatattcacccatgtggacagaaaggcagcaagcataagggtgtttggagtagaattatttgtaatagtgaaaaattgaggctaggtgcgatggctcatgcctataatcccagcactttgggaggctgaggcaggcggatgatttgaggtcaggagtttgagaccagcctggccaacatggtgaaaacccatctctactaaaaatacaaaaattagccaggcatggtggtacatgcctgtaatcccagctactcgggaggctgaggcaggagaattgcttgaacctgggaggcggaggtcacagtgagccgagatcccagcatcgcactccagcctgggcgacaagagcaaaactccgtctcaaaaaaaagaaaaagaaaagaaaaattggaagcaacctaaatgtccaactaaagcgtaatggtttaaaaaaaaaaccatggggcatcacactgtggtttacactgtagtagatcagaagagtgaggtggatctacatataccaacatagaaatatctccaagacataccacagagtttaaaaaggaagctgcagaaaaacgacaaaactcacacatgcagcatcaaaaagagtgatgactcagggaaaggggtgagattggggcatggctgggacagtaaggagaaatgttactttttaaaatgtgtatgcaactgagttgttccgaatgtttacagtagcagtggatttatgtattacttgtgtgaactattttgcaagcatttaaggggaatgaaacaacccatgcaccaagtccaggtatggaaaaaaagattgctgctgctgcctgctggggggtgggtggctcccacccagggcctcagcttgagttccaggaaggcagttttctgggtctctgagacctaaggggctgaatgaatggaggcgtgagaaggccctggagaccagaactgtagaggcctcctttgatagaaaacagtgccctcattactgcacctcggctgagaactcaacacccatgtgatgtaagtggacccctgcaaaggaacaagtcccagggctgggcgcctgctccaaacagagcccagcactttaaaggaaggattgctgggtctgattctctccatccctggggatggaaaagagaggtggcaggcgtcacctcacaacagggtggctttgtgagagtgaagcactgaggtggaggctcggggtgagcgttgcgacatccagtggctgtgggctccagagagtggaggttgtagaggagggcagcagccagggctctgcattacatatattcaacctttaagaataagccaggtagggaggctggcacagctgactccagggagaagggttccttaacctcactgagcctcagtttcctcctctgtaaaatgggtgcaggctcttgccatctcacacacacacaaaagctcctgagtcagactgcctcaagtctaattacaaagctgccacttgccagctgtgtatcttttttatttttttatttccatccagctgtgtatcttaacctgccgaaggcctcagctttcttcctcatctgtaaaacaagaacttcactcttccctaatctcagaggactttcatgaggtttaaatgagaccatatcggtagtcatgtcacagtgcctagcactagaatgtgctcgatagctgtttgctacaattattaagttaataatttattaatttttatttacaaagcacctatgtgccaagaactgtgctaggcattgcagacacatccctgaataagttacaattcctattctcatagtgtttacagtctaatggaggtgtaaataaagacgtctagagacatacctccaactgattcactccagattttaaggacaaataccctgagctccaaattcagaattcaggcccatctgtgtttatcagcgatgcaattttgctaacacctccctcctccctgccaatccaaagcattgtgtatgggagtgacctgaatgtgtccccaaaaatctatgttgtaaagatgtcaaaagtacaatacaaagtgacacaatcattgttggcagtatccactatagctaaacattcacctacttatgatcccccaagtccactgctggatatctgcccaacagaaatgagcactcattttgacccaaaaattcatggaaagttgttcatagcagctttaggagtgatagccaaaaactggaaaccatccaaatgttcgttctcaggagaatgtatcagcaaactgtgacatagccaccaaatggaatacttaagtcagaaatcaagaggaatgaactactgacacaggcagccacactgatgaatctcaaacacacggctgagtaaaaaagccaggccaaaatgagcacattttattattccattgatgtgaagttctagagcaagagaaatgaatctgtagtgacagaggccagaatggctcttaccctgggagaaagtaggtattgactggggtgcagtcagtcttgatatatattttgtcatatatatcaagatataaagcaagccaatcttgttttatatcttgatcttggaggtggttatgtgtgtgaacacatatataaaacctcactgagctgcacaatggactttatgctacacctcaatttttttttttttttgagaccgagtctggctctgtcacccaggctggagtgcagtggcacgatctgggctcactgcaacctccacctcccaggttcaagcgattctcctgcctcagcctctctagtagctgggattacaggcacccatcaccaggtccggctaattttttgtatttttagtagaaacagggtttcttcatgttgaccaggctggtctcgaactcctgagctcacgccatctgcccaccttagcctcccaaagtgctgggattacaggcgtgagccaccgcacccagcctacacctcaatttttaaatgtttaaaaacaaataaagcaaggtcccttaaatgctcctcggtgcatggggaagactatggcagatgtggattgggcccatggttggtctccttgacactttcacattgaggtctcagcctctaggagaagcaataggacaaactggggaagaggaggatttggggataggatcattgaggccaccagtgaccaatgccaagaggtttttctcaacaatcaggacatgaaaaagaggcaggcggaggccacaggaaggacaggaggaatgcagatgtctttgcctcagggaagattgagttgtgcccagttgtattggggcatattgtacattacacaatagtatttcctctggaatttatgtctgctaactttcactaaccaaaattataattaagccagcatctcccgatttggaaacggtgagaacaaatgacagttggccatatttttcagcatcgtccttggaaaagactatcagttatcagtaatgcatcaggaatgatctaggtggagattctctcactcaccaaatgccaaccattgaagggagagagccctctgccttggccactgaggttccactggatacaggttggccttattttccaacaagtcttgcatggaagggggttggcaggtgtgcaagtgacatttcttgtgtgtgtgtgtgtgtgcacgcaacaaggctgtttatttcacttgggtgcaggcgggctgagtccgaaaagagagtcagcaaagggtggtgggattatcattagttcttataggtttgggataggcggtggagttaggagcaattttttacaggcagggggtggatcttaaaaagtacattctcaagggcggggagactattacaacataccttcttaagggcaagggaatatacattatcgcaagggcagggagggtgtattgtcataagatcaattgatcagttaaggtggggcaggaacaaatcaaatggtggaatgtcatcagttaaggcaggacctggctaatttcacttcttctgtggatcttcaggtgcttcaggccatctggatgtaaacgtgcaggtcacaggggatatgatgggttagcttgggatcagaggcctgacattcctgtcttcttatattaataagaaaaacaaaacaaaatggtggtgaagggttggggcggtgaaaatttttgggggtggtatggagagataatgggcgatgtttctcagggctgcttcgagtgggactgggggggtgtgggaacctagagtgggagagattaaactgaagaaagatttgggggtaaggggtgatattgtggggttgttagaaggagcatttgtcatatagaatgattggtgatggcctggatgctgttttgtatgaattgagaaactaaacggaagacacaaggtccaaataaaagaaggaggaaaacaggtattaaaggactaagaattggaaggacccaggacatccaattaaagagtgtccaagggggttcagtgtaattatctgtttggttggcaagttttggggctctatccttgagtttttttgtgttgtcatatatcaagccagattgatttaggtaaaaacaacactcttcatttgaaaatatacagtcctcttttttcagcagtgagtaagtggaggcctattcctgtcttcttatattaataagaaaaacaaaacaacagtgaagtgttggtgtcatcaggggaccaggaagctgttcggacctatttgcaaattgattttgggaggtaaggaaaactagtgtacatgtgcctgtccaattaacaaggtagacacatataggtggagaagccacagaggaagaagagaccttgtgtaaggcaaaactggaaatgtaaagtgaaaagatgagagggagcaccaaaagagatgtcttgcacccagagtcctacggatccagcgagggcagctgccgttagaggttgtactggggattgatggggcaactgggtagagggggaggtttgattttcatggtgtatgagaaagtgcctacaagcaatctttcactgctattcatgaggttgggtacaagtaaacaagaagaggggctgggaggagagtccaaagaacaaggggaaggtagccaaggatggaatgaaatgcagggcaaatgtcttcctaagcaatagtaactgctaatgtttttacgtttgtcagtattgacacagggcttatctgtaatgcggagctgaaaagcccctaatggttttggtaatgtccatagttgggctttggagatgaagagggaaagagcatagagaaggtgaaaggttacctaagggaattctggtgggtctttgccgagagatgcacaaaggagaggaaacagggatagtagtttgtgttgtgaggggtccaaatatggtgggggggaggggtggaactgacataaggagaaaggtgccgtaagtagatgcggataagtgtggcagcttgttggtgcgaaatgtctgggcagttctcaacaaatccatccagaaagtaaagaagttcctcaggcaggtaaagatgagggctattaaaggaggttcggaggtgcagggagagggagaggtagtccagtcaacctgtagggcgcggacggctgtgtaagagcaggaagaaacggaaatgctaagccagcaattgttcgctaaggaggaattagaaatggtgaggagggagtgagtgagattgatagtatgttagaggtaattagggaagggtagggagcgactggagaacaggggcaaggataagagtgagtagaaaagtaaaaaaaaaaaggacttcgtcaggatagaagaattggagtgtaccttgccactgaagatcttctatccgcttcaagagagacttaagggtggttgtttgaggtaaaaccaggagatatcagttatgatggtttggaggaaaagtgtaaaccggcagtgtaaacaagggcagggcatttacaagtagttgagaatggtgaataggagtatgactagacagcagatagtagggatgacaagtttttggggtgcagtccaagtagtgggggtgactgtataaagccctgttgcaaaaagtagggtaaggacgaatagacctaatagaatgaagggatgtattaggctcataagcgttattactgctcttcagaaatgcgagtgagtttaagggaagtaggggagagcacttgcgacttccaggaggaagaggagagatcaggctggctgtccaatggacacagctttattctggaacggtgaacccaatggggagggtcctgcaggcagaaggcagttggagtactatagatgactgagtggggtccggtccaccgaggttgtagagtttgaggggtcagattcttaagaactgattgtccagctagggtgtctttataaggctgggaatctggagtatgcaagagaagattagcagtctgatgaatttcctgtctagcctactggaggactggaagatagttgcctagaaggctggtgtctgggatgagattggggcccagcaagaaagtgcgtccatataaaagttcaaatggactttaccctgtaacatcttgaggacaggctctaattttgagaagggcaagaggtaaaagtactgtccagtcctttttaagttggaggctgagcttggtgaggtgtgtctttaaaagaccattagtccgttctacctttcctgaagattgaggatggtaaggggtatgaagtttccactgaataccaagagactaagaaactgcttgggtgatttgactaataaaggccggtccgttatcggactgtatagaggtgggaaggccaaaccgaggaattatgtctgagagaagggaagaaatgaccgcggtggccttctcagaccctgtgggaaaggcctctacctatccagtgaaagtgtctatctagaccaagaggtattttagtttcctgactcggggcatgtgagtaaagtcaatttgccagtcctaggcagggtcaaatccctgaggcaaggaacacttctttgaactccaggtctgggagctgcttcttctgaaattctggctttgtgatgctaatgttgcccttgggacccagcccaacttcccaggtctgtgtgaagagagctgagcagcagcttagatcccttctggattctctagactaggtccattttctatgtcttgaaattttcttccacagattaaggttacttgctcccttaagcctttcattaaaaaacacaaaagatacttccaaaccacgaacactctccctcttctatcccctccttggtggtggagttcaaaattggaacccccaggggaaacaccaggaccccaggcaattctgttcaccctgatcatccctgagcaggccacagctgaggcctcccctggttctggccctgactcactctctggggaattacccactttcccatacagcacagaggcctttatgtggctgcattccctcattcactgattcattcattccctcaataagtctttattgaatgtccactccaagcacagctccaggctgggccctggggagacagctgtgaatagaacccaatccctcttcaaggcgagtacagtatggtgaaggaagcagggctgaaagagtcataattaggtgggaagtattaacataggggaagtctgcatgctacgggagcacgtggttgaggggcacctccctgaggaagtagcatttctgccaagacctaaaggatgagaaggagtgagccaggcagaatgcgggagcttcccaggtgaagggaacagttcctgcagaagctggcagctgagagaagccatggctttcagggaacccagagagttctcagtggttggagtatgaggcatggaggaagttggcccctgtctcctcactgaccttctctcatgtgactgccccagtgttccctccacttcggccaccctgacctccttgctgctcctgaatatgccgggcacagcccagctcggaacctttgcattaaccgctgaccctgccccaggacatctgcttggctaactcccagcttctttcaagtctatgtccatgtctcatcttcccattgagacctgtctgaactgagcatctatttatgaccacaggtggtccccacttgccaccagccaccccctttcccttctctacactccctttttcccagcgtctctctgttctccttccacactgtctaccttacttattcatcatgcttactgtctatctcccactctagaatgtgaacgtgaacgctgcaagaacagaggcctttgttgtgttcactgaggtatccaagcccttgcacagtggaaggaacaaacagatggaatttgagaggctcacagggagaagccaggctgcagaggccttgtaggcctggtgaaggcatgtgggtttgagtccccaatgcaaagggaaaacatgacacagaagggttccaaggagggcagaatcagggtctgagttacgctttaaaagctcaatctggagtctttgtggagaacgacttgaaggagagtgatatggtttggctctgtgtcctcacccaaatctcatctcaaattgcaatccccacatgtcaagggagggacctagtgggaggtgattagatcatgggggcagattcccccatgctgttctcgtgacagtgagtgagttctcacaagagctgatggctttaaagtgtggcacttccttgcgtgcactctctctctgtctctcctgctgccatgtaaaatatgccttgcttccccttcacttttcaccataattataagttcctggagcctctccaaccatttggaactgtgagccaattaaacatttttgtttataaattacccagtctcaggtagtatctttatagcagtgtgaaaactgactaatacagagaacaaattactgttggtatccaggcattcagtggtactcaggctaaggtggtggcatggaggcctgggagaagtggatggactccagaaattcattggaaggtggactcaccaggcttggaagatcagacaactgtggggttgcaggaagacagggcaaggaagactcccagcctcctggtctgagcaacagggtcagagtagagccatgtgctgagatctgggagacaggggaggcacatgttggaggcttggggtgtcaagagttctgtttgggccatggtgagtttcaggtgcctattagactttcaagtggagatgtcaggtagctgattggacaaggtcaaagctcagaagcacagtcaagattgaaaatatataatgtattaggggaatgttggcttagagttctctttaaagctctgagagtgtaaagagagaagagaagatgtccaagaactggccctaaggaccaagccctgaagccttctgacttggcccttgaagaatgaggactttgccaggaaggtaagaagaaggcagtccaggccaaaggaacagcatgggcgtgagctcaacctaaaagaatatgggcctcaggactctaagaaactgtgcgagtcatccaaaacaaagaaagtctgagaaactgtcacagccaaggcagccagaggggacatgatgactgaatgtgacgtagtagtctggagggatcctggaacagaaaagggacattaggtaaaaactcaggaaatctgaataaagtatgcactttagttagtaataatgcatcaatatggtctattaattgtaccaaatgcaccatacaactcacatgtacagctgcatatatgtaaggtgttaataacagggaaattgggtgtggagtataagagaactctctgtactatcttgttaacttttccctaaatctaaaactgtttttaaaaataataaagtttattttttaaaaaagagcatgagtctcataaatacgcatgtgggcacacacacatacacacacacacacacatccattccaaagactatggtaatttctttctctggagaggactttgactctgaccagtcccttcagtggccaaaagactcagatacattgtgaatatatcacccctccctcagccaaagaaccaagggtcctcaactccacctactttctttctgtttacagaaaacatactctcctcaggccagatttcatagtgaaaatgagaagcagagacgaaatggctcaggtaagtcagacccgctagaattcctgggtgcggccagagtccatcccttcagatactccacaaaagtacatcccatggccacaatttccctgagtcccactttgctccacagctggtttggtttctcccttgcagcataagttctggcaccatctgggttcaaattctggctccactaccaactcattatgtgatctcgagcaagtcacttgtgccgtatttcctcaactgtaaaaggggcataaccatcacttgaggccgggcatggtgactcatgcctgtaatcccagcactttgagaggctgaggcaggtggatcactggaagtcaggagttcgagaccaacatggcaaaaccccttctctactaaaaatacaaaattagccagttgcggttgcgtgcacctgtaatcccagctactcgggaggctgaggcaggagaattgcttgaacccaggaggtggaggttgcagtgagccataaaaaaataaagaaagaaagaaccatagcttgatcaaagagctattgagtggattaaatgaggtgaactgtaaattggatataatttcatcctctgaagaaaggatataatacagtgaatgccaaatatctgccatcatgcctggcactcctgaaggctggttgttgatgacagacatgatcagtctggccaatcaatgaggcctccaaagatcaagtgtcaccttgggcccctgattggcatctgaggtgtggcagatgggctttcaggacactggatggtgtctggggagcagagaggtacaggacccctgagtcagagcagaagctggatctgggcagtggccatgggccaaccaaagagagtttggccaacagttggccttgaaggtaccaaggctggtaacaggccgcaaagggaggtggtactgtgtggctgagaccacaacagtcagctcaagattccctggctctttcagacacagccttgaacagaggccatccagtaccctggacagctccaggaatctctagatttcaggggcttaagttttgtgggctgagaactggattgggtcttggttgtgcaagccacctcacctgcctaagtctcaacgacctcacctgtaaactggagggaatacccacccttcagggctgttgtgacgagtgaatgagatagcagacaggcagaagagcaggtggccaaggtctgtagtcggaccacctgcgttcatgtatcccagccctacactgtgtgacttcagagaagttgcatcacccctctgagtctctgttttttcttatttgcaatgttaatagaccctgcttcataggattatgaagattaaatgaaacagaacatgaagcacacaattaacatgagtttttgttttagaagaaacttagcaccagacacagaatagatcctcaaaattgccagcttcttgtatctcctgaagccccctggtgagcctggcacctcccacctttagacctgattggcccactcatctctgattgttacagacactccacaaagccagagaaagcaatctggtggagttccataggcctccaccctcaaccttcacacccagcaaagaccctgcctctcagtgccacccaccccacgatacttgtgacatgttttaaagtaccagtgtatactgtatagtgtttgttctgcaccagcctctgttctgggccacacacacacacacacacacacacacacacacacacacacacactctaagctgattaacctcacaaccatgtgaggaaagtactctggttattccgattttacagatgaggaaactgagtttctgcgaggttaggtaactaaatcgtggggacacacagcttttaatggtggtggtgggacctgatcccaggtatggcgcttcagaaccccatgctggtagcatcaacaaggccagcggccaaagaaagcagaagagtaggtgggagaccgaggctggaagtcaggacactgtgttctcgccttggccctggaacctcggggctaggagtcctcactgcagacgttcacccgcgccctgcctgctacctgggcgcggacacctgccctggcccctgcccccctccttcccccggcggcgtctcctcgcccgcccctccggccgccgccgtaacttgaccctcagcggggtttgggacttggggccgcgtcaccgtcgcggaggcgcttcggctccggactacgctcctgctgtgcgctcgcggggccagcagtgctggctctgcagtaggaggcgcgggggcatggcgcagaggctgggcgagtgggcccgggggccctccgatgccaccgggctctaccgggctgtgctgctccggtcgggtaagtgggagcaacgccaccctcgccgcgggaagtgggcgaggagggctctgtggtgcacggcgctcagtccctggccagtccgccgctgggcgcctctgcttcgttgctctgcttctttcctaaccttccgtcattctttttgcttttttgtttgtttgtgacagggtctcattctttctccccgactggagtgcagtggtgcaatcatagctcactgcagcttccaactcctgggctcaagcgatcctccccatcctcccgcctcagcctcccgagtagctgggactacaggtgcgcaccaccacacccagctaattttttaaattttttgtagggacgagttctccctagtgctgcccaggctgatctccaactcctgggctcaaacaatcctcacgtcattctttttaattactttttttttcttcctcctttctgcctttctttccttcctttgttccttccctcttcctgcattcatccttttggggatctatgacatacattgctttcttcctatgtgtgagaacacgctcacacagtttcttgaccacagaagtcctgtgaggttccacctcctggctgatctcttaaacagagactcacacaagtgcctgaaggcggctgtaggcgcaggaagtttgggccaggagagaggaaaatgggcacgactcgagtagcaggcaatcaggcataaagaaactggagcccggcagcgcggttgaaggaggtctgctgtccagtgaggcatgacacaaggtggggaggggaagggaaggcagatctaggagagcaactgcctttctatatgtgtgcatgcaactatttggaaggaaacactgggtggtttcatttcttaaggttgggggttggatgataggtgctttttctcttccatctttttgtttgcttgtttgcagtaagcacgtgtttcttttctattcaggaaataagcctttttatttagaaaaatgaagttaacctaatatatgaccagtgtccaaataattcggagaatacagggatgtaggggggaaaaaaagagaaagcaaagccccggtaagcatttggggtattttcctcccgactctccttggagagagacgtttggaggaggtgaaacgctatctcgtgctggggtcctgcactgtggaggtccgtgattacaaagcgtcaagggacttgggctcacgggccagctaccctctgccttgggcaaggagctcgccccacccgtaggcctgcctgccgaccgctggagccaaaagcgcgaggcaaaccagctgccgcgtctgcagcggcggtgcctgtccccgcgccccgcgcggcccgctctggaactgctcgcccttcccgcttaagccccgcctgggggagatcccgccacccagttactggaaccacagttctccaagtcccaaagcgagaactggcccaaacttcaggactggcggcgccttcctaaaggagggtctgaaatcttgctgaggcgggacaggcagagaaggagtagctttatcatcagacgaatctgatttccaatcccagctccggcgatttccctacaaagcacgccaccctaagtgtccccacccagttctcgatcgtctctcaaagctgcggagggggtctccctaatctgaaggccttgtgttccccctcacctcttagctatcaacccacgcagaatagcaaacacgtaggagtgtttccaggggctgcacgcctgcgggtaaggagccaggaagggagcggggcctcggaaaagggacggaggctgcactgacaagcacttaatatccctggctccttccctgcaccactctacaagtgttacccattgacggtgtccaggttcttggcgtcatgaacaaagaattggacaaaacgcacaaacaaagcaaggaaagaatgaagtaacaaaagcaaagatgtattgaaaatgaaagtacactccacagggcgggaggggggccgagcatggggcctcaagagccccgttacggaattttctggggtttaaataccctctagaggtttccatcggttacttggtgtacgtcctatgtagatgaagaggatggagtgaagttatatagtcatttactgggtgcatgccctatgtaaatggagaggatatttcctgtcatcgccgaagtgtctccatttgatttcgttctgttctgggaagtcagcgtgaagcggccatatgttccctgcctccagaccctattctcctgcctcagaaggacactgccaattgttatctccatttaagagataagaagaccgaggttcagagagcttaagcaccttgcccatggtccactaaggaacattttctaccccacaaagaggtagaaaacacattcaaactgcggtccatccatgccaaagtctgcacaccttctgaggatagtcacaataatggctgatgattgtcagcactcaacgatcaccccatctctgctgtacatctgccatctcatcaactcccttcattcatttattcatccagctaatatttattggcctctgttttccaaggtgcagggatgtatttataaataaaacagatctgcccctcctctcagggagcagagtaatggaaacccctattggaaacatgaggaaaccgaggctcagatggtaacatgacttgtctaaggtcatacaactcatcgagagtgaagctgagattccaaccaggaccgtgtgcctctggacccgctctctggctgctccacacagggagcggcaggaagtgagaatgggagtaaggagccaatttggccatgtgctgaaggggtgagcactcctttcgttgagaagcccccaaggaggacattacagattcagacccaaaatagaggctcttttcattaacagtagcctcaagtcatgcagcagataatataacactgggtgactcatgccttgaggccgggagttcaagaccagcctgggcaaaatagtgagatctcgtctctagaaaaatgtttaaaaattagcccagcatggtggtgcatgcctgtggtcctagctactcaggaggctgaggtgggaggatcacttgagcccagagagttgaggctgccatgagctgtgtttgctccactgccctccagcctgagcaacagagcaagaccgtgtccccccccaaaaaaaaagaaaagaaaaagaaaaagaaaaacgtttatcccaaggtatttcaaaataattttttttttttttgacagagttttgctcttgttgcccagggtggagtgcaatggcgggatctcagctcactgcaacctctggctcccgagttcaagcaactctcctgcctcagcctcctgagtagctggaattacaggctcccgccaccacgcccggctaattttgtatttttaatagagacagggtttcaccatgttggtcaggctggtctcgaactcctgacctgaggtcatccacccgccttggcctcccaaagtgctgggattacaggcatgagccaccgcacccggctaaaataatttcttaatattagagtaagacatgctcaccatagatatttcgagaaattgagactaaagaggaggaggcctaacacataatcccactaaccacgggcggccacacataacatttggaaatgcctccttccaaaccttgctatgcatagtgtgtgtgtgttttacactgttgagactgttctgactctagtctttaattccacttttttcagttggatgaaaatcttgaatgctcggccgggcacagtggctcacgcctgtaatcccaacgctctgcgaggccaaggcaggtggatcacttgaggtcaggtgttcgagaccagcctggccaacatagtgaaaccccatctctaccaaaaatacaaaaattagctaggcgtgatggcaggtgcctgtaatgccagctactcgggaggctgaggtgggagaatcacttgaacccgggaggcagaggtcgcagtgagccgaaatcgtgccactgccctccagcctggcaacagagcaagactctgtctcaaacaaacaaacaaacaaacttgaatgctcttaagtgagttatcaaaataatagttgccacttacagagccctgactccatggcagccacggtgtgaagggctctccagaacatatctcctttgttcctcaaaaacacgtctgccccattttagggaggaggaaacagagagttgaaggtcacccagttgtccagcaatggagtcaggattgtggtccgggttggcaccagagtccatgctctcaatcacagggctagaagggtcacctctgtggaataactcctgtttggccatgcctgggaggcaatacagtccagtagttcaagtccacttgaggggcgttaacctgcatcctacctggagctcaggtcatgttcctggaagggaggaaagcatctctctgcactatggacaaaaaggcacctccccaggtgcctgcgggcatcagcaactatacttcttctccgcagccagaggggcagacgcagcctccacccctgcctctgccaggtagggctgccagataaaatacagggcactcagttccatctgaatttcagagaaacaacaaatcatattttagtgtaagcatgttccagctatgtcatggactatactaaaaagttatttggtgctcattagaaattcaaatttaacttcgatgtgtgacatttttatttggtacatctagcaactatgctgccaggaatcatgaagtttgctcagtttgacagctgtggtctgcccaggttctcctgcatgcatgcgcgcacacatacacacacacacagagaaacagacacacacacgcacacacacacatgctccctctcacatcctctcaccatccatagattcactcactgtgcttcttgtctgattacaagggaattaaaatgtactggggatgggggtaccccagggtccttctgcagctaagagaccaaattaaccatgtctaattgcagctgggtggagagccagctttcagaaacaagactctaagttcttccccaccccctctcactttcccattttcacgcttgaaatccctcaactgggtaaattcttcccggttcaaacttgttgtaaaggcgactctcattccttttataatctctccacagatcccatgacaggttctttctgccagcacagcttcttctcccccaacccccgagtcctttctgcagagcatgtttgagaggcggggggcacggtttaatcctagggctgttttgtgggtggctgctcagaaaccccattgaggccttgaaaaggggccttggagatttagactgaatacagggctgaggaggaagttttaagttgccatggaaacttcttgtttgatgttcgtgggcccagataagctgttctaggcgcccatgggcttggagaaagggggcaaaaatgaaacaaaagctgtttggggaggttattttctgcacactgcagcccagcccactatagatgcaggaaaattctccacctccctgtcaggactgcctcccctggtcttccctgtcccccttcctttgggttcctctggttcccaagaaatcagagttaaaaggggatgggagggaagacaggaggggtgtgcccagcccctgggcttccccctttgatgccccagctcaccagggggccgagcaagtatgcagatccccaggcccctggcttcccagagtccttccttttggaagaataggaagacctccagggaaagccacacagaaggaggcaggagacagcgactgtggcttgaattatgcaattacctggagtaaacgcctcaaaggcttgtttgttcagagggcctctgttttcccatattctgatgacataactgagccagatgtgattcctaactaactacagttgtttgggaaatgttgctctttctcacatttttaattcttagagtctttttctgataacaaaagtaatatatgctagggcctttttttttcttttaacaccgcaaacatcacagaaatgcagtgacaaaggagaagggcctgtaattttacgctgtagaacaatggtcctcaaactctttaatataaatgagcccccagagaggtatgtttaaaatccagattccatggtggcttcattcctgtgatcctagcactttgggaggctgaagcaggaggaacacttgaggccaagagttcaagaccagcctgggcaacacagtgagatctcatttctaaaaaaaataaaaaattagctgggtgtggtggcatgtgtctgtagtctcagctacttgggagactgaggtgggaggctcgcttgatcccaggaggtcaaggctgcagtgagccattatggcaccactgcattcagcctaggtaacagagtaatgctctgtctcaaaaaaaaaaaaaaaaaaaaaatccagattcctaggttcctccctaggaaaaaaaaaaagcaagagcatttttagcactcatttcaaatgacatctagtaatagtatttgagatacactgatctagagttgacctctgctaacagattagtgtatttgcctccacactagttctttatacatataccaacttttttatcttgaaaaaaaaaagagatcctactacatatgatttttcattgaatatgtagaagacatctttttcaggtcaatacatagacatgtttattggctgcatctcgtcttggggtgtagcatagtctcttgctgatggagtgtggcctgggaaagggtggtggttggccgctgatctcacgtacagttgcacctgcacatggacacacagcaagatggtgctgtaacaagctcagcgctgtcaaggttttcggtgtcttcaggttaacaatagttattgagcccctcagtactgggacaggaagataggtaggtacctgccctggggctagcagtctgatgggtttgtatacaagttggactgtgagaagagtttttgtgggagaagcacagtgactcccaactgcccacggaaaatgacgcccaacatccgaggactactgcccagttctccttggctgtcaggtgcgtgttcctctgaagtgtaccaggtgatgggcttctgtcttctccggggatgagcaggagctgtcagaagttcccccgctccaggatccttcttactctccaactgttagaaggcactgggattggttcatctgagccaccaaagaccctaggaaatattcaaaatacttctttgcagagcaggaggatgtgtgcaaggaaccagggtcagcaaagagtggtttgacaagaatctagctgtcctcttctaccaggagagtttggggaagttaaggcagagcagggtgggaggctgagggggctaccattcatagtgcctcaagaaatgcagaattggggaagaagaaaaaaagggaccacacattgtttccagaaaattgttttatacccaagaatttaggaccctcttagtttaagtggctcgagaatggtcagcgtggccaagactccctggacatgcctgccctgtccctcccactccacccctgtctcccacctccctcactcccaagatggcacccagcctgcctttacatcacaccaggatccacccagtctgggcctttccactggctcttcccaccctacgaagactctcccatgtgtacagacttcacacaactgactccttgtgattctgctaccctaaaacaccacccgctctcacctcacccagccttgcgttcatcacggcattcctcactgcctgacgtcatcctgaatgtccccttctttactgtgtgtcccccttgaaggtaggttccctgacagcagggatattacctgtgtcattcacatggtacccccagcacttagaacagtgccaggaacacagtaggaattaaataaatgtttgttaaatgaacaaataatataggccaaagaagacacaaggttgccttgttaaagcctccattcacctgtgatgcatgtcctaggcctcatcaccttctagccaaccaagactccatgagaaagtaaagttggggtggaggcctggtctaactggtagaccccagcttcctcactggggaactaggatgacactaaacgatagaaaacacttccagcttttcaagtgaaagctgattctgaaattaggagaatgcctccattatctataagcatccaggctggccttaaggatctacatacattttttacttttcttgggtttttttgtttgtttgttttttgggtttttttgagacagtcttgctctgtcacccaggctggagtgcagtggcccaatcttggctcactgcaaactctgcctcccaagttcaagcaattctcctgcctcagcctcccaggtagctgggattacaggtgtgtgccaccacccctggctaatttttgtatttttagtagagacagggttttaccatgttggccaggctgttctcaaacttctgacctcaaatgatctgcctacctcagcctcccaaagtgctgggattacaggcatgagctaccatgcctggcctacttttatattttacattcacatgttcattcattgagccactacttatggaacacatattctgccaggcaaaatgcaccatgctgggctctggcctcagatcacgtagagtccaggtctctcttggagaaaagtcctatatgctgagctttgactatgtgcttcactaatgtcatctcatccatgtcatctcccaaccaccctggtatgctccacatttgacaaacacagaaaccaagacacagagacactgagtggctgctgaaggggctggtgctggagccagggccaacacatgagcctgctgagacccagacacggtgcatcccctctcccacgctcttccgttggctcctctgtgaagttccaatgacattcaaggtatcaggaaaacgctgtgtacggagtttctgacccattcgtggataattaagaactgacccaatgctgagcagtttcccctccctttacaccccacccttttccccccagagccattttctcctgaagaatccacaccactgcctcaggaagcttggcttcccctcccatggggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaagtaagaccatctctgttctgtttcatctgctgttgagagcggtgccgttcgggaggaggtggaagggaaggagggcagacccggtacactgaagtgggctgtcagtggacctgagtgctttgagtttaggtacccgggctatgtcccagcatccataaaatgatacgggagatgcctccaggcaccctgggtttcggaaaagggtaggagacaaagaagcgagccccctggcatagccctgcattcttgttgatctttttctgctgcatcctcaggtgaatctgaattaatgcatgatatagcctcacctaagtcaattatcacacagtatgggggtttaattctcagcacaacagacagaacacagatttcagcttcagagtttggctcagattcaagctctttccttcaccggctgtgtgatttggggaaatcagatgacttccctgaacttcagtttccttgactgtaaaaagaggataataacagtacccacctcttcagtctgtcgtaagaatttcatatttcatgagatatggctgctaggtgcttagcacagtgcatggcacatagtgcacgcaggttaacgtgtgaagggcctgcctttctggtgaatttggctttaggactttgcaatacaaggcaagtctgagattgggccagaaatcaagagctgtaggattgggtgtgtcactttttgaaactgctaccaaacccaagtagctttgagcttcaaggcagcccccacgcctgcatctctgggtggcttagatcctgagtggccctcttagttctgttggtggtgagtacctgctggaattttccctgcagaggcatctgccaggtaaagtggctgacatcatgccactaatgagccagcagggattccaggtctgctgatgcttgttccagatcaactgcacaatgctgtccactaaccttgctaagtatcctccatgtctagccctggactctgctatttaattggttcaaaatcctaaatgtccacccaacattctccttccgaggtaggaagttgcaacggacctgaggcaaaatgttcaggaagtcagccttgagtcattgcatccaaatggacaagcagctctgctgggggcttccgagcatcgaccagaagctgctgggagatctggaggtggctccgagatacactgttctttggctgctggccagtgaaatacaaataggcactttccccatggagaggaaaaaagccagaagggtcaggaaatccagtgaccgtgcttgtcacttttactgaatgcctgtttttcctttgccagtcgttattttgaaagcctctcttctcctctgccctggcatcccattaaatgctgaaccaagagggttctgaatgtgttcggaacccagcagcttgaacagtaatgaggaagtgggggcacaggagggaaggccaccagctggtcctctcctaaacagagaccagcctgaggccagacaggcccgtggactctagcttaagcccaaagctgctagggccaggctggggctccccagtgagagtttgcatttcacgtaggctaggagtcctcaagttagcaggcctccatgttcttatctataaaatgggctcacacagcctcttcattggggtttcttgactatctagagagagaaaagggacataaccctgctttgtcaactaaaagacattttgcaccttgaagacagtggagaggtagaaagagcattgaatttggcgtccaaggtcctggctttgctgcttactctctgtgtatcgagacaagtagcttggcctctctgagccttagttttctcatctataaaacagggtaccactggctgcctccaagggtgatttagagatccagatcaaattctagtggtgaccacagggtttcttcaggacagaagtaccatagtttgtcttcggtgagcatcactctgccaggcgctgggctaagcacatcatgccattgtatcacttcaccctccaaactgctccatgaataggctgttatccttgctgtatagaggctcagagaggttaagctacttgcccaaggtaacacagctgggaaggattgccaccatgaatcaaacccactctgtctccactaaaacatctgctttaaccattgctttactggcttatgtgtcatttgttacaactgatgccatcgaagacagaaacatgactaccagaacagtggagaggcaagtggaagggacactgaggccttagacagcctggggtcccatggctattgtcaagacgaactgggccccgagactccatcagtgcagctctccttctgtctctccttactctctcctgtggctgcaggcaccagtgtttggtttcaaatctgccaccctgcattagccatgcatgccccagtggcccggtgcactctccgtgggagcagcagtgatctctgctgagccttgcctggtgtggggccaacatcctgtggagcctgtggcaaggagctctgggacctcttgggtcaccaacagaaccagggaggaaccaagcaaggggttccaaatctttcctcagaccccttattatccccaccccaggaaaaacaacatcagtcccataaactgcatattgagaattatttgccatcctatagtcatgcaagacactcaatagctgtcgcctactggtggcctccaccccatgcccagctctttagctcatccaatcttcacagcatcacaattctacagaggagcatcccagaggttagagaccatcccaagatcacacagctgctaagaactgtgaccttaatcagatttgctcacaataaccaggccaactacagtcagctgagatccttcaggaccgaagcaaataagtttgtgttttgggtttttaactccatggtttgcaaagttggctgactctaggaatcacctagggagcttttaaaaatccccaaagccaagccgccccccaaacccattaaatcagaatccctgtggtgggactcaggcactggaatttttgaaacttcctgtggtgatgccgatatgcagccaaagttaagatccactgatttaaccagtgtggtttctgaggatgagaaggctccatctaggactaggaatgggatttattaatagtgattgttaatagcagctaacagggtggtcacactgccattccaggggcaccattcacagtttaatctataggagttgaggacttgctgtgaggtacccaaccagcctgttgtatgtggcagccctggtagccagccccaagcgctcaactctgtacgaggcatttgccaagcaccttgcaagtatcacctcgtttatgatatcacaagttcatggaggaggattctaatgtaacgctcattttgcagaggaggaaacaccagatcaaaagcagctgtcccatctcaactctgctgttcagtgggaaacagccatagacaataagtgggcgtggtgtgtcccagggctgtgggatttggtccaaaggctgtagtttccaggctccagctccagagggtagggaggcatggacagagctgacattcgaatgcaagtctgaatggcttcagcctccctatgctactgcttcctcctgcatttctttaacagccatgaagaatacaaacaagccacttacctttctccttcgtgattggcccgctcctccttctccctgctagctcttctcctgggtgttcacctttttctttccagagaggacatgtctaatgcccacttcccctcttagctgctccacagccactccccggatggaccccagagtcttggatctctcgggatgcccagaagccttgggaacaaccccagtcctctgcctcaggaggcccagctgaccgcccaagacagcctggattttcttggcctgccacctgtgctttattgagtagtctcttttataacaggacctgcatgaggttcttccacccagagaccttggttaaataaattaaaaggcagaaaggctggctcagctttctaagtcctgggggtccccagcaaccctcctcaccccacccctcataggtgtatacgtggatctcacaggggttgtttgctggggttcagcaccctgagtggcaaaggcgatggtttttcccctgcagctctgagctaaggcaccagccacatccctcagggttcctgcctcacccaccacaccagcctggcctcagggaaataccatcatccacagctcactgctgatttaattaattttttttttaaggcctggagcaagtcattgagccagggctgaccacagattggagctggggtgcaggactggcttcataattgacagggcccagtgcaaaataaaaaaggagtgccacttgttcaaaatgcatttggaatttcaagacaacaacaacagaaggtcaaaccaaacagggcccctcttccaagggcaaccctgtgtgactgagtccgaccgtctggccctggggcagccaacccactggctggccggcaacttacgtatggggcgaaggtctcagccaggtcaatcacagatttttcccctggaagttaacagaagagacagagaccacccattggaagtgaaggaaaccaaagtcaaaacatcccaaggcctctgatggtttccccacacagcagcgagaataacctttttataactgaatcaggtgcgcctttccccgacttgaacccacccgtccaccctcactccaggcgctctcccagtctctcagctcacaccactcccagcacactatgtctttttgttccctgaacagacccagcttgttcaaggtacatgagtcacacatgctgttccctaggccccaaatggcctccttcctcattctcaactgtcagatcttaatgtcgcctcctcagagaggccctcaccacacctggctgacagcgggtccctccttagtctctatgggagcctggagccttttgtggtctttcgttttcattggcttgtgtgtgtgctgactgttggcctccccagcagagtgtgggttctgtgagcgccgggatctcacttgtttagttctcctctgtgtgtccagtgtctaccacagtgccaggaaaatcacaggaactcgaacatgtgtggaatgcatgactatttttattattacgcactttctcagtggtcattcccgttactcaggagctcttgattttgtgtacttattttgtatctggccacattcttgaactctctcagtttcaaatgcgtttctgttcatccatgtgggaattctgggtgtatggctttatctatacaaatattaaggctgccatctcctttcctaaagttatccaacttattctatttcctaccttatcactttggcaacatacagtgagttcttttaaggatggtgtggctgatgaaaagcaagcagctctggaagatttggggggcacagagggactaagaacaggtgaatagctggggagccaaagtagttattaaagtgtggcatgagctgaacaggaagagagctgaggtcacgggaaggaaagagcgtagctgagaattactcagtcaaaggatgggcgacacttgacaataggaataggcagcaaaagagagaagatctcaaagctccaatctgaatccaggtgttctaatacgtaagcacccagagagcttgatcccacagacaataaaatacccacactaaggagtgggagctgatacagccaactatgtattttgtcgagtgcccattttaaagtaactctaagtactattatgatcactttttaaggaccaaaaaattaggaaggatataacctgaaagcaaacagccttatgaaaaagatgagaaaaaaagggaagttaataagaattctcattacagaaatggttctgagaatatgaatttgagaaaaaaattaacatgtctatcctctgacacttcacctggctacatccaaaataccttataataattaacactttttccaggttacacagcacctttacgtatgtggtcttacttgctcctcctaacagcagcctgtgatgggtcatcatagaaatgccaaacacgggtctggtggccaccgttgcaaagtacagtctcctgttttatgcccagattcctgacatatcaccttgcaacgtgcaccccgtcaaacccccctctctgtattttctgaccccaataagctgtttgccactttcaggttttcacacatccctgttcatccatgaaactgcatttgggcagagaatggttctcatccccttcccagtgtgggggaggaaatgagagtctgtccacaggcaacatggtggccctcaagcaggggctgaagcctggtgtttgaaatggggacacactccctcagttgccacatgaaaatcacatgccaccgggcactggttccccaagaccaaagaaaacttcaaaagttgcattggcaattaccaacaaatgtgtattgatcgcctactgcataccagaccagacactgccaactgtcagggcctggcatataataggagctcaacctctgcaaagctagactcatgaagagagcagagctaaagtctaaattttcactgaaattcctataagcagctaatggccaggcagtgtctatacctttgaggcctttttttttttaagtcagtctctttctctctctctctctctctctctctctctctctctctctctctctctctctctgctgtatttgcttttgggcatttcaaggataaggagccagtttgtagaagagggagcccttgtgtctgaattttaagtaaactgacagatttcaaaccgctgtggtagaagtggggccattgagtagccaaacatttgacaactatccctttgctattagggacacagcagtctctgaatttcatgctctcctctttgatgtgaagaaaatgaaaagctgaacagttgtggaactgtggatagagttagacaataagggtaatactttctttttatcactgcatttatccaaattgtttttaacaagtacatgttactctttttaaatatattttccttttctgttacaagctcattgaaaaacagaaactcaaacataattccttttatagtgggcgaaaactgttgcaaagccaggccaaaaatatgcatgtgtcaacccgtattttgtgacccgttatcattttacttctatactccagacacatcgcaaacatcatctccaattctgacagccctgtgcatgcgttccgttatgatttccattttataagtgaagaaactaaggctcagaaagtcaggtagcttgcccaggtatgcgcagtagcaggtggccaaggtccatctgacatgaaaaccttgcccttcaactgtgtcccatggggcagggtgagattataggctcagctctgagctactcctctgcccatctctacagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggtagggatgaagccctgctgcctgggccccgcaagcacctgggcctgtgggggatggggaaggtgaccctggaggaaagcagagctggctttcatcctggggctcctggagactgaggaaggctgaggtgccccacatgatcaccggcaaaacctgtaaagaccctgtccccagtgggtccctgggaaccagagggaccaaaaagccctgttctcttgcccagccacccatttcatgcccacactccagatacatttactgagtacctactatgtgctgggcactgagcccagacctggggatacaagaatgaatgggacccagttcctgtcctcacagacagggacgggtgcatagccaggcagtaggatgggtgcattgatgagggcataaataggcctgagaccccagaggaggaacccgagaggggtctaaaatgacttcacaggagcggtgctgcctcagctatgacctgaagggggactggagttagccaggccggaggtgggtgctggatggcagagggaacctcatatgtaaatgaacaggaaacaggagtcactcactgtgcctggggcatcgattgcgtggtgcaggccagggcagaaggatggactaaggaaaggtctacagcaggggcacaaggtgtggtgggcccgtctggtgaggtgggatgggggagctcacaataccaaagtgggcaggaatgttacagaggcccaggatggtggctggcttttccgtggaaggccgtggtgtgcaatgacagagacgagccagaggggcatctgggaggtggcaggggtgggatggggcaattgatgggatgtgaattggagaagaggaaggctgagcctccccttggaggactgggaaatactcctgctaaccagtaacagcgtgaacgcagcggtgccttcagagcgccctctgctggccgattctggtattagagccggttgtgatttctattcttgttttcagttgtgtgaccaatatcctaacagttatcattttgtacactgagtcgcttttgtttttgttttcaattagtattataatatgagcattttctctgaatggtttttagactcgtccctttaatatcaaaaaacatcaccacaatcaaaaacaaaagcttaaagacaaatcagagaaagtatttgtaatataaataaattttatttttaaaactcacatatacaaaaaaaaattcagatctcttgttttttttctttttttctttttttttgtttgagatgaagtctcgctctgtcgcccaggctggagtgcagtggcgcgacctcagctcactgcaagctccacctcccaggttcatgccattctcctgcctcagcctcccaagtagcagggactacaggtgcccgccaccacactcggctaattcttttgtatttctagtagagacagggtttcactgtgttagccaggatggtctcggtctcctgacctcgtgatccgccctcctcggcctcccaaagtgctgggattacaggcgtgagccactgtgcctggcccagatctcttacaatggacaaggaaaaaatgaataaaaagtaatacagtacagccagacatggtggctcacacctgtaatcccaacactttgggaggccgaggcaggaggatcacttgatcccaggagttcaaggctgcagtgagctatgattgcaccactgcactccagcctgggcaacagagcaagtccttgtctgtaaaaataatattgataatacagttaattcacaaaagaagaaatgcaaatggctggtaaacatatcaaatgttgttccatgtgactaataaagaaacaaatgaaaagcagatattctttctggcctaccagattctcaaatatgaaaagattggctggtgatggtggggagaaatagatgctcttgtacactgttcagaggaggatacactggataacctttctcaggcacagatagatatatgtacctcaaatctttttaaagagcctgacccagcaattctacctttaggaaagtatcctaagaaaataaccagaaataacataaaacttggtctctgcagtcaaacaggcctgggttcaaatcctcatgtggcctacctgtagctatgtcttggactggtatcttcagccctaggagcctcagtttctgtccctgtaaaatgggacagtaatgggtccacctccaaggctacagggaggattgcacaagataataatgggggttggtgtcaccgcaggaagcagccctgaggctgggggaagcgggaaggtgatggtctcctgacagctccccacttcccaccccaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccaggtgggtgatgggcacccagcagggaccacgcatcctccagggctgtcctccagggaggagctctgctgtggccacagctagtaagagggaagaggatcagcagacagagcactggactaagagtccactcctggcctgagtcctccctctgccattcactttgctaggtccttagggcgagtggcttccctgaacctcagcttcctcactggcccagtgtactgcatgctgattctgatttcattcttataactgtcttgtgagccaggtggcattcccattttagagatggggaagctgaggcccagagggggtgagtgatttgaaccaggctgcacaaggagaactcagtctcatgctctgtgccccagctaccaggctgatagcaaaactcatccccaggttggttctgtttccccactgagtgggcccttggtccaaactccacaggttttcagagtaggaatccccctagctccacccacttcactctctgcttctccctccttcagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgttt

SEQ ID NO: 36927 - DNA, 43457 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccggtaggaccccggggcgggttcgcgcgtccgcggcgagactagagctctcctcagtcgggcaagagtcgcggggcggggctcacagcaggccgtgcctgtttggggacagggttctctgaggggtgcagtgctcagatcccgggggtatgtggcggggaatgcggggaccacgcagagcccgaggtgaagcttgtttggtggcgtcgtgtgcgcggccagcatttacgcaggatctggctgcgtccctaaaaaaagcgtgaatcgtgttttcgggattgagccagtcggccaggggagcgcggactgggcgccctaggtgagggcttgttctggagtgcacaggtgcgtgggagtgttgctagggcccgtgctgtgtccgtggtgagagtttgccctgtgttcccttggtgccttggtgagtggggtgttcattagggcttggacagtacccgcggtaagggttgcagtgcgtctgctgtgccccatgtgctgggctgggcgagcaggggcctggccaggtgttgctgggagcgtgctgtgcgtaagtggcctgtgtgcagagttcactgtgggcaagacagctcaactgtttgctttgaatggagtgagcgcggactctggggctagggagggcatgttgagtgagagcaggctctcggtgcctggggttagagaggtggtaagggcgcgccatgctttttgtgccttctgtgaacagtctccgtgttacctgagctcctattagtttgtaaatggctgcttttttggggggtgggtgggccatcgagtcttcttcctgttcccaaccaatatagatagtatctgattccattgcctaatggctttttgacattgttttccttcttttcattactttgagtcatatttgagagatgtgaaacaacctaaaaaacaatggtagccaaacctagtgagaaattagtatcctaacaaaggaaggcagataatgttaatcttgttttcccctgcagctcataagctaaagcttaaggcctatcccactaaatttattttgtatttcattgaatggaatcaatacttttaaaaatgcatgctaggccaggcgcagtggctcacgcctgtgatcccagcgctttgggaggcccaggcggggtgattgcctgtgcccaggagttcaagatcaacctgggcaacatggcaaaaccttgtctctacaaaaaaatacaaaaattagctgggcatggtggtttatgcccgtggtcccagctactctgggggccgaggtaggagattcacttgagcccaggaggtgaaggctgcagtgagctgtgatcatgccactgcactccagcctagatgacagagtgagaccctgtcaaaacaaaacaaacaaacaaaaaaaaaacccgctaagaaatacatgcttattgtgcgatacgaacagaatcaaaagacagctatttttaatattttggcatatttgtttctgccttcatgtgcgcgtcatgtgtatctatgtccaaattatatttaggatccaataacatgtatagtttctacgttgcatttttttccttaggagcattcattcaacgaatatgggtcttgtatgtctggtgctattacactggtaggcaataacaaaccattcctattttcttgatccttttttcactatttgtttacacacacattcatgcaggaagataagcagggactttgttttgctcaatgataagtgctcagtgccgggaacacagtagataaccaataaattatttgctaaaatgtattgggattggcagacattaaaatccaaaacataatagtgacaaataaattatgaaccaagggaagtgctctggaggcaagcagtataattttcagatataaatctgacagcatttaacaaatgattggagagagggaaggcttctctgctcatcaaacagactttggggcatctgtgcttgctgttccctcagcccaggaacattctcctcctgacctgctgcagaaacagtctcgctcttctgcaaactcagctggaatgttacaccctcagagaccttctctgatcaccccacctcgcgacccccccatctcaggttgaacacatacaacccagttcaagtccctcttcacttgtaatcacccttttaaaatgaccttttctgttctttgtctcaccctgtcagaatgcagggatcctgtctgtcttgtcgcacttgtggttccaaaagcccgatttgtttacctctgtatctgttaaataccagaaaattaaatatactatttggctggggcttagagcctaggaaaaagttcctcctgcctccaagaggaaggttctttaaagagctatgctcaggatggtctttctgcggtacctaaaaagctagggcagtggcagctgagagccagaaaggatctgtctcccctatttgttgactctgcagggcttccagtacttcagtcttgcatctcactgatcattaaaacgttcattttgaaggagggtaatgggagtagggagtagtggtgataagaagaaaacaaaaggacttttttttttttcttttaagattaatgtttagaataggcttagtgctagaagttcagcctggacagcataagcagacctcacctatacaaaacatgtaaaaaaaaaaaaaaaaaattagccaggtgtgatgttgcatgcctgtggtcctagctacttgggagactgaagggggaggatcactggagcccctcatggtcaaggctgcagtgagccctgatcatactccagcttggataacagagcaagagaccctgtctcaaaacaaaacaaaacacacacacatacacacacaaacaaacaaaaaaagaaacaaaataggaagctgaagaagataatgaaagcgatttgaaatagaggaacatagaattatgaaatgaatagggtgcaacatggaaaataacaaaactaagaatgaagagaaggaaaagcaaggttaagtttgaggttcataagggtaaatcaagacaggtatgaaacctagagaaagtaaaaatgagaagtcacgatgctaggcagagagaatacgtgaattaaaataaacattcaatttttggagcaactcactctcacaaggagaaggtttcgtaagcagacagtgctgtgcatgggagacctgccctctcaaaggtagttgccaaatggttccagatagttgaaggaaacatgtatcaaatttcaggccagtctcattcctccagaagaggagctgcttttttggacaaaacccgcaatctcctgttgtgcgtggtctcttctgcctattttaggtgttttccttatttccagtgaaagaagccaagatcagtaagcacttacacagtagcgtctcagtttccttactgggcatactacaatgcaaagagagcagtccatatctggtcacctgccaggataccagaagactgggagataggcagcacaagaaatggcctaatcttctttctccattgtgctgtagaatgattattttcaatatgaaattgattacaatatattcttcacattgttttgtgtttgacagcagtggattttgaataccaaattttttttgaatagctactctgagtgacatattgtgctgggtgttgtggccacatggatgaatggagttggccttgttaactattaaacacaaaagcatgtgatagttacctgagagatccatgcaggggagagtccaggggaaggtgactgatcactgcttcccagggggaggcagaaaatgcttcctggaggagatgatgggtggattaaggaagatgagttgagcaggagttgtagctaccagccagggaggaagggtattcagagcagaggaagcaaggtgagcaaaggcaccaagatgtgacactactggactgccaagctattcagtgtggcagagtagggcaaaggaggcaagaaagaaggaagaggattaaatcacagggtgagtaattctgaaaagcaacagactcatcaggagtaaacactcaccatcataaattcagactttcacgttattacctgtccttttagggcaacttgagccttttgtttgacttagcacaacatgaatccaaactagggttgttttgattttcccaggcacggtagcagacaatttcttgaatacttatttgcagatagagtttgtcagtgtcagcatttcttgtgcacccacaaggtgagtatagtagaaaaagaagaacatggttcttgacccccaggaacttgccttttaagagaagacaccctgaagtgacaagctgttataagttagtgttttaaactatggaagaacaatctgagcagagtactctatactgtagaagacttcttagaggagaagttacttttgaaatgaatttagaaaaatgtggggaaagatgcatccatatatattttaagatcaaagacattaatgctgtctcttcagtttattgtcgaatgtttattcccaaacaaaccaaaagctaataggatgttacttaaaacatgcaagtcccatttcctccactgctatgagcactcaggtaaaagcatggaacagtcatttaaaatcttgccaagggcctttctgttttttctgtactacctgctgccagaccacagtccatggctgatgaaagtgatatcagtacttcatcttcatgttcctattctcttatccctagatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagtaagtaaacaaacctcttttttttttctgcttgctctagagatttgcatacattttggggtacatattccactacggtgatgatgattttcttcttgtaaaatgaggttcaagataacaatgcatttttgcaagctttgagaaatcaaaatctccaagaaatcattttcctggcaatagattgcctgggtgaatatgaatcttaagtttgcccttataataagtaaataatgaaaattatattcccacccattcaaaagagcactgcagaattttgattttgattcagatctgttttataactggattgaaaactatcaaaattattttctttcaggagaaacatgtccatatatacgggatcctttaaatggccaagcagtccctgcaaatgggacttacgagtttggttatcagatgcactttatttgtaatgaggggtaagttgctccttagaggaaataagggaagtgttagtaattttatttttgttttgcttctcttcttaagcattcctgtaaacttaattttgctttctatgtgacaagttatacttctagccaaacaactcttggatgttttatggagataggcaagatatatagtaaatagaaagtaattgatatttaaggaaagcaaaactacttgctgtttctgacaataagtctgttgtaagcattaagaatgtagtaatcatgagaatttgtccttcacaactgagtgtcccctatttaaatctgccaactcttagagttgaagtagggctcacaaaaatgagaaatagaattgccaactaaagatacacttgtatccagatgactctgtaaagtgttatcagaccaaaactgacgcggttagcctttaccatcatgttgatcaaaatctctcagttgaaaaaccttatttttgagactgctacagtgtgaagcatctcaagagcaggtactgagccctcggtaatagcctttgttctgtagggttttgaagttgtatatattggagatactagacatttaagataaatgtgcatttatagagtaaatgtaagtattctgctataacagaatacttgaggctaggcatttataaagaaaagaaatgtatttggctcatatttctggaggctggagagttcaaggggatggcagtagtgtctggcaagggcttttgtgctgcatcataacatgctggaaagtgaaagggaaatttagcatgtgcaaaaaagacaaagcacaagggagggggttctcgctttataacaacgtgctcttatggtaatgaatccaagcctacaagaatgagaactcattccctgaagaattaatgaagaccctctagaaaggcattatacctcttaatgacctagtcatttcttaaaggccccaccacctctcaatgctgttacactggcaattaaatttcaatatgagttttggtagagacaaaccagattcaaacaatagcagtaacacaccataatatagaaaaagtaagtgagtcttggaggaaaaatcagctgtgactatgtaaggcaactgacagtttttaaaatttggtcaagtagaaatattggaatattcagttgacacatactgcttgctaggcacaccgagggataccaaaactttaagacagtgaccttcctaaaagaagttctaaccttattgagaaataatatatactgagagcaataaaagcaaaatactaaatgagaaataccaaataagtagaattattcatgataattactctaagagtccagaaggaggagagattcctgtgaatttaaatcagggaagatttcattgagtataggggtatacttaatgaaagtattcttatactcagtgagctattcctagaaatacactctgttctaaataatattaatagaagctaaaactcatgtagcactatctatgtgccaaatgctaacttatctaatcccctaaacaaccccatgtactgttatccccttttaatcaattaggaagctgagtgaaggaactttaagtgacttacccaagctcaagaaactagataagttgagaagcagggacttgaatctatccattccagctctagggcctgttctctctacacagtccttgtccttactgtgcaaagtggtgtgagaaaaggcacagaaatgaatgtgtaatgtgattgcaggaggcagcaaagaggctgggtggaaaggcacagcagatttatttagacatctttgctcttggccaatatatattcaaatggggaaactctatttgattaaattgcagatttatttagcactttcgttatatagtatgttgtttaagaaaccaccccctcaaactactgtagtgtagaaaagaaaccatataaaaaattccttcattattatgtgtgtcttattaattgctatacaaaacagtaaccctttcttttctcatttagttattacttaattggtgaagaaattctatattgtgaacttaaaggatcagtagcaatttggagcggtaagcccccaatatgtgaaagtaagtaaattctttttttttaaatttagaccagtagtcctcaaagatttttgcctcctttacaccctttacactttaagattaacaaagatcccaaagaggtttcttttatgtgggttatatctattggtatttatcatattggaattcaaacggagaggtttttaaataattattgattctttttggttttgtttgtttttcctaagacacggtctcaggctatttcccaggctggggtgcagtggcacaatctcagctcattgcagcctcagcctctccagtagctggggcttcaggcatgtgccactatgcctggctttttgtaatttttgaagagacggggttttgccatgatgcccaggctggtcttgaaatcccatgctcaagcagtctgcccccgtgggcctcccaaagtgctgggattacaaatgtgagccaccccacctggcctgattaatttgtaagaataaatgcaatacaaattaacatatgtaacataatttttatgaaaaataataattttccaaatcaaaataaaattagtgagaatagtggcattgttcacattttttgcatatctcttcaacatctggcttaaagcaagattgtatttggcctgttgtgttatcacacaatatgtagcctttggaaaaatatcactatattcttattaggatcagagtgaaaaaagacaataatattttggtggtattgtgaatcaccaatttagaaaatggatatatttataaattgcaaaggatttcttaactagcaccgagttaagcatattttctcattaattgtcagcatttcttgtgatgactagaacagaacttagcatggccttccaaataaatacaggcgtattaggccgttttcgtattgctctaaagaaatacctgagactgggtaatttataaagaaaagaagtttaattggctcatgtttctacaagctgtacaggaagcatggtgctggcatctgctgggggtttgggtaggcctcgggaaacttaacaaccattgggaaagacagaaggagagcaaggtgtctcacatggcaggagcaggaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgcgatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaacagcttgtagaaaccctatattgacaaatttattgaagacacagaaattttactaatgctgtcttaatcttttacatttcctttcctctttttcttcatttttaagaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaaggtagtgtttcaatttatttccttcttcatttgtaaatactatggaaacattttgtaaatagtttcatctacagataaacaaagcaggtgtatgtgcttcctcctcctgtataattggtttctaatttattttaattcaggtcaattcaagtcaaaaaatagttctagctagagttccctatttctcacccctacatgttcttggcatttcattttatacagtgtgaactactgtgtacctgcatgagttagaagtttttgtttgaaagaaccaaaaaaaaaaaatacacactggcttaaagaaagtttcatcttgtattacaagaaatctaagagttctggctatggtagtggtaaactgtgacagactaatcgtctcacaaataaaaatgataaactctggataaaaaaaattttttttttaaagaccaaatgtttaaggcactctggagtgaccaaaagtatgaagaccatgtaggggacttgcccatttaaagaaagaaatcactgaataacagtgatttaaaagtatatactccccaagtacacatgaaacattctccaaagtagaccatattctagacaataagacaacttttaacaaacttcagaaaattgaaatcattcaacatgcattatcacaatagaatgaaagcagaaatcaataacaaagccaatccccaaagaattggaaagtgtacaggacacttctaaataacccatgcataaaagaagtagtcagcagggagattagaaagtgttttgaattgaataaaaacacaacatctcaaaatatccaaatatgtaggatgcagctaaagcattgcttacaggggaatgtatagcataatatacttgtgttagaaaaaaagaaaagtctcaaatcaatgatctaattttccaccttaagaaactaaaaaagagcaagttaaatcccaaactagcagatgtaaggaaatgataaaaatagagccaaaatcaatgaaattgagaaaagaaaaaaaaatagaggaaatcagtgaaaccaacagttgctacttggagatcaataaagtgtgtaaacctgtagccagactgacaaaaaaagacgcaaattaaccaatactgagaatgaaagaagtggtggccaggcgcggcaccccagccagcttgaagaccctgccctcctgcagccggcaggggcagtcactcccggacttgtccttttagaagttccagctttaccacttgctggtggagcccaaccactgccgcagggtcctcatcgccaacacgcctggcagatccaagaggagatggcccaggatgagacgtggcacacacaggcacccgagagtgtggggttggcgttgttccactgcctggtttctgcagagatcctgtgcctgtggcctgtgcccgccatgtggaagccagagggggtgtgccatgccccccgctttggacactgctgcgtgaaggggccagttttcagacctttgctctgtcacctcagcactggcgccaggagccctgaagagcagcatctgggagacggacagccctggggaaaatagaggaggcgttcagaagtagctagatgagatatttgaaatactgaagaccaaaaaccccagtttgcatggaagaactggcctcagatgtggtcagttcctatgatgacctggacacacggtgctgacccacacgatgggaggtggccctgcaaagcattcagaggcttgggcctgctgccgtccggcctcccacctccagctgcaattgcattctgacctgggcaagtaggaacacgtagtggagatcctgatggagacctgagccaggcgtcccggagtgctggccaggcgtggagtacgggatccagctaagggagactggccagcctatagccccccagccttgctggctcctctgctaattccagcagggtctgcagccccagacccatccccttccttcccgtctgcagagggcaggccagaggctggtctcagtgggagctagggctctcctcaagggctttttgaccttgggccagtcttgacatccccacagccctgcgcccctcatcacttttcgtgtctctcggagacggcgagctgcaactgcagcaatcttgtttaaatttaggtaggtgaatttcttagaattaagtttcatatgttttgagcaataagttttcttaagatatatatattttaatctttttagttttatctctgaatattttttattttttttcaatgtattttttttctggaaacattctgtgctgctacattagagcctacacagtttagttggtacatttcattcttttaaggttcaaataagggattttattttccagtgagtttccttgcattgttaacaagtcaacagcgttaacgtatgattttttggttttttttttttgtatactttaaatttgtgtgcaacccttctcatttatgccctgtgttacagtgagagcttggtcaaagtggggaaaacacacacagctgctacactttttttttttttttttgtcattggaacatttgtgccatgtcttcctagacttaagtgtaaattatggagggttttatttgacaatttatatgtaaatgtcattgaaggctaaggttaaatctttggaaatcacaggcaccagttgatctttagagacctcagatcccctcaggtggcgccttgtgataggcggtgttctgggaggcttcctgtcaggttccacagcacaggcacctgctctgggcacggactgagctcctggggtgtgcacggagctgcggtgcgccagtcacatgcgcttggaaacagcgtgtgctgctggattggaaatgcctacgttgctctgttaaattggtgctggagccaaaacctaaggttaaatttaagtctagaatgaaagaaatctgaatccatgtaattaatggccgctcgatcttgagagtccttgacggccctgcctcaggaagtgaggtgggggtgcctacacctttcactttccttcctcacgtccaccccgtatgtgtttctcatcctttttctgacttccccccatcccttagccaaaaagctttatattcttttgtgcatatggtcattctttaatatcagtgatgtaaactttacttgattactttacaaaattattcaacagacaaacaaaagaatgaaaaagagaatatcactaaatatcctacagacatttaaaggatgacaagggaatattataaacaactttatgcctacaaatttgacaactgaaatggacagattccttgaaagatacaaaatgtcaaaactcacttgaagatatggataacctgaatactcctatatctaccaaagaaataaaatttgtagttaataacctactgaaggtccagatggcttcactggggagttctaccaaccatctaaggaataaatcacagcaattctacacaagcgtttcaagaaagtgcaagaggagggaacacttctcatcccattttatgatgatagcattgtccttatacgaaaaccagaaaacaaaaacattataagaaaattacaaataatatccttgatgaacacaggaccaaaaatcttcaacaaaatattagcaaaccaaatcctgtgatacataaaaagaaaagtaaatcatgaccaagtaggatttaccctatgaatgcaagattagttcaaatgcaaaaattaatcagtgtaatttgccacatcagtagactattaaggagaaaaaaaatcatgtggttatcttattagatgcaaaaaacaaagaaaatgtttgacagaattcatcatcttattttttcatgataaaacttctcagcaaactaggaacagaagggtactatctatcttaccctgataacagacatctacaaaaatctcacagctaacattacacttcatggttcaaaaaaattatacttagtggtaaaaagtaacattgtacttagtggttaaaaaaaccttacttacatttctgtctaattaataaagacctaattctggaaggaaaacagtgaggatgtccactcttaccactccattcagcattatattggagatcccacccagtacagtaaggcaagagaaagctattaggcacacatgttggaaaagaagaaataaaaactgtctctactcacaatgagatgccactaaatacctattggaaaggccgaaatgtaaacacacacaccccaaactgacaataccaggtattgacaaggatatggagcagatgaaactctcatatactgatggtgagaatcaaagtgcaatgaccactttgggacatttttggcatttcttataaagttaaacatactcttatcatacaactcggcaacccaaataaactgaaaacattttcacacagaaacttatatgaggatgttcacagcagccttattcataatcaccccaaactgcaaatcgccacatgttcttgagttggtgaatgaatgaaccacctgtgctacctctaaaagatggactcgtactcagcaataaaaaggaatgaactgattcatgcagcaacacaaatgaattttgaaagcatcatgcttagtgaaataagccatactaagaagactgtaatttcatttatgtgacattctgaaaaagtcccactatagggataaaagcagatcaatggttagctggttgtggaagtggggatgagggggaagaggggtaactcacaaaagagcatgaggaaattctggagagtaatggaacttttctgtatctttactatggtggtagttacatgattatttgcatttgtcaaaactgatacagctgtacacttgaaatggtgaattttactgtatgtaaattatatccaataaaccaacctttacaaataacattaggtacaattagacacaacaaaaggtcagtgaacctgaagacaggtgaatagaaattgaaccttatttaagaagaaatgttgactaaagaaagagagaggcttacagacctgtgggagagtatcaagcagtgaaacatacatgtaattggagtttcagaaagacaggagagagaatggtgtaaaatattatttgaaaaaatattggccaaaaattatccaaattagatccaaaacaacctcagatccaggagattcagtgaaccttcagcaggatgaataaattattaaaatttaccaccaccaccacccccctgcagtagtttggtaaaaactaccaaacaaaattttaaaaagcagccagtgagtggggaaaacaacaaaaacccgtattacatttaggagggcagggacaagtaagaatgacagccagccaagttttcttaagaaaatgtggttacaatatggttatctctgttagtgctgaaagaaaaataaaacaccctagaattctgtatgaaggagaatatattagttaacatttaaagtcttttaaaaaatgtttttaacatcttgcattccattccttgtctctgttcacactggaaattactactttgtactactttttctgctaaagcagatatccattaattctgaggtttctctaattttccagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcaggtttagtaatttcctgcttatagtttttcaaaaatcctttaaattcctggtgattttttataaaatccttcaaatttctggtgatgttcacttatttttagtaatgaaaggagggaggacatttgtatagccattttagttgttatacatagtgattctaaaattatttgccataatctgatataaacaggaatatgaccttgggaaagttgtataaattttgaatgtgtttatatatatatgtttacattatatatagagaaattgatttagtaccttccttattgggtattagtaaggtataagtgggatgcatttaaagcacttagcacagtgcctggtgtagagaaagctcttagagctagccaatatgacttatcctacacttaaattaatgttagggaaggggaaggttcatgtatgtttgttagtatgtgtgtgtgttaatatgttaatatgtttgtttgttaatatgtatgttttgtgtcatcaactttgctattttattcttttcagaagtgatctgttgacacctttactgagtttgttcctattgcaggactctttcatttcctggaatgcaactagtttgagtcttctgatgtaaaacatttaaacagggaaatttctgctgtcctcagaacaagatctgtatttctgcctcttccctacccacccctcttccacacctcataatgttatttattttttttctctttagtgggcagttttatctggcaatagcaactcaattttatagcaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagactaaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccaccactatgccggctaattttttgtatttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaatttataaaatcaaacttatttttctaggtcctaggcctacttacaagcctccagtctcaaattatccaggttggttaactctttatcctactgatattgttaagaatttatttatttatttttattatactttaagctctagggtatgtgtgcacagcgtgcaggtttgttacataggtatacgtgtgccatgttggtttgctgcacccatcaactcatcatttatattaggtatttctcctaatgctatccctcccccagcccctaacccctgacaggccccagtgtgtgatgttccccaccctgtgtccatgtgttctcgttgttcaactcctacctatgagtgagaacatgcggtgtttggttttctgtccttgtgatagtttgattagaatgatggtttccagcttcatccatgtccctgcaaaggacatgaactcatccttttttatggctgcatagtattccatggtgtatatgtgccacattttcttaatccagtctatcattgatggacattcgggttggttccaagtctttgctattgtgaatagtgccacaataaacatacgtgtgcatgtgtctttatagtagcatgatttataatcctttgggtatatacccagtaagggattactgggtcaaatggtatttctagttgtagatccttcaggaatcaccacactgtcttccacaatggttgaactaatttacagtcccaccaacagtgtaaaagtgttcctgtttctccacatcctctccagcatctgttgttcctgactttttaataatcgccaatctaactggcgtgagtggtatctcattgtggttttgatttgcatttctctgatgaccagtgatgatgagcattttttcatatgtctgttggctgtataaatgtcttcttttgagaagtgtctgttcatatcctttgcccactttttgatggtggtgtttttttcttgtaaatttatttaagttctttgtagattctggatattagccctttgtcagatgggcagattgcaaagattttctcccattctgtacgttgcctgttcactctgatgatagtttcttttgctgtgcagaagctctttagtttcattagatcccatttgtctattttggcttttgttgccattgcttttggtgttttagttatgaagtatttgcccgtgcctatgtcctgaatggtattgcctaggttttcttgttgggtttttatggtgttaggtcttacatttaagtcttcaatccatcttgagttaatttttgtataaggtgtgaggaagggatccagtttcagctttctacatacggctagtcagttttcccagcaccgtttattaaatagggaatcccttccccatttcttgtttttgtcaggtttgtcaaagatcagatggttgtagatgtgagttgttatttctaaggcctctattctgttccattgatctatatatctgttttggtaccagtaccatgctgttttggtcactgtagccttgtagtatagtttgaagtcaggtagcttgatgtctccagctttgttctttttgcttagggttgtcttggctatatggactcttttttggttccatatgaactttaaagtagttttttccaattctgtgaagaaattcagtggtagcttgatgtggatagcattgaatctataaattaccttgggtagtatggccattttcccaatattgattcttcctatccatgagcatggaatgttcttccatttgtttgtgtactcttttatttcgttgagcagtggtttgtagttgtctttgaagatgtccttcacatccatcccttgtaagttggattcctaggtattttattctctttgtagcaattgtgaatgggaattcactcattatttggctctctgtttgtctattattggtgtataggaatgcttgtgatttttgcacattgattttgtatcctgagacttcgctgaagttgtttatcagcttgtggagattttgggctgagacgatggggttttctaaatatgcaatcatgtcatctgcaaacagagacaatttgacttcctcttttcctaattgaataccctttatttctttttcttgcctgatcaccctggccagaacttccaacactacgttgaataggagtggtgagagagggcatccttgtcttgtgccggtttccaaagggaatgtccagtttttgcccattcggtatgatattggctgtgggtttgtcttaaatagctcttattattttgagatatattccatcaatacctagtttattgagagtttttagcatgaagggctgttgaattttgtcaaaggccttttctgcatctattgaaatagtcatgtggtttttgttgttagttctgtttttgtgatggattatgtttattgatttgttaatgttgaaccagccttgtatcccagggatgaagccaacttgattgtggtggataagctttttgatgtgctgctggattcagtttgccagtattttgttgaggatttttgcatcgatgttcatcagggatattggcctaaaattatctctttttgttgcacctctaccaggctttggtatcaggatgatgctagcttcctaaaatgaattagggaggattccctctttttctgttgattgaaatagtttcaaaggaatggtaccagctcctctttgtagatctggttgaattcggctgtgaatccatctggtcctggactttttttggttggtaggctattaattattgcctcaatttcagaacctgttattggtctattcagaggttcaacctttcctggtttagtcttgggagggtgtatgtgtccaggaatttatccattgcttctagattttctagcttatttgtgtagaggtgtttatagtattctctgatggtagtttgtatttctgtggggtcagtggtgatatcccctttatcattttttattgcgtctatttgattattctctctttacttctttattagtcttgctagcggtcatttttgttgatcttttcaaaaaaccagctcctggaatcattgagtttttgaagggttttttatatctttacctccttcagttctgctctgatcttagttatttcttgccttctgctagcttttgaatttgtttgctcttgtttctctagttcttttaatggtgatgttagggtgttgattttagatctttcctgctttctcttgtgggcatttagtgctataaatttccctctacacactgctttaaatgtttcccagagattctggtacgttgtatctttgttctcgttggttttaaagaacaactttatttcagtcttcatttcattatttacccagtagtcattcaagagcaggttgttcagtttccatgtatttgtgtggttttgagtgaatttattaatcctgatttgcactgtggtctgagagacagtttgttgtgatttctgttcttttacatttgctgaggagtgttttctaccaattatgtggtcaattttagaataagtgcgatgtggtgctgagaagaatgtatattctattcatttggggtgtagagttctgtagatgattagtaggtctgcttggtccagagctagttcaagtcctggatatccttgttaactttctgtctcattgatctgtccaatattgacagtggggtgttaaaggctgccattattattgtgtgggagtctatgtctctttgtaggtctctaaggccttggctttatgaatctgggtgctcctgtattgggtgcatatatatttaggatagttagctcttcttggtgaattgatccctttaccattatgtagtggccttctttgtctcttttgatctttgttggtttaatgtctgttttatcagaaactagaattgcaaccccttttttttttgctttccatttgcttggtagatcttcctctgtccctttattttgagcctatgtgcatctttgcatgtgagataggtctcctgaatatagcacaccgatgggtcttgactctttatccaatttgccagtctgtgttttttaattggggcatttagcccattttcatttaaggctaatagtgttatgtttgaatttgatcctgtcattatgatgttagctggttattttgcccgttaactgatgcagtttcttcatagcatcgatggtctttaccatttggtatgtttttgcagtggctggtaccggttgttcctttccatgtttagtgcttccttcaggagctcttgtaaggcaggcctggtggcgacaaaatctgtcagcatttgcttgtctataaactattttatttcttcttcacttacaaagcttagtttggctggatatgagattctgggttgaaaattattttctttaagaatgttgaatattggcccccattcttttaaggctcgtagggtttctgctgagacatccgctgatagttggataggcttccctttgtgggtaacctgacctttctctctggctgcccttaacatttttttccttcgtttcaaccttggtgaatctgacgattatgtgtcttggggttgcacttttcaaggagtatttttgtggtgttctctgtatttcctgaatttgaatgttggcctgtcttgctagtttagggaagtcctcgtggacaatatcctgaagagtgttttctaacttgattccattctccccgtcactttcaggtacaccaatcaaacgtagatttggtgttttcacatagtcccatatttcttggaggctttgtttgtttcttttcacttttttctctaatcttgtcttctttttttcattaatctgatcttcaatcactgatatagtttctttccacttgatcgaatcagctattgaagcttgtgcatgcgtcacgaagttcttgtgccgtggttttcagctccatcatgtcatttaaggtcttctctacactgtttattctagttagccattcatctaatcttttttcaaggtttttaccttcctcgagatgggttagaacatcttagcttggagaagtttgttattactgaccttctgaaacctacttctgttaactcatcaaactcattctctgtccagttttgttcccttgctggcaaggagctgtgatcctttggaggagaagaggcagtctgttttttggaattttcagcttttctgctctggtttctcccatctttgtggttttatctaccttttgtctttgatggggttttggtgtggatgtcctttttgttgatgttgatgctattcctttctgtttgtgtgttttccttccaacagtcagacccctcagctgcaggtgtgttggagtttgctggaggtccactccagaccctgttttcttgagtatcaccagcagaggctgcagaaccacaaatattgctgcctgatccttcctctggaagcttcgtcccaggtggggcacccaccacctgtttgaggtgtttgtcggccgctactgggaggtctttcccagtcaggctacatgggtgtcagggacccacttgaggaggcagtctgtccagtgtcgaagctcgaatgccatgttcagagcaccactgctctcttcagagctgtcagacagggacgtttaagtctgcagaagctgctgcgttttgttctactatgccctgcccccagaggtggaatctatagaggcagtagcccttactgagctgcggtgggctcctccagtttgtgcttccagttctctttgtttacactgtgagctactcaagcctcagcaatggcagacattcctcccctcatcaggctgcagtgtcgcaggtcaatctcagactgctgcgctagcagtgagcaaggttctgtgagcgtgggacctgccaagccatgcacaggagggtatctcctggtctgctggttgttaagactgtgggaaaagtgcagtatttggtcaggagtgtactgtttctccaggtacagtctgtcacggcttcccttggctaggaaagggaaatcccccaagtccttgcgcttccgggtgaggcgatgccccgccctccgtgggctgcactcactgtccagccagtcccagtgagatgaaccaggtatctcagttggaaatgcagaaatcacctgtcttctgcatctatctcgctggagctgcacaccagagctgttcctattcagccatcttggacaagatttttttttacttaaaatttttttaaattaaaaacttaagacatatctaaaaaaatgttaagaatttttaaatgatgggtgaaaaataacatcttgttttaatttgcatttcttggttcttggtttttagttgtttttgtttttgcttttttgagaccgggtctcactctgttgcccaggctggagtgcagtggtgcaaccacggcacactgcagcctcaacctcctgggctcaggtgattctcccacctcagcctcccaggtagctggaactacaggcacctgccaccacacccagctatttttttgtgtgtgaattttttgtagagacagggttttgccatgttggcaagtcttttctccaactcctgggcttaagcgatcctcctgcctcagcttcccaaagtgctaggattacaggtgtgacccaccatgcccggccaatttacatttctttaattatcagtgaatctgaactttttttgatctacatttatttattcatgtgctttgtctatttttctgttaggtttctaaaatatttttcttagtgatttttgagagctcattatgaattaaagcccttttaatatgaagtgaacagttttttccaggttcttttgttttgtcagttttaagcttgttatactactggatatagattactttttataacttttaattacatgagtagtgtatgaatatacttttgtagaatttcaaacattacaaaagtatatagagtaaaagattagttttatttttaactcattacccaagttaatcactgttaatagtttagggtttctttttaaatctatttttgtacatcaacatctttttttaaaaagttttattttagatttgggggtacaggtgaaggtttgttacataagtaaacgtgtcacagggatttgttgtacataactatttcatcacccaggtattaagcctagtacccaatagttaccttttctgctcttcttcctactcccaccctccccggtcaagtataccccagtgtctgttgtttccttctttgtgttcattagttcttaccatttagcccccacttataagtgagaacatgcggtatttgggacgttcctgctgaagacatgcgctcgttcttttttatggctacgtagtattccacggtgtatatgtaccacattttctttatccagtctgtcattgatgggcatttaggttgattccttgtctttgctattgtgagcagtgctgcagtgaacattcatgtgcatatatctttatggcagaatgatttatatttctctgggtatatacccagtaatgggattgctgggttgaatggtagttctgcttttaggtctttgaggaatcgccatactgcttcccacaatggtggaactaaattacactcccacgaacagcatataagtgttcccttttctctacaacctcaccagcatctattattttttgactttttaataatagccattctgactggtgtgaaatggtatctcactgccgttttgatttgcatttctctaatgatcagtgatactgagcttttcttctgtatgttttttggccacatatatgtcttcttttgaaaagtgtctgttcacgtgctttgcccactttttaatggagttgtttttctcttgtaaatttttttaagttcctgtaaatgctaaatattaggcctttgtcagatgcatagtttgcaaaaatgttctcccattctgtaagttgtctgtttactctgttgatagcttcttttgctgtgcagaagctcttcaatttacttcaatcgtacttgtcaatttttgcttgtgttgcgattgtttttgatgtctttgtcatgaaatctttgtctgttattatgtccagagtgatattgcctaggttgtcttccagggtttttatagttttgggttttacatgcaaatctttaatccatcttgagttgatttttgtgtatggtgtaaggaagggatccagtttcaatcttctgcatatggctagccagttatcccagcaccatttatttaatagggaatctttttcccattgcttgtttttgtcagttctgtggaagatcagatggtcatagatgtgcagccttatttctaggctctctattctgttccattggtgtatatgcctgtttttgtaccagtaccatgctgttttggttagcgtagccttgtagtagagtttgaagtcaggtaatgtgatgcctccagctttgttctttttgcgtaagattttcttgactattcaggctctttttggctccatatgaattttaaaatagttttttctagttctgtgaagaatgtcgttggtagtttgataggaatagcattgaatctgtaaatagctttgggcagtatagccattttaatgatattgattcttccatccatgagcatgggatgtttttccatttgtttgtgtcttctctgatttctttgagctgtgttttataattctcattgcagagatgtttcacctccctggttagctgtattcctaggtattttattctttttgtagtaattttgactgggattgcctctctgatttgactctcagtttggctgttgttggtgtataggaatgctagtgatttttgtatattgattttgtatcctgcaactttggtgaagttgtttatcatctggagcagcttttaggccaagactgtggggttttctaaatatagaatcatgttgtctgtggacagagatagtttgacttcctctcttcctatttggatgccctctgtttctttctcttatctgattgctttgcctaggaccatcaacatacttttatgtgtaattatacatgtagtttggtgttttctcttttcttaaaaatgatattatgctgtacatatttttctgcaactttttccacttacactcttagattgtagttgtgtttagatttattctcatactttctaatgatgacttaagtatataccataccttatttaactattctcctatcagaggtcatttatatgttcagacgttttatattaataggtagttggatgtattgatcttttccctaatggctatgactttggtgtctttcttactaaaactttaggtcttctgtatgctgaaattgtatgaagatttcaaccatgtgttctgactttggtctttgcacttaaatcattagtaaatctgaaatttattctggtgtatataatgagatatatggttccacctcgccccaccccagcaaccaccatccaatagctaaatagcaccattttttgaataagttgtcttctccccaactgatttgaaatgtcaatttgtatcatacattgcattcataggtgttccatcctcttttctcctttgaactttgtccattcttctattcttgtagcaaaagcaagtctttttttttttttttttttactgtagtactatatgttttaataactgccgggaacacttccttttcagaaatttctaaggaactctatgttattttttccaaataaactttttatcttatcattttgaccattttaagtttacaattcagtggcattcagtacactgacattgttatgtaaccatcagtaccatccatctctagaatattataatcatcccacactgaatctctactcattaaacagtaactctccattcctccctatccccatcacctgatgataaccactatctactttttgtctcatgaatttgcctattctaggtaaatttatataattataataagtggagtccacttatatggcatcccactatttgtccttttgtgtgtggcttattttacttagcataatgtttttaaggttcatctagatctatcttgtgacatgaatcagaacttcattcctttttatggctgaataatagttcgttatatgtatatactatatttcatttattcattcatctgttgctagacacttgggttggtttgtttttaccttttggctattttgagtaatgctgttataaacataggtgtacacatatctgtttgagttcccgtattcagttcttttaggtatatacctgggagtagaattgctagatcataagggaattctatttttaatattttgaggaactggcatactgtattccacagtggctgcaccattttacattcccaccagcagtgggaacctttaacaaaggttccaatttttccacatctccaccaacacttattaaattgtttttttagtaatagccaagtgtcttagtctgttttgtatgtgataacagaataccacagactgagtaacttataatgaacagaaatttatttcttagagttctggaggctgagaagtctaatatcaaggcatgggcatctgtgagggccctcttgctttgtcataatatgatggaaggcatcacatggtggaaaggaaaagagacggtgagagagagagtaagagggacaaaaccatgccctaaataacaaacacacccctgcaataacgacattagtccattcatgaggacagagccataatgacccaaacacctcttaaaggcgccaccccaataacattacattgacaattaaatttcatcatgagttttgaaggggacattcaaaccatagaccgtcctaatagatatgaagtagatatgcatactagatatgcatttccctaaaaattagaaatgtgttgagaatcttttcatgtgcttattggtcatttgtatatcttctttagagaaacatctttttaagtcttttgcccattttcaagttgggttgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactaaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttcttaatttccttttcagattattcattgttagtgtatagaaatacaactgagttttgtatgttgattttgtaacctgccacttaactgaattcatttattagttctaagagatttttgcatgtgtgtgtatatgtgggatccttagggttttctaaataaaagatcatgtcatctgcaaacagagcgaattttatttcttcctttctaatttgaatttctttttcttacctaattgctctgattagaactttcagtcctatgtcagatagaagtggcaaacatggacaccctgtcttgttcctgatcttagggaaaaagccttcattcatttaacattgagtatgatgttagctgtgggtttttaatatatggcctttattatgttgaggaagtttccttccatttcaggtcaactctaaagcatttatttttattaatccctcttttttttttttttttttttttttttgagacagagtctcgctgtgttgccagactggagtgcagtggctgtgtctcggctcactgcaacctccgcctcccgggttcaagcgattctcctgcctcagcctcccaagtagctgggattacaggcacgcactaccacacccagctaatttttgttttttttttttttagtagagacggggtgtcaccatgttggccaggatggtctcgaactcctgacctcgtgatccgcctgcctcggcctcccaaagtgctgggattacaggcgtgagccactgtgcccggctaatccctctatcttttaattttaattagaatcacattggatttatagactaattttgagaaaatagtacagataaatttgcatgttgaaccacagaatgttgtcacagaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaaaaatctattacctttcatttcttagactagtttggtaatggttaatcattttatataatgcaccttaggcttgttttttagtatttgccttacctccaaaatctgtggtccaagtaaatctgttgccatcttaaactgttaaacacttgataactgtttatgagatgagaagagcagagttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtattgtttgtgaagactttgtaaataccatctgggcaatagaataatagaaatttatttatgactcactctacagatcacttttggaggaaaaaatacaaattaaatgtctaccaaaataagaaatgacagaatgactgttgaactaaaccaactctcatgggataatacttttcaaaaatcattttcctttactatagtgaattctaattactctaataactttaccgctaaataacctgatgtggtagctatagagaaaaacagtgaaaaatgaggttcccattaagagtttcacaagtggaacccttaacctggaaactggttagaagggttctatgatcaaaatgacctggatgccctagcagtcatgctaaaactatataaaaaatttttttttcctctgtagtcttgtattagtccattctcaatgctgttgtaaggaacagtctgagaccgggtaatttataaaggaaagagatttaactgactcagttctgcagggctgaggaggccccaggaaacttataatcatggaggaaggggaagcaaacacattcttcttcacatgatggcaggaaggagaagtatgagaaccaagtgaaggaggaagccgcttataaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatcttggaactgttttctttctcagatgtttgggtcattgctgtgattgttattgccataggtaagtatcacaaattttgacaccacttaagtcaaaaaattattgtgaagacatgcattttaaaaatagtttttcagtttctatagttttttcagcttgtaaattggttaaaccgatttaggaaaacctgactttttatttgatatacttaactacctaccttgtgttagtgattttatactctgttatattctgtatatctacttagtaacaaagcctaagtaatacatattttctcaagatgatcagtaatattagttggcttcccaaatgtgcttttgatagttttctaaattaagcaaggacttttctctgacttactatggactgtgtaagtgattatggggagttggatttagatagcaaagagtctggatggaatataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatcttttttttttttttaaaaaaatgcctgcattagtttgtcctaccaattgcatttctttgctaaaaatattttcagctacttctaacatcactgcaacataaaaacatctgtgcagagttcctacagctattatgactttaagaaaaatttcttttggatttgaggtttaagttatttagcaaatcatggaccactcactatgaggccttctctaccctattccctatttccaaaattgcactaatggccaaaattaaatttaaagtatttcactgtggagactttgacagttgtattcactggaatttttataatgaaagtttccacttgtctatatagcttagctagttgcaagaagctatgtaggcatatcatttaaatacccaatttggtgtcttttcatttaaagttgttatttatacatgttaaactgggggattcaaaacaacactatccgatttccctcttatgttctctgaatttaccagattgcagtaaaactgatagggttaaagttaaaattgctgagaggggttagatctataaggtacctcaattaactgtgtcttttaatatataaaaatgtaaaaagtgagtgggtttagaatagaagaaaaatgtacaagtacatatcttctaaagaaaatagggttttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaataattttaagacttttggtactcatggttttatgatatatattccttttatactgatcatcaggtttgggctaagtcataaaagtacaagctttactcataaggaactcaaacttttttcatattacttggttatcttttgaaatacccataatcccttcacttgaatcttaaatcttgtattaatggaacacgatatgcatatttgatttatctatcagttgtatattctaaaagttacatatctacaacgtgagtacaaaatattatcaatggaatatttttacaaatccataaggtttgcgtagaaacaagttctaaagaaaacaaaacaaagtcgcattctgcttattttccttctttgtttaaaatatcactgcatcagaatttttaaaggttcattaacaagtattaatcaaactctctctagctagcagttaatggtttttctgttgttgttttttgcttttttgtgatggagtcttgctctgtcacccaggctggagtgcaatggcgcaatcttggctcgctgcaaccttggcctcctgggttcaagggattctctgcctcagcctcacgagtagctgggattacagtcgtgcaccaccaccaccggctaatttgttgtacctgtactagagatggggtttcaccatgttggtcaggctggtcttgaactcctgacctcaggtaatccgcccacctcggcctcccaaggtgctaggattacaggcatgagccaccgcgcccggccttaatgggtcttttaaagctcaacagttatctgactgttacactcccaaatgaaaggttcaatagcagtagtgaactgagattccaaaattaatttgtccagtgatttttttttaaagcccatattttacagcatagggtccaactgacagttgccattattaaaattttaaaatattttgggaaggtatgatatctttagccaatgcaacataattaatcctgcaaatagtagcacaacttgaggaaaaatagtccagaaaatggtgtgagagacgaaactcctaattgcctttgaactttaaaatataaactgcgtgggaatcttttagaatagatgttaccctttttatgacaggaacatactcgattggaaattcagcatatgtaatggctgaatccaaagctaggctctctttatggatctattattttgtagttccatgttattttgatagctgaactgaatgtgagggtggtttatctttcttcttcagagtctagaggaatgtttctctgactttaatgtgcacattagtcacctggaaatctgttaaagtacagattctgattcattgggtttggggtggagcctgagaccctgcctgtctagtgagctcccagtgctgatgctgctgctgtgcctgggctacactgaccagggtgttgcccactactgatgtgcctatattgttgaagtctgaagaaacactatgaagcttattggcaaatttttctaatatttaagataattgaagtttttaagattcctcatccatgtgtatccttaaaaaaaggctatggggtaataaatagtacttggcttttcttaccttctttaactcttaaaaaacaaagatttccagccgggcctggtggctcacgcctgtaatcccagcactttgggaggccgaggcgggcagatcacgaggtcaggagatcaagaccatcctggctaacacggtgaaaccccgtctctactaaaaatacaaaaaaaaaaaaaaaaaaatagtggcgggcgcctgtagtcccagctactctgggaggctgaggcaggagaatggcgtgaaccccggaggcggagcttgcagtgagcgagattgcgccactgcactccagcctgggtgacggagtgagactccatctcaaaaacaaaaaacacaaaaaaaccccaaagatttccattattttctttgcactgtttaatgtccataatcttgtccccccagattggctgttgtggccttagaaacttcttataaagactataaaatgtctggaggcacttctccacttccgggggtaactggaagcaggctagcaggcacaaataatctcaaattgttgttaaagcctggcacaaaatgtatttcttgtaaactggtatttatggtgatttgggaacgtaattactcttctgcagccttcatctcaaaatacaaaaatagtgtaaggagtcattttaagatcatccaacatcatttacattacttgataaaaagtgggcaaaaggttaaagtattctgccacttttctgtttcatagctctcagctgagaacagtataggataccagtgggtccgaaacaggtcccatccacatgctccctccttttcccttcccatttcctttctttactaattcttctaccatactttttagtcttggaagccacagccctgtctttgctactgcttcagtcctgtattgcatggcatgactgtgcttctgaacaacagatgccttttgtttacataaatatttaagtaatggttttttttaaatgcatgattattttttaactctagttaagcatccctggataagtgacagtttggctaagttagtgaaagttatttacataatttatatatttattacctgtgacaaatagtttttccttttttccattaatggtatttattattttgtataacctaaactgacttttaatgttacattaatattgactgacccaattactttattaaaaatagtggtcagttcaggtaattggggcatatagtgacatggggcaaaaaaaggatcaaattaacttaaatgtttttctagttggcccttaaattcttgagcatttaacccttcaaaaatttttgagcaactacaaaaatgttttgtaattagtttagaaagcatccttacaaaattagatccatctcagaaatatgagacgccatgtaatacaaagttttgcaacgatgtctcctcaggttgaaaacagatgtgccacaggaagacacttcttaatgtaaaagtccagagacatctgaaaatacatgatgtcataaagttgatttctagataatattacatggatttgatacatactcaatgtattccctcaaaattgagggtgttaggccgggtttggtggctcacgcctgtaatcccagcaactttgtgaggccgaggcaggccgatggcttgagctcaggagtttgagatcagcctgggcaacatagtgagatgctgtgtcttgaaaaaaaaaaaaaaaaaaaaaaaaaaaatcaagagtgctagagaccggtaccatttctccccaacaatctgttattccttgaaaacattttgacatgaatcacttcatgcaaaatggcttcaaagataaacatattaaacaggaatttccagtctgtttatctgctggatgatctatatgacttcaaagttcaagtagcttctagcacaaaattcatgtttccagtccttcagtgagaatgagaaagtcttaagttatgaacctaattctcagctttcctgctactctcttacactggattttatcccacttgttatgctactcgtttctttttggtttgaagtcactattttattcagccgttttctcttcctctgttcagcacatacctaactgatgagacccacagagaagtaaaatttacttctctctgagaaggagagatgagagaaaggtttgcttttatcattaaaaggtatctgttttctgttgtttattttcagatgtcctttcttttgaaaaatattcagtggatatatagatatcaataacctgagcaaagagatattggcagtaaatatcaaagaggaaatttacattcctgttccctttgctaaattattgatgtgttcttataccattccctttgaaaacataatgtgtactgacaggctttgacgtaggctttaaatagagttatgttcccctagtccttttatcagacgatctcacttctaccttgtaaaacagctgtgaatccaaaagtaagaatttgtgagccaactgggaaataaccacagaatcaactcattttaagtgcaaggaggaaaaatgcccttttatagaaaccaaaatatattttacttagttttgtaaatttattcaattccaacgtataaataactctgtaaagacattttatcagtttccctgggctgggatatttttagcatatcaaaggaaaacaaaaaagtcctcagattttgaaaagtaatggattgcattgccttaaacccttggaccctgtccaccttctgtctttgaactgaactggaattattcctctgtttgtgctagaatgtgtgtccgcagagctgggaagagatggagatacatatcccacctcttataatgtgaggccctaacctaggttataattaaaagtttgggagcaggatctacaaaggccagctggaaggacaatttcttagtaaaagcaaagtgatgtctttggttacaggaggaaagggaaagacaaaacataccaaccagaattggcggtctgggcctacccagtcctatatacagtagttccttcttatccacgggggatacattccaaaacctctagtggttgcctgaaacctgggagagtactaaaccttatatatactgttttctcttaagcatgtatacctatgatcattcaatttataaattaggcacagtaggagattaacagcaataactaataactaataatatcaattataaaaatatgccagcatcactactcttgtgctctgaggccactaagtaaaataagggttacctaaccacaggtactgtgataccgtgacagtcaatctgataaccaagacagctattgagtaacaggcacatagtgtccacagcatgggtatgctggacgaagggatgatttatatcccgggagggatggagtgggacagtgtgagatttcatcatgatactcagaatggcacacaatctaaaacgtagttctgtaattttccatttaatatttttgaccgtatttgactatgggtaactgaaaccgtgcaaagtgaaaccgtggataagggaagcctactatatcttcttagtctcttaggacacttttgagactaaagccaactaggaaaatagtttttagactctctctgagcttcagggtatctgtaaacatttgaagataatttaatgaatgctgtagttaatattttgccatcttcaaaatagcttcattgttatatccaataaatgtttctttaaatttatgttaatgccttttatctttggcatagattggatttttatttaaaactttatttaaagaaagagattctactactatgggaaaaaaatatttacttagaaaaatatagtggtggccagtcctggtggctcacacctataatcccagcactttgggaggccgaggcgggcggatcacttaaggtttgagaccaggttggccaaaatggtgaaaccctgtttctactaaaaatacaaacattagctgggcatggtggtgcacacctgtaatcctagctactcaggaggctgaggcacaagaattgcttgaacctgggaggaggaggttgcaagtgagccaagatcacaccacactgcactccagcctgggtgacagagcaagactctgtctcaaaggaaaaaaaataaagaaaagaaaagaaaaatatagtggtcttggagaattcagtgacaggccaaaccattaagtctgtcatcacaacagtccttagggaactgcaatattataagtatagtaatgacgcagtagagaaccataatgatggcctccccggcaaagaagaaccaacccgtttacgcctgaggttgcaattttttgaatttttgcagtcagaccctggcgatgaccttgagcagtaggagataaattccacatgcttagcgttccagtaatggaacactaggcataaatgggttattaaagtatccagaattaacatgcttagctgtgacattggaaaggcaatgtgtttgctgtggcacacatactagtaaataatgactggtccgaatttggttttcgtttgtctattaaagtcaatttactaaggcagggagggcccagagctgtgctgtccagttcaatagccatgcgtgactgctaaggacttccaaagtggctagtccaatgtcaggtatgctgcaagtgtcaaacacacactggatttcaaagactaagccaaaaaaatgtaaaatacatctcaatattttggttatactcggttaaagaaaataaaattatttttgcctttttatgtttttaaaagtggcttctggaaaattttaaattacatgtatgactggcatcatctgtctttggccagcactagactagaataataggttttataaagatgtctattgttatactaaaagtgtgacgtaaactttagttatttaggagactcttagtggaatacatgattttcttgacagtgaggggtagatgaggcatcacatacttgaacagttagaaccactatctttttaaaggttctgtgccagagctacagctttaaaatggagggatcaggaaagcatgcgtttgtctccagtctttcccattggccctacatcaaaatgaggacatagttactaagtactttgtgtgctactgctctatttcttgttttggaggggatcaaaaatataagacagggataaaggaaggttttttttacagtgagaccagttgaacatttgaaattattttaaaagaataatttatttcccaggttggtggctcattactatatttttttaattgttcattttctgaataggcttctggaatttaatttctgtacttaattatatttatctttgacatgatctttataccttggtttgcaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 36928 - DNA, 42808 bp, Homo sapiens
ggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatgtcgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctttgccatcgcccaattccaccgctgccctcagcctggatttcccaccctgtccgcggggaaccacacccttcccttcgcgaggttgccagccctgttcacttcctatccttgggggagaaaccaccccgatgctgctgctttggcgttgaccaccctgcccgcccaattctcgctttgtgttactttctcgatgtattcctccgccgccgcctctgggtctgccatccccattcttcagcccagtatctctttattcacagggtgtaatattcttttaagtttccatccctgcttgaagagtttgtaaagcaactggagtgtagctgcacaagtacaaggcggttgcccttttagacacttcagtcgcgagcatttggtactgaaaatacgaaaacaaccaaattgtaggagtgtccttcagctgcctttccatattgaggcgatttgggcggaagggggtggggaattgggctgcgcttctgaggtttcccgcgaggttattttttggttgtttctcagttgagatgtgtggagggttttagctactgttcctggaagttgtgctgtaagtagtaggtgaatcgtcaatagtgtcttatccgtaattgtagggagtgggattaataattagtccgtgctcctctccccacgtctccaccgtgattttcaaaggtttaagattctgtactggattctgtactagcttgccctttttaatgtgttatttatttgagaaagctgtcgtttcaagtgttaaaatagcagataagcggcattgaaaagtgacaaagtaatgtgtgaaaacaaggagctaggaagttctagagacttagctaaaatgtaattttagtttctattaaagatataacctctcccagatgtggatgcaagtctcaatgctctttgtgttggtggtcagctgtgcattctgtcaggaaatttactttgctttcctcagtatccggaacgctcatcagctctgatgattggggagctgggctcaaatttgaactagtcaccttaaccttggtagaattaaataatttgtccatggtttcccatttcaaccagctagtgaagtgctacggtcgaattcccagtttaagtatttacagttgtgacaagcagttttttttttttttttttccctctctgggctttagctatatcctttaaagatctttatgtatctggattaagtcacttgcagcgaagtgcttttatttattcattatgttgcgctttatcaaatatattttagcgtccatcctccctccctcccaacgttttgaccattgcagttgcaggtaactgcctggcttatataggcttgtttgcaatgtcttaatcctttagtcaataccagagctgtttggaaaatgttagtgctaaaccaacgtgggtgggatttagccaatttagtctccttttgagtttgggatggtagaggagcagtgtaatcttgggtctttatttaaaatgtttgatgacccctttaactattttggctgttgtcaaatgacaaacatcttgtttatcagctgttttaaaaatagcactttgactttttggtttttcccttaggctcgtttctacttgtccttttaaagaattaaattctgaaatatacaaaaattgatataatttaaagaattaacacatctggtgtcctcactgaggttaagattgatagattgttaccagtactccacctcaacaaatccaacctgaaatatggcacaaaatattacgtttcccaatatgttattctgatattattaagtctttgtgaccttgcaaatcacacgtttaatattttgtttctgtatgttaactaaggtataaggaataatgttcagtgaatccttagatgctacctatgatttataatttaaaagtacaaagtatttttggtcataaaatgtaatctcatatggaagtaaatattcctttctagtttgggaaagaaagtattaatgggtgaattctaaaaatgccaattctgcacttgatgttaacttgaagatatacataacgtgcagaacactctagtgctttacatagtttcaagcatttccatttttaagttaaatataccatatttttacatttttttggtttacatttctaactttttgttttcccccctccttccctcaaatgttttgatgattctccagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacaggtaggagatgttggggtacctgctcgtgattgctgcctctgggtgctgagcttgaaaaatgatacttaaatatttgaacttgaaatttttccagtaccgggtttcaactgagccgccaacgcacatctgctctcttgcccacttgtgacatgcccagctgccagtttttctccttccttttgtggtggtggttatattatcagtatgactagggaccttttctagatttttctatctgggtctgctgctttctagactctgttcaggtaataaattattatcaatgtatatctgagcatccagtctccctttcatgagacctgtcagtttgagggactgaaatgctcagaaatgatggttatgtatgctgtggcaggagatgcatacctggagtttcattaagttgttatggtgtgttgcttttagttaatcagttgaattaatcaaaagggaagaatttgtgttcctgtccttttaataattgttattctggcatatttagacacttaaagatgtgcatcattaaatcttaaatggaaaatgagactcgtgcacatagctttccattttttatcttaatgatcatgatttccaatgtggtgggtttttttttttttttttttttttgagacggagtttcgctcttgttgcctaggctggagtgcagcggcgccatctcggctcactgcaactctgcctcctgggttcaagcgattcttctgcctcagcctcctgagtagctgggattacaggcatgtgccaccacgcccagctaatttttgtatttttagtagaaacggggtttctccatgttggtcaggctggtctcaaactcccgacctcaggtgatctgctcgcattggcttcccaaagtgctgggattacagacatcagccaccgcgcccggccaatgtggtagttttgtaacaagactctagttagaatttttttcttttttttgaggtggagttttgctcttgtcacccaggctggagtgcagtggcgcaatctcagctcactgcaacctccgcctcccgggttcaagcgattctcctgcctcagcctcctgagtagttgagattacaggcgcctgccatcatgcgtggctaaatttttgtatttttagtggagacggggtttcaccatattggccaggctggtctcgaacacctgacctcaggtgatcctcccgcctcagcctcccaaagtgctgggattacaggcgtgagccactgcgcccagccaataattttatttaataagaaaaagcttttcattttgaaatctagaatacctccacttttgaaaatctttgatttcccaaatttttcttgctatgcactagttaaaagataaggtattatataatgagcaatagcacagatctcaaactgtttgagttgcatatgggccataccttcttttctgtaacgtgcatacccatgcattaacacttgtcgccttttccagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgtgagtaaaattttaatggttactttcccttcctagaaacccagaaagaaacatagtgtgatatttcagacactaaagtaggttttcacatggaataaagtcaaaagtttagaaatgcgtatgtacttaaaatggtgaaattgcttttagctggtctgcgttatgctaaaatatttgttttatttagcaagttatattaaaaagcataaaaattcttattgcaagaaactacatcaattttaaaataacacgtataaagtacagagcacatgacttttttctgttgtgattaactttggataaattctgataagtgtttgcaagttaattgattttcaaggaatggtggataatgggtcttaatctgtaaaatctgtaatataaaatagtttgaaacaagatgccactatatggaatgatgtgaaaattaggctacaaaatttcttcctcaatatcctattctcttctctttcaatgtaattagaagtcatagaatttagatgatactacttatactgggcttttgattagtttaaaaattttttttgtctaagttgcagatgtgttctgggaacaagtaaggctcagctggcagaccttaaattcatactgtgtttaggatctccgaaagatacaaaaacataagactttccctcagaacttatgatgtagttagagaaagtagatgtaaacttaagaggtaaatgatagtggggttatagaaatctagaaaaagttcccaagttacattgtcaacattcagttttgtaaccaacctggaaatggctaatagtttattttagctaccgtttactgaaagtctgtgtggtcagacactctactgacagctttaaatgattggtcttagttaatcctcacaataattcttcaaaatagatgatattatttctgatttttatcaattaaaaaaaaaccatggactcagggttatgtggctttcatggggacaaagctagtaatgaagtattaatagatattaaaacctgagtctgaatatcctcaaagcaaatgttgaagtgaaaagaaataaaagtgggatgatgtgcccagagggcactcacccatcaaagcagcccttgagcacagttaaaaaaccattgatcatattttgctgtcccttattttttggttaggaaactgaaactaaatttagtagtttgttcaaagatccgaagtcacttctcatgatgatatctattaacaatttttgtagttaattttgagagtttaaacgtgtcctttttagaaaatccattgctttaaaaaacatttttttttaagagatggagtcttgctatgttgcccaggctgtactcatactcctgggctcaagcagtcctcctgcctcagcctccagagtagctgggactataggtgtgtgccaccacacccagcttctaaatttattggtttttgaatggatacagtgaatacctccagttagcactcttggaggtagcaaatgaaactaatttcttgtctatcttttctgagacactcagtgtatatatatgtacatttgagtgactttttgtaagttttattgcaatactaatctagctagttacccacataaagttttagggagcctggtatgtactgccactgggccttggaccccatttttcccagggctcagggctcacctctgtacccagttgtcacagtaagttctttacctttattaatcaggttgattctactcttattgatagtgtaccctcttacacagctgtggttcttgccatctttaactctaatgcccttggctcaggtttccagttgcctatgtgtgtagcagagcagtcattgctactgatagtgtacccaagcagtaggactatgctgagaaggaaaactaaagtgagagatggaaccttgctatttaatatctaacctgctgttagcaggaagcttattgttgtaccctaccaaggaagtgagatagtactaaaataaatcatgggattacctcttgaatgcattgaatggccatgtgttgtcatctggttctatgtttcttctagtggaaggtgctgctttacttatttattactgtttttaccaataagaatgaaaatgggattgtgcaagttcccttgatttcaactaaacatgccatagtgatcatattttaatttatttcaggatatctaaagtcttaactagatttaaacttactgtcaaatgcccgttgtcagttcagtactggtagaaccttgcgtctgttccttatgttcttgttgacagtgcttaaatgcatcattagtacattgtgtacctgaatcatagatgtagttggcattctatgaaaaatggttaaagaaactcaggttattttggttttgcagcagtgaaagagtagaatgttaaggtggtatctttggtaaccttggtaactgttttcaacagtgtttatctttttaagttaatagatatgtcaatttagaagttgttctctgtgacttgattatagaaattatctttgagacagctatctcatttttttcattctgaattatcttctataattataatgttgggtgttttcataattttggtaagattttagtctgtcattttttttttttttttggagacggagttttgcccttgtcacccaggctggagtgcagtggcgcgatctcggctcactgcaacctctgcctcctgggttcaaacgattcttctgcctcagcctccgaagtagctgggatcacaggtgcccaccaccatgcctggctaattttttgtatttttacaaaaacaggctttcaccatgttggccaggcttgtcttgaactcctggcctcaacagatccgcctgcttcagcctcccaaagtgctgggattacaggcgtgaaccactgtgcctggcagtctgttgtatttgaaggtgttattgcagatagcaccttgcagtgacagcacatgttctttgacatggtgactcactagagttgcctatacctggcaattccttttgcaaattatgtataaaattgtcctttctgtaacggctataaccctgagttgttttaaacaggtctgtttctgaatctataggttgttgaattgttgcttgtgctttgattgtggatgcacagaatggagagctgctggcatcctggccatcatgtgtgttcctgtcatgttatttgttacttgttactgctgagcctctcttatacagctgcactgtagaaaaccatatatttcgattcttctctgttctgctttctgttgtatatttcgattcttctctgttctgctttttgttaaggttgctgtgcaaatgtcacatttaaatatgtgagtgcttattgtgcatacaatgctttgttaggaaatggggagatgtgttgtgggggaagttgcgggttataatataagacaggacctgacccgtaaaggaaaaaatggtgtaagttccttggatgataattgttggagagtattaatcagaagatttcctcgagtgggtgcttatgacctaagcattctgtaggaaggtaaatagcaagtagacttccttggctgaagtggtgagtcaagtagtaacaagaagtgaatgtagtagaggagagtcaattggaagatttataaagaatagagaggctgaggagtttgaatttaatttgagaggcaattgagaattactgtaggtttttatcgacctgattttacttcatatgtatgtacgtgtctagatgttgtggctggtgggggtgggaggctctaggaggaaaggcaggaaactgatgcaatcttaggagaaatagttctacaggaaaatcttgctcatttctatctccttttattctcacgattttcccttgtatacagtgccctcctcctttgtctattaaaaccctactcatccttcaaggcccagcttaaacttctcttatgagctcatcatctagttctcttaaaattctttactactgagtgggcatttagtgtgtgccttgtcttttcacatagattgtaagccccttgatgataaggattctatatcttttccctatagttccaggcatgttattgaattgagtaacagtttgcctgaaatgtattaacctgggatggataaaatgggctagttttgagaaatataattgtcaaaaacattttgatttgacagatgaagcagaagtgatgtcttgggttttgaacttttgggagaatggtggtgcccgtgcgttttctagaaattagctgttcatgcacataggtttggatccccaaacaggagaattggatttcaccgttacatttaatatgatgttttagcttttcctaaaactgccttattgattatcttatagtaatcttgaagataatgtatttttaactatgagcattgtgttaacttgatatagtatactgtaatggatctagatgataacaaaatatagatatgctgtcaggacttaagtggcatccatccaagagttcatagaaactagagggtaataaaattacgcaacagctggctactatgtatggccattacagtcattgttggagaattattgcaagacttctgattattatgacttagaaaaggcataggaattggtaaaagtccaaacatgtataaccacaattatcaagtagtagaaggagcttgtatgcatggattggattatgcagtcatggtctgccaaaacaggggtaaccctttcagtttagaaaaaaacataaccatacaaagtagatagcaagattatataattcattacttctgagagtatagtgttaaaaagtgctcaggctaattagaggagaagtcaaataagattaatggtacctttgatgttttgaggattagtattagccttttgtgcttgaagtgatgggagacaaccttactctctagaacatcagtcattgcttgaaggacagtattgagtcagggagatgatggaactgacccagtatggctgaccgtaagattgttgtgtggcagcctgtactttgttggcagactttttggttcacctgatggatgatactatacaaccacaaaagctgtttatcagtagaattaagtgattttggaaaccataatatagttccagagcaaatcatatatatgatgatttttcggcacagttgacaaaatttcactttctaggacttaagtctctttcacccatggaacagtttggaataataagcatacttcctgttgtcattgtttctgcctgttgactggtagatgtgactgacaatggcaaaatagggcaaataaaaatttaagctcactgttgtgatgagtgtctcatccagatgaatggactgatgagtcagatgactagcagcacaattgagctgctaataaaaagcagagtcaactgcttttcattattcacccactcaactctaatggcacttaatactaatgagtaatctagtggcaggtgccaggattgaggctttggttggataattcttctgcccgatagtgaaatgaagtcagagtttctaaatatgcctgacagcctaagggtaggtttgctcataggtagtcatttgctaaatatgtttttttccactctggaaaattttcggtccttgatacagaagtgattcatcataaccttgaataacatagttggacaaatatttgagatgtgtgtgtgtgtgtgtgtgtgtgtgtgtgtgtatatatatatatatatatatatatatttccttttttttttgagacaagagtctctgtcgcccaggctggagtgcagtggcacgatctcggctaactgcagtcactgcctcctgggttcaaccgattctcctgcttaagcctcccaaatagctgggattacaggcacacgccaccatgcccagctaatttcatatttttagtagagatggggtttcgccatgttggccaggttgatctcgaactcctgacctcaggtgatcctcccacctcgccctcccaaagtgtggggattacaggcatgagccaccacgcccggcctgatatatatatttttaatgtgactgacatttggggaggagagaaagaagctctagtaaggtcccatagtattttatgtgaagctaatggggccaaatgcatttcaacattcagaatttttaggatattagaaagataataccatatataaaacacccagaaaagtctggagcagcaccttttagtaaaacacatttatatttctgcagcaaaagacagtattcatactaagtgagataattaaattctataaatagtttcatgtcacctcaagtcaggtttaaccctcaaatgagtttttggaactttttgggatttggaattgtggatgaggggttgtggtcctgcactgaagtttgtcaggcagtatctttagttgatagaataaaatggcagggagctagatgcttaaaagtgatttcaagatatttttaattgacaaagcagagtataattaatgacagcgtctctgggtttctaggatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgcacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactcctttttttttcagccatacctcttaacacctcatagaacacactttgggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggttagtcattaaattaataattggtatttttgaagtgcttacgcatgtagtgtttttactagaactaaataataggtcttagccagtgacattatatctttgtttctctggcggtataggcagtatgtgacttacagagaacaatgatttgacttaaatattttttcaacttgacaatggtgcaaaagacatacatattcaatagaaatcatacttcgagtacccatgcagccattctggttttccctttcagtacaagattcagtaaattacatgagatgcccaacacactattataaaataagaaggaggctgaggcaggaggatcacttgagcccaggagtttgaggctgcagtgagctgtgaccatgccactgtacttagcctgagtgacagagtgagaccctgtctctaagattaaaaaataaaaaggtaccataaagacacatgcatgcgtatgttcatcacttcacaatagcaaagacatggaatcaacctagatgcccatcaacggtgggctaaagaaaatgtacatatatgccatggaataccatgtagccatcaaaaatgaaatcatgtcctttgcagcaacatggatgcagctggagtttattatcttaagtgaattaatgcaggaacagaaaaccaaatattgcatgttctcacaagtgggagctaagcattgggtacacatggacacaaaggggaacaatagacagtggggcttacttgagggtggagggtgggaggagtgtgagggtacaaaaactacttaccaggtactatgttcactacctgagtgacaaaatcatttgtataccaaattgctgtgacacaatttacccatttaacaaacctgcatgtgtaccccaaacctaaaataaatgttggaattaaaataaaactcatattaaagttttaaaaaagggctttgtattaggtaattttacctaaacgtaggctaatgtgttctgagcatgtttaaaatgagactagccgggccaggtgtgatagctcacatctgtgatcccagtgctttgggaggccgaggcgggcagattgcttgagcttaggagttgaaaaccagcctggacaacataacgagaccctgtctctacaaaaatgagctgggtgtggcagtgtgctcctgtagtcccagccatttgtagggctgaggtgggaggattgcttgggcctgggagctggaggttgcagtgaaccaagattgcaccactgcactccagcctgggtgacaaagtgaggccctgtctcaaaaaaaaaaaaaaaaaaaaaaaaaaaattaggctaagctaggatgttcactaagtgttacagatgcattttgacttaagatattttcaacttatgatgggtgtatcgggacataaccccatcctaagttgagaaacatctttattgcagcatttgctggatagtacatggtatggcagtttccaattttgtgttgaaaatgtactttaggctgcgtgctgtggctcacacctgtaatccagcactttgcgaggctgaggtgggaggattgcttgagcctagtagtttgagaccagcctgggcaacatagtaagaccctgtctctacaaaaaatacaaaaagtagctatgcgtggtgacacacacacagctactggggaggctgagatgggagtttgagtctgcagtgagctgtgatcatgcaactgcactccagcctgggtgatggtgtgagaccctgtctcaaaaaaaatgtactttagtaattaaaaatgatttttataaatgggctttaaagaagcagggcttcttggtgaaaaggcagattccaggtctggggcaggaatttaaaaaaaatttttggaatgtcttgtcataccagaaagcaaggaagctttgacatattactttgcatcaaaaggactcaggaagcaacttgaggaggctcccactggctaaagatgcagacttgagcatcaataggaataataactgaaatatactaaaacttatcaagtatgtttaaatctatgagcttataattatgctaaaaaattcattggtcatctttggaagacttacaaggaacaattaatttggaaaactggttaaaaagagaagaataaagtttttgaggaacctctatactagttcccaaaatggctgtgccaatttatacttcccccatcagttacaaggcttccctttctttacatcctcactaacacttgttattattcgtccttttgatgatagctatactaacaagtgtgagatgctaactcatggttttattttgcatttccttgatgattagtgatgttgagcatattttttatatatctgcttgccatttgttttttttgttttgttttgttttgtttttttgagatgaggtcctgctctgttgcccaggctggagtgcagtggcgccataatagctcactgcaacctcgaactcctgggctcaagtgatcctcccaccttggtctccccaagtgataggattacagacatgagccactgtgtctggcctgtacctcttcttttgagaaatgtctgtttagatcctttgcccgtattttaatgggcgtatttgctactgagttgagcttcttaaccctttatcagttgtatagtttgcaaatgctttctcctaatccggggttgcctattcactctgtgtaattgtttcctttactgtgcagaagctttttagtttgatgcaatctcattgcatatttttgcttttgttatctgtgctttatgctaagtgaaataaaccaggcacagaaagtagatactgtattatgtcacctatttgtggaatctaaaaaagttgatttcatagaaacagagagtagaagggtggtgaggcttgggggggtggaggagggatggggaaaagggagatattgatcaaagtttcagttagactggaggaataagttttagtgatctgtagtactgcatggtgaccacagttgttaataatgtatatttcaaaattgcaaaaagaataggtttttaatgtcctcaaccacaaaaaaataagttagtgaggtgatggctatgttaattagcttggttgactctttctaaaatgtatacgtggatcaaaccatcacattgtatgccataaatatacacaattatatatcaactttaaatttaaaaattaaaagaataaagcatatgtcttccctctcctgtatgaactagaccatagagtaacccaatagttgatgggggaagcttttctttataaaagcattctagctaataagtgaagaaggaatgatagaatatcaccattaatagtgaaagcatttattaggccgggcttggtggctcacgcctgtaatcccagcacttcgggaggccatggcaggtggatcacctgaggtcaggagttcgagaccagcctggccaacatggcaaaaccccatctctactaaaaatacaaaaattagccaggcatggtagcaggagcctgtaatcccagctactcaggaggcggaggcaggagaatctcttgaacctgggaggtggaggttgcagtgagctgagattgcaccattgcattccagcctgggcgacagagcaagactccatctcaaaaaataaaaaaaaagttaaagcatttatcagtgacaaaaacgagatacaatcaggtattaagtaccttgtggtaaacaatttcaccagtgaagtagtcttgcacaaagagaaaagaacacaaacctaattaagcttctggttctacctaccaatttacaggagatatacacgggacaggaaacatgttaaaggacaccatagggatgcagtcagcaaaattcaaactttgggaagctgaccttcttacttcaacaaattgtaataaaaatggagatttaaattaaacttttaggccgggtgcggtagctcacccctgtaatctcagcactttgggaggctgaggcgagtggatcacttgaggtcaggagttcgagaccagcctggccaacatggtgcaaccccatctctactcaaaatacaaaagaaaaaaaaaacagctgggtgcggtgcggtggcgtgtgcctgtaatcccagctacttaggaggctgaggcaggagaattgcctgaacccgggaggaggaggaggttgcggtgagccaagatcgtgccactgcactccagcctgggcgacagagtgagtgacactccgtctccaaaaataaataatgagtgacactccgtctccaaaaataaataaataaacacacaaacttttaaaggattaaaagaaactcagagaggcacattgacaaattatatctgtcttatttggatcctgactcagttaatgagaaattggagcactgaatggatttttttttttttttttttgagacagggtctcacttgatcgcccaggctgaagtgcagtggtgtgatcttggctcactgcaaccttcacctcccaggctcaagggattcacttgcctcagcctccggagtaggtgggactacaggcgtgcgccatcatgcccggctagctttttgtatttttagtggagacagggctttgccatgttcccaggtcttgaactcctgagctcaggcagtctgcctgcctcggcctctcaaagtgctaggattacaggcatgagccaccacgcccagctgatatttaatatgaaggaattgctgtcttttttttttttttttctgttaggtatgataatggtattgtggttaggttgggaggaaaaagcattcttgtgttgtccctgagatacatattgaagtatttttgaatggaatatgtctgggctttgcttcaaaatgatctgcgaagagggggagtaagttggagtatagattaaataagatcaaacatgatatatgaattgttgaaaatggataatggagacttggacgtaatgttcctctgcttttgtatatgtttaaacatttctattataaagtttaaaagttcttggggtggacatctatcactatagacaatctaaattaaatgcatcatgccgtgtttactacagagttgtcatctaagtgaagatgaagtgttctttctttatttttttttgagacagagtctcgctctgtcgcccaggctggagtgcagtggcacgatctcagctcactgcagcttccgcctcccaggttcaagcaattctcctgcctcggcctcctgagtagctgggattacaggcgtgagccaccatgcccggctaattttttgtattttttagtagagacggggtttcgccatgttggccagggtggtcttgaactccgggcctcaagtgatctgcccgccttggcctcccaaagtgctgggattacaggcatgagccaccgcgcccagcagatgaagtgttctttatcagtctttaataaacatacaattactcagtgtcttaatcaaataccttttcggtgtgtgtgtttttttttgtttttgttttttgtttttggagacacagtcttgctctgttgcccaggctggagtgcagtggcgcaatcttggctcactgtaacctctgcctctcgggttcaagccattctcatgcctcagcctctcgagtagctgggactacagttgcacatcaccatgcccaggtaatttttgtatttttagtagagatggggtttcaccatgttggccaggctggtcttgaactcctgacctcaagtggtccgacctcggcctcccaaagtactgggattacatgtgtgagccactgcacctggccggtgttttgattgaagtttgcatttaccatgctgtaggagtatctttcttgatcagtgtttctcttccttggttatacatgaggagcttataaaagatctgaatatcctgaccctatcttcagagggtctgatttaactggcctgtgatagagcctcggtaccttttctaggaggtaaattcttaatatattgccaaggttgagaatcactgctctagacaacatgacagctatttggatgacaccgtgtaatggttagtatttccttgaagtattgtatcttactgtgtatacagctctaattgcatgtcttaataaggtcttgctgagcatgtagtttgtatgcatacaactgaggtatatatttaccttttcagtaagagtttgctgcctcttttgccactatttttcagaagagttagactggttaattgtgaataaaatagggccaatcattagaagtgttcagtttaatgaaattggagcaggcccaatatttaatttttctcttcaggacccattttgctcatgagaacatgaggcatgagaagttattttgataatgttgaggtttgtaaaaataatgagaagacactaaataaataattggtttattaaaatgaaatgtaattgaaagtctgcaaggaccttggagtaaaaaaattgtaattgggaagttgatctggtgaaatcctaacttgctctgagtaactaactgtcttgaaatttttaggctgtcacccttgacccaaactttctggatgcttatatcaatttaggaaatgtcttgaaagaggcacgcatttttgacaggtgagagaatgttctgtttaataaattttcttgaatctttgttgtattgacacttgacagtttggaccgaaatgatgacaatagtccattgaagcatatttgccttttctagcacgttgttctctgcccatgtcctgtgttgccttttatttatagatgttgttcgttgcctgactttttgttgttggctttcctcaaagccgttatccttctcattgggagtttagttgaaatttttttattgttaaaatggttgaaatgattctttcttagactaaattattcctttgacctgattttagaaagcaaagtaaatccagacttttaaattttttgttgttgtcaaaggaaagcctattttttatgtgggagtagaaaacttcccagtgtaaagacacattttataaaggtgtgattttggtttgaggttaaaatataatacagcatgaattatgtaattaattacaattacttgatatattttgatatagtacagcttgaatgagttgtaacaaaccatccattaagcatgagttacattttgtgtgtgtgtgtgtgtgtgtgtgtgtgtgtgtgtgtgtgtgtgtttatttacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgtaaggatttttactcattctatttgttatctggtaggattaagagtcttttctggccaggtgtggtggctcacacttgtaatgccagcacttcgggaggccgagatcagaggattgcttgagcttagggtttcgagaccagcctaggcaacatgacgaaaccctgtctctacaagaaatacaaaaattagccgggcatggtggcacacacctgtagtcccagctccttgggaggccgaggtgggaggatcgattgagtcctgggaggttgaggctgcagtgggccatgattgtgccacagcactccagcctgggcaacagagcacgagactctgtctcaaaaaaatcacaaaaaccaaaaaacagcaaaaaaggaaagtcttttgtacaagtattgagatggtatattggtttactttagagttttggttgagggtaagaataccaaaaaatatcaattttctgtagcattaccagccattaggcttaattaaacaattattagaacagtatcagtggaggctttatgattctgtacagtttttgaagactttgttttgttttctaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtatgtgagggtggtgtagctgggcatttagcatgatagtagagggaaagcagttaagtttaccatcatccacctcttttgtaaaaatagtggttgaatcatttacaagaggattattcattgaagtaacaattgagtacctaaggtatgatgtgaggccctatgtgacattccagaaaatccctgcattcagagttcattattctgtggataagatctgtacaaaaaaattaaacattaacccacagttcaagagaagttacttataagtatataatcttagtgcctgatggctgtatggtagtggttagtagatgtggtaggagtttagcagagagagatttcagtggtgttggagtggtcaggataaactaagaggagaagaggtgtacctcattatgtttgaaacaagaagaggtataaaatagaggaagaggtagaatttgagaatgaatagacttggaaaaagtagagacaaatttaggggtttaaatgtacttgagcaaagttcttaaggttgtggtgaattattactgctgctttagcaatttttttaacctcagttctgatcttgactctttataggtcttcccagagtttgctgctgcccattcaaatttagcaagtgtactgcagcagcagggaaaactgcaggaagctctgatgcattataaggaggctattcggtaagagacactaacagccttatttttaaaattatttttaattttaaaatgtttgacattcggcacattgcagatgctaaaatggctttaaataacaacggaataagttagcattacagtgggttaaagatttttgtattggagaaataaaacctttggcttctcttttagaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggtactactgtttattataatatgtgcagtttaacacctaaaatttaacttttggaaattttttaccatcctgctttatttattttccaggattcagggaatattccagaagccatagcttcttaccgcacggctctgaaacttaagcctgattttcctgatgcttattgtaacttggctcattgcctgcaggtaaagaataacaggccagtaattggctctcagtgttgtaatagctttttaattgttgtatgccataagaatccaagcctgactggaaatagtatttttaataggctatctgacattactttaggccaaagacatatcaaatattaaatcctgggataggactttctggataataacttgtttttgctttctctagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataaggtgtgattcttttgttttaatctttttgttgtaaactaaaacacaaatacagaaaactgtaaaaatcaaatctgtggcttaatgaacgattataaagtgaacaccacccaagtcgagaaataaaacttttgtgggccacttcagaaccccttccattgtgtcctgagtataaccccctgcacttcataagacggaatccttaactccttcacttaaacactaatgatagactgatggtacttttctttaagttgaaagccataatttttttttcttttatcttttttttcttttttttttgagacggggtcttgctctgtcgcccaggctggagtgcagcggtgtgatcatggcttactgcagccttgacctccccgagcttaggtgatcctcccacctcagcctcctgagtagctgggactacaggcgcatgccaccacacctaattttgtgttttttgtagagatggggttttgctatgttgcccaagctggtcttgaacctctgggctcaagtgatctgcccacctcgcccggccaaagtgctgggattacgggtgtgagccaccgcgcctggccagccatcatgtttaatggagtgcttggtattttgtattcacctttgagaattagagcagtacttgatcaaggattggatcaaaggttggataatagattggagtgctaggtgtactttttttttttttttgagacatagtgtctctgtcatccagactgcagtgcagtggtgccatctcagctcattgcaacctctgtctcccaggttaaagtgatgctcgtgccttagcttcccgaggagctaggattacaggcgtgtgccaccacgcctggctaatttttgtatttttagtagagatagggctttgccatgctaggctggtctcgaaatcctgacctcaggtgatccacctgcctcagcctcccaaagtgctgggattacaggcatgagccactgcccccagccataattttgtttttagaaaatgtttccctatagaattttctaaaatgcgggaggaaaccatgctctgtccatactgcttcatacctacaagtgttagatttgctcgtacttttttttttttttttttttttttttgagacagggtcttgctctgttgcccaggctggagtgcagtggcacaaccttggcttactgcaacctccacctcccaggtttgggcgattctcccacctcagcctcccaggtagctgggactacaagcatgtgccaccacgcccagctaattttttttttttttttttttttagtagagattggatttcactgtgttggccaggctggtctcgaactcctgacctcaagcgatccacctccttggcttcccagagcgctgggatttgctcatgctttatagatctcaggagcaggtcaaagtatgaagcatattacataaagtgctgaggttgcatctctctggcaatattaactaaatgctctgggcagacctttttcaacaggtgtgaggtataggtttggtgtgtttttcgtcagttttcctagatgaaaatttatgtagattttactaacaagcattggattctgttgatagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtaagactagtgtttctctagaatcactatttgtttaaaaaagaaaaaacccacaatgttggcttgtcaccatgaggcatggaaacctagtgtcttttggaaagatttgagccagaaagatttgagccaatgttattaaatatgccatgtgctgcctttcaggtgttctgttatgccctgagcccagacgatggcacaaacttccgagtgaaggtgatggcagaagccaatcatttcattgatctttctcaggtagatgaaactctcatactttaactttttattttgagcaagtttaaataaaactattagcatatagtttatttttgatgataagtattaaatgctgtagtaccacatataggcaattgtgttgatcttatttccttgatcatttgtgttaatcagcatggctttttccgaggttgcaaatgaaactgaaatgtgttatgcttgtgcttggacatacaacttttctggagattgagccagcacttgtgacagaagatacttaataaatattgacaaaatggtgacttgggagaagaataaataggtcttttaaagaaaatagggccgggtgtggtgactcatgcctgtaatcccagcactttgggaggtcgaggcgggcagatcatgaggtcaggagatgagaccatcttgactaacatggtgaaaccccgtctctactaaaatacaaaaaattagctgggtgtggtggtgcattcctgtaatccccgctacttgggaggctgaggcaggggaatcgcttgaacccgggaggcggaggttgcagtaagctgagatcgcaccactgcactccagcctggcaagagcaagactctgtctcaaaaaaaaaaaaaaaaaaagaaaaaatagatgaactatggttcatcagtttccatgggcctttgcctttggttatctttatttctgtacttgttctattgttgtatcctctaggagagtaagttttatgataaattaagattgaaacctatgggggaattaatttgctgagtatgtaggctacagtgttttctttgtagactctattagccactttgactaatagagataatatactctttatatgtgtgtgtacacacatgtatgtatgtacatacacatgcaggtatgatatgtatgcatatatgtataaatatacatgtgtatgtgtatatatatatgaatcactgaagtcctagcagaaaggttttgagacttctcatttaataaatagtatgtactaacaaattttgcagtatagctgttgcttcaaaagtatacctggccatttttgatacacagttggactctttgtgaccaagaagcatacctctttctacctctgagacctttagggactcactgctgattgattgcagtctaaactcttcagcatagcttttgtaacctttctctgtttgccacaactttgtcaatactttaactcaccattcaacatcttgtataccctatactaaatagaagtgaattactcaccctttttttttttgagatggagttttgctcttgtcgcccagggtggaatgcagtggcacgatctcggctcactgcaatctttgcctcccaggttcaagcgattctcttgcctcagcctcccgagtagctgggattacaggcgcctgccaccacacccggctaatttttgtatttttagtagagacggggtctcaccacattggccaggctggtctcgaactcctgacctcaggtgatccacctgcctcggcctcccaaagggctgggattacagatgtgagccaccatgcccggcctactcaccattttctaaactccctcacactttactctagttcttcattcatactgttctctactgagattgtattctgttaaactccttcaaactcctattcgtctttgaagacctattttcaaataccaattctaggctgggtgctgtggctcacgtgtataatcctttgggaggctgaggtggaaggattgcttgagaccatcatgggcaacatagtgagaccccatccctaccaaaaaaaaaaaaaagattacaaatttcaaataccaatttctctgtgatatgttgttattcatacattcaatccagaagtgaactctccttcctttgtgttctgtttctttaatgctttgggcccattttaatgacagtcaaccatatttgtgcccgaattaatgtagttaatttgtgttcttacctcttttccatctgggaatctgaattatgttaaatgccattaaaactaaatgccattaaaactaaatgtcattaaaactaattgatctgagattatacatagtgagttcttattttgtattctgtagattccatgcaatggaaaagcagctgatcgcatccatcaggatggaattcatatccttgtaaatatgaatggctatactaagggcgctcgaaatgagctttttgctctcaggccagctcctattcaggtaaacaaattaacagtcatcacttataacatgtatttggctaagaatacagtgaggtgctgcttttcctccctctggttaactgatatttgaaactgtagggcagacatacttttaatttttttaagttgttgaaatgcacaggacaaaaagagtgtagagcacagtgcttataggtacatgtatatagagacatgcaattcatggttggctatgaacagttactctgtcttgcaaatttgaagaacattttagcattttgaaagttagtctgaaatacaggccgggtatggtggctcacgcctgtaatcccagcactttgggatgcttaggcaggaggatctcttgaaaccaggagtttgagtcctgcctgggcaacaaagcaaaacaccctatctctacaaaaaattaaaaaattagccagagtggtggtgtgcctctgtgatcccagctatttgggaggctaaggtggaaggattgcttaagcttaggagtttgaggctgcagtgaactatcactatgccactgcactccagcccaggtgacagagtaagagtctctcttatagaactgcttcattgctttcggctaaagaagtcagccttgctgtgcgtgtggcaagtgcctgtaatcctggctactctggaggctgaggcagaaggattgcttgagcccaggagtttgaggctgtagtgatctacgattgcaccactgtattccagcctagggaacagagtgagatcctgtctctaaaaaagagttagacctccttgtttatttacttatttaattttggcacctttaggttctttttttaaaaaccactttattgaggtacagttgacatacaaaaagttgtacatatttaatgtatgtgacttgatgaatttagaggtaagtgtactgataaaagttcttaatcagtttttgatctgatttttttaaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaaggtaggtatgaaacagtgctatggacgaatttcaaagaactgtagctttttatttccttgctattgtctatgtaaatcctaaaagacatgtctgaaactattttttccattagaaaaaagcagtcatcgattttaagtccaatgggcacatttatgacaatcggatagttctgaatggcatcgacctcaaagcatttcttgatagtctaccagatgtgaaaattgtcaaggtcagaacctagtcagtattgtcattgaaataaagttaactgcattcacgatcttttccctaatgatgcatttttttttcagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcaggtgagaagataataatacaccattatatgtcccgccaagtatgcatttatttcccttaacctcatgataactctaggaggcaagtatcattatcaccatttttatggatgaggaaatgagtttagtggaaacgtgcatcttatataggtgtgtctgattttaaaagtctcctggattcagccagcagattattacttactgagaaactgctgtgttaatatcttgttattccctgcctgtggctttactctcttacatgatgaactatgtgtagattccatacagtttcttgcttctgtaaacccatcctttccctagctaaatcctactcaaacgttcagttcagacagctcttccaggaatccatttccgtacttaccgctaacgtctccatccctacttcattggtacctgtcttttatacctctgtaatgtttggaatatatcattacatacagcacaacagatgataattccctgtgtttgtatcctctactgaattgaattactgagcccatgtcttaatcacagtaatgtagtatgtactcaataaataatatattgcatgcttaaataagtagctctatcaagagagtgtaaggcaaagatctctgacctctagaggtcatagatgtccttgcacacctggaatagttatataacaatgtaaggcagtactcaaatgtgtgagaattacaagatgaaactaattatgtatgtagaagctcagaaacggtgaggatcaatgtgaagagagacactcttgggagaagagaccatttggaggagtaatttagccttgaagagtagatgtgatttagaaaaggacatttcattcatgaagaaaagagtgatcaaaagctgttggaacgttaataggattttgagaccttttttggttagagcaagaagtttcatagtgcagtctcccccaacttaagataatgctgcaacggtttgccttttcttaaacttcatatatcatgaatattttctcatggttcagtgacttttaatggttataccattttggatcttatggattgaaatattggactccttttgcctttaaatataaccatcatttttttcttgttctagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacgtgagtatgcaagtatgttagagactaataaagattttgtatctagagcttcttgctgaagatggtccttccactcccatttaggagctgttctgctcatttctttttaaaatttttttttggctgggtgcagtggctcacgcctgtaatcccagcactttgggaggctgatgcgggtggatcacctgaggtcaggagcttgagaccagcctgaccaacattgcaaaaccccgtctctattaaaaataccaaaaaattagccggacatggtggtaggcacctgtaatcccagctactcgggaggctgagacaggagaatcacttgaacccgggaggtggaggttgcagtgagccaagatcgtgccattgcactccagactgggcaacaagagcaaacctccatctcaaaaaaattttttttaaaaatactttttaaaaaatttattttatttatttacatgtgactcaactgggttatgccctttttttaaaaaacagaatctcactctgttgttcgggctgcagtgtagtggtgtgatcttggctcatggcaacctttgcatcccaggttcgagttattcttgtgcctcagccttccaagtagctgggattacaggcatgtgccaccatgtctgggtaatttttttttgtatttttagtagacggggtttcaccatgttggctaggctggcctccaactcctggcctcaagagatctgcccgccttggcctcccaaaatgctaggatgacatgtgtgagccaccgcacctggccttgtgctcatttataatcttcaagagatgtagatttttcaggcatttttggtttctccttccagtgtctaaatatgacattgtgaaccttttaaatttacatattcaaagcattcttctgtctaaagggtcagcaaactttttcttaaagggccagatggtaaatattttcagttttgtggtccatgctgtttcacgtctactcagctttgccgttgtagcacgaaaataaccataggcattttgtaaatgatgagtgtggctgtgttccaataaaattttatttatacgaactggcagtatgccagatttggctcacaggctgtgtagttcgccaactcctggtctaaactgatagcatatgctgtcatgtacatccacccatttttaacattcttgtagtattgtagagttataaccaagaaggagtcgatctgtacatatgattatctctcagttcatcagacaagtttgcataagtgggatatcggatagctataactggctcttaatccatagaactaaaataaaatggcatgttttacctttaggtaatctggagataattccttggttaattttttccccgatatctgttttgttttatgtttagaggagaggggaggatagaagagaagaggaagcagatgagtacaggtctactgtccttaatccttacttcctgatgttcacaaaaactctgaaaatcaaaagctttttcataagtgtgtggcaaatttgtttggcagcaaaactacctgaactaacattagggtatatattagtccgttttcatgctgctataaaggactgcccgagactgggtaatttataaaggaaagaggtttaattgactcacagttccgcgtggctatggaggcctcaggaaacttagagttacggcggaaaagggagcaaacatgtccttcttcgcgtgatggcaggaagaagggctgagccaaagcggggaaagccccttataaagccatccgatcttgtgagaactcactctctatcacaagaacagcagcattggaaataactgtccatgattcaattacctaccactgggtccctcccatgacacatggggcttatgggaactgcagttcaagaagagagatttgggtgggggacacagtcaaactatgtcagggtatttgtagtcttttatttatttcatttagtatgactgttcctgcatctcaatgcagaggtactaatatgtttataggaagttgctgctgagggtgttaatgtgatacatacacacacagtactacttttttaaaatctgaaatattctgaatttggaaattcatctgttctcatagctttcagagaaagggattttgaacttacatggtacatagagtagatgtaaatctaaatcaggagttggcaaactatgacctgtgggtcaaatccagcccactgcttgtttttgtaaataaaacttaatggacacatagctatgcctacttgtttacacattgtctgtggctgctttcaagctacagcagaagaactgagcagctatgacagtccatgtggccacagaaccaaaaatatttgctatctggccctttacagaaaagaccgatttatattaggcaaagaaagttaggcaagtgtgaggtaactttcttggttgtatcatagtgggggatttgaaatttggaatgcaaaattcctctctcagcaaaacccactgcctgtgtcaattcccgcaggaggtagctgcctcagattttgcctgtctttctttgaactcactttgaggacagctaagcagaagagggataattcaattgatctcattcatctctgtgaaggaaagacttaagtccacagcaggcttctatctggatggaaagaatagagtgtggtagaattattagagacctctgggagtctttgttgaaaaaggcagatctgctattaataattattcttattttccctattttagattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggtaagttgctgataaatcactggaatcttccttgttcctttgaaaatctccgtttgggggagaaacttccaggtgaaattatatgtactaggagcaacattaaaggaaaggtgatagaaagtgagacttgttctcacttcattctcttcatctgcgttgtgtggaggcttaacataaataacattaactctgtgctgttttacgttctcagatgtgcagttgttatcttttgtattacaggagagactcttgcttctcgagttgcagcatcccagctcacttgcttaggttgtcttgagcttattgctaaaaacagacaagaatatgaagacatagctgtgaagctgggaactgatctagaatagtaagtaaacttttccttgaacaaattatttggtaaagtagagagaatatagctgttataaaatgaaaccataaaataagtgtaatataaaataggtgaactagttgtatgccctctggatgggagaagtacttctaaactcttagaaatgaagtgatcaataggttttactatgtaaaaagtaaatggctgaataaaaaatattcaagaaaattaaaaagcaaacgaggggaaaaaatcttttgtctcagataacaaagtattaattacctggcaatgtaaagactgcagaacatttaaattttataatcccctaataggaaagtaaaaatggaaatgaccagacacctcactgaagtggaaatacaaaaggttaacaagaaagtgtttcaggctctgtagtagaaatgccaattaaaatggaattgaggctgggtgtggtggcttatgcctgtaatctcagcactttgggaggcttaggcgggcggatcacttgagatcaggagttcgagaccagcctggccaacatggtgaaaccctgtttctactaaaaatacaaaaattagttgggtgtggtggcatgtgcctgtagtcccagctactcaggaggctgaggcaggagaatcgcttgaacccgggaggcagaggttgcagtgagccgagatcgcaccattgcactccagcctgggtgacatagtgagactctatctcaaaaacaaaaacaaaaacaaaaacaaacaaacaaaaaaaaaaccaaacaaacaaaaaaaaccaaaaaaagaacctgaggtatatccattatttgcctatacaataaaaagattttttgtatcagtgaggtagcattgaggactagcctttttatgcattggtgaataaattggtacagcccttcctcagagtttttagagccttaaaagttagatctttgggccaggtgcggtggctcacgcctgtaatcccagcactttgggagggcgaggtgggcggatcacgaggtcaggagatggagaccatcctggctaacacggtgaaacccccctctactaaaaatacaaaaaattagccaggcatggtggcgggcgtctgtagtcccagctacttgggaggctgaggcaggagaatggcatgagcccaggagacggagcttgcagtgagctgagattgcgtcactgcactccagcctgggcaacagagcgagactctgtctcaaaagaaaaagttagatctttgaccctaatactgtcacttcttcactacggtcggtgtaagaaataaacaaagcataacttaaatgcctgaaaatgagtaggaattagaggggtgatgcttagatgaggaggatttatccatacaataaactagtatttctttcattcttttattttttttgagataggattttactctgttgcctaggttggaatgcagtggggtgatcttggctcactgcagcctccacgtcctgggctcaggtgatcctcccacctcagccacctgagtagcagggaccataggactataggtacatgccaccatgtcccatgcctggctaatttttaaatttttttgtagagattaagtttcaatatgttgcccaggctggatatttcttttttcttttccttttttttttctggacggagtctcgctctgtcgcccaggctggagtgcagtggcgcgatctcggctcactgcaacctccacctcccgggttcaagcaattctcctgcttcagcctcccgagtagctgggactacaggtgcacgccaccacgcccggctaatttttgtatttttagtagagacggggtttcaccatgttggccaggctggtcttgaactcctgacctcgtgatccacccaccttggcctcccaaagtgctgcgattacaggagtgagccactgtgcctggcgttttttttttttttttttttttttttggagacagcctcgcactgttgcccgggctgaagtgcaatggcacgatctcggctcactgcaacctctgcctcccgggttcaagcgattctcctgcctcagcctcctgagtagctgggattacaggcatccaccaccacatccagctaatttttgtatttttagtggaggctggatttcactatgctggccaggctggtctcgaactcctgacctcgtgatccacccaccttggcctcccaaagtgctgggattacaggcataagccaccgtgcctgacgggtatttcttaaatgaggtttttctttcggtataatgggtgatgttttttctttgtgtttttctgagaagtagcatattacataataattaaagaaacatactttttgagtcagactacctgagtgaacccaagctctcctacttatgagttttgagactttgggcaaataaatctctgtgttgtgccttggtttcttcttctgcaaaatggagcataatgctagtgcctactttgcagagatgatgtgaggattaaaaaaggcattccatgtaaagtacttagaatagttgttggtatctggtaaacattcagcagatgttagctacttattattttcagaatttcctccatagaacatcacatacgtctaagaaaagtgagaaatttgaacccaggcattaaaaaaaaaataagattcatgtccattagcccagagataactatagtaaaaaatgtagtgcgttttattttcagacagggtctcactctgttaactcaggctggagtgcagtggcatgatcacggctcactgcaacctctgcctcctgggatcgagtgatcctcccaccttagccttccagtagctgggactacaggcacatgccaccatgcctggcttttttttttttttaatttaatattttgtggagacagggtctcaccaatattgcccaggctggtaactcctgggcccaagcagtccacccacctcggcctcccaaagtggcgggattacaggcgcgtgagacactgcacccagcctgtggtgcattttaaaatttttattagactctttggtacttagtttggttcatacaatgcttttcctcaacatttttgttctcaaaatttttaattttataataaacacatctatacctactgcttagaatctaccattagcattttactattcttgctttattacatatctattcatccatttattccctttattcatctgccaatccatcttattggacacattttgaaataaattgcagacatcagtacacttctccttaaatacttaagattggctgtcattaactggagttcagtacacatatatttttttgaggtagggtctccctctgtttcccaggctggagtacagtgatacgatctccgctcactgcaacttccgcctcccgggctcaagcagtcttcccctcaaactcctgaatagctggaaatacaagcatgagccaccacacctagctaatttttgtatttttagtagaggcagggttttggcaggttgcccaggctggtctcaaactcctgacctcaagtgatccacctgccttggcctcctgaagtgttgggattacaggcgtgagccactgcgcctggccatttttttcttttgaggcggaagttatatacagtgaaatacacaaatattcagtgagttttgagaaataacccttttttttttcgttttgaaacggagtcttgctctgtcgcccaagttggagtgcagtggtgtgatcttggctcactgcagcctctgcctcctgggttcaagcgattctcctgcctcagcctcttgagtagctgggactacaggcacgtaccaccacacccggctaatttttcatatttttagtagagatggggtttcaccgtgttagccaggatggtcttgatctcctgaccttgtgatccacctgcctcggcctcccaaagtgctgggattacaggtgtgagccacagtgcccaaccgagaaatacctttgtaacccaaattcctatgaagacaaaaaacattatcactccagagagtttcttcatgctccttatcagtcagtctttttcaccaacccccagagacaaccactgttctggagggtttttttcccttccataaattagttttgcttttctagaattttatccaaatggaactatgtcaatatgcactctaaaggcttctttcatcaagtttatttcttttgctgagtagtatttcactgtatgaatgcactacagtttattttcctattggcatagaattttaaaaaaatagagtgcacaggtctttctctttggagggtagcattaatatggacatggttgtattgagaccaacagatatgcacaaccattttactgcttctgtcacaacaaacattaaaacaaagttgggcgtggtggcgcatgcctataatcccggcgctttaagaggctgagggaggaggattgcttgagcccaggagttcgagaccagcctggacaacatggcgagaccccatctctacaaaaaatacaaaaatagctgagtgtggtgatgcgtgcctgtagtctcagcttcccgggaggctggggcaggaggattgcttgagctaaggaggttcagtctgcagtgagccatcatcgttccattgcactccagcctgggcaacagagtgagactctatttcaaaaattaaaagaaaataaataaaaattattgcttttaaaaatgcacagaaatgttctggcttctggttctaaagtatttatcccttcatctaagaataatctcatgaaaaatatattcaaaagggaagtagaaatcttttcccctgtgtttcctgaagaatcaattacttcttttttatttttctgaacagaaccatactcttggtgatattagcaatttttaaaaatctgaactcagttcaggtacaagtggaaaattacgagagtagacttattgtatttcttttccccttgagtggttttctgtttcatcaaaatgaccataaatcgaatacttcatcttatgtttatgctttaacttttgtaaatgatgcttcaatgaatatctttgcatggtcctgtatgtttttgcatctgattatttctttttaatagattttaaagtgttactgttaggccagagggttatgaacatttaaggttaatacatacttgctaaattgcttaccaaaaaggtaagcaacagtacataggaatagtcatgtgccgttgtcaattcttgttattttaaaggtagaaacaagacgaaatggagaacgcgtggtatcccttggatatacttgtttaggaaagaactaagttttttcagagtatatggagttgagctcatttcagtgttagcattatgcaagatgtgacccttccctttttagcacgaagccaatcaagaaatgagatagcgtagagtttggtcatgcattttttgccacaaatgcgactaggtatttatagggtgtgtttctgagtttctgctctgatttgtaaactgggttcttgttttttattacccagcctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttcccttt

SEQ ID NO: 36929 - DNA, 3734 bp, Homo sapiens
aaaccatcgagacggagggccagagagtcacggcggtgagagggctgagtgacgggttaccccaaaccatgtggctggaggcgcgagctggggtgtgggcgaggttcaggagggggttcctgggtgtcgcggaggggccggggacgggagagctttgtctgtggccttccatgcataggtgttttggaattctggatcccagttctgaggctcagccgaggtcactgctgtcagctcacctccctgcatgccaggcgcagggcaaagtggccggggttcggggttggaggagaggtgtactagaaacaactttgctcttgtccctcaggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggtaggtgggcgccgtattgtagagagccttgagtaccaggctgagtttatacccaattcaggggtctgctgggagccagccattgaaggtgctggagcagagagagatatggtattggagctgatccctatgatgaaagatctggacccttgtgtagatgttccgtgaagcaggaggtgaagacctattaaaatgccatttcaagaactacgattttaaagacagtttaggtgggaggtaataaaggtctaaacaagacgttaaatattggggacgtaagggggaggatatttgaaggacattactcataacaagacatagggttactgacaagtcaacggacgcttctcccttgctgactgcagccaatggacccctttttatcatagctggtcccagggaccacaaaaatcctgtccatccattaccctgatgtgaagcctgtttatatagctctttttggtttaaggcatctccagacatggtcctctggtaggaaacaggtatgagtagactaatgaaggacaaaatgggatgagggacctggagcctccacccttgcattccaataccacccttaccccacaaaaggagggtattgacccacacagtaatgctgacctgtggccagggctggggaggtccaatttctaatctgtgctttgtcccatctccactgttccccacccctaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtaaggtggggagctagggagggctgtgagagtagaaaagaatgatgggagctgggtttgacccattcactcactcagttttgatcgttcttattcaggtatcgggggaaatggattcgggtagaacgaagtcgagagatgcagatgatagacttgcagacggggactccttgggaatctgtcaccttcacggccctgggcactgaccgaaaggttttcttcaacatcctggaggaaggtgtgggatggcacaggcaggctttctagggacattgcagggatggggacatttgacatcagatgagcagtttggagaagtggaataagcaggccggggtgagcccatgggaacagggggccagaaggaagctgtttggcacagctccacctaattgaagaatcagccatggtgaagagaattattggctttatctcatcttctccttcccagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggtgagaagcagctggggtcttggctgtgctgtttttgacatttttagaagggacaggttggtctccagccagatggggtgatataaagctctagtccaattcccagagattaagaggaatgaaaagttgtgtatgagaatgatttatttccgtaccaaggttatcaggcttccagggggcagggctgggaatgaacgtagatatccggggcaaaagacatgatcatcctggctctatccctaggcattccttacagacgtggctacctgctttatgggccccctggttgcggaaagagcagttttatgtgagtattcaaaatttctctcaacttggcaaaacgaagcctttgtggaaacactaggctgatagggttggaaggggaaatgaatctggggatcggggaccaggataaacatgaaacgtgtggaacatcagggtgtgaggtagaagtcaggcctctgagacacatgtccccaggcggtgaggagagtagctgggcctgaggaagcatttccaggttgcctgctacctcctgccatcccatgctccatagcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagagtaagtgaggggttctggaggaagtggagtgggtaactgtggaacaggggaagaaagcagaaatccagagggctggtggaagatgcctgggttagtgacaagagcccacaagacacatggataagtaggggaacatagtggggcatgctaattttatgctgggctatgactactcatgcttccttatctttgccttcctccagacccagtaaagtaccaaggcctaggtcgcctcaccttcagtggactgctcaatgccttggatggtgtggcttccaccgaggcccgcatcgtgttcatgaccaccaaccacgttgacaggtaggaaggagccaggcatcctgagacttaggcaagagcccacctcctcccctagtgccttgggaggaacaggaggtcgaggggccatctctgttgggtgctagtgtgacctgctttccctgtcttctctcaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacact

SEQ ID NO: 36930 - DNA, 31673 bp, Homo sapiens
gagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaaggtgggctcggaaacccctctcctttcgccgcggtcctcgggtgctccccgaaccccggcacccgcggtgcatctcctgtctccccgcctgctttctgggcgccaaaatcgggcggagcggtggatcggcgagcggcgggacggggtgggtggggactgcgagcgagtgggtaggggtggggggagcggcagacgcgacggtgctgggatcccgggagggagcggagcggacctgggcttggtcgcctccaagccggcgggaccgagtgctttaggccgcttgaaagaaagttgctccggtaagggacggagcgggaagagggaggtgtgtgtctcgcgggtgggggcggtggaagctccggcacctcctctcaccccgggccccaccggcttgggcttggcgtggcgaccccccatcactccccaatcgctggcttggtcgttccccctttgtccccgccatccggcggaggggacgggagggggtggtttcccggcttcctcccaccaccaccaccacccctccaagacaaaagtcagctcctcctctcctcgcaaatggactttccagctgtgattcagttctcccctctgggtgggcgggtggctggggtcgggacggccgagggacggcttacttcccccaaaccatcacctctaggtgaagggagcagaggtctttgtgtagctgggctcctttcctccatcctgagcccttctgcctggaacatagggcctccatccctatctgccccgccagcctcctagctcttccttctcccaacctgaaacccttaggctgacacacctggcactatgcattgtgttccctgcccttcctcctcctcccccagcgctctcattctcttatctgctcgtcttggggtcccttcacctagcatttcatgagtctgggtgtataattatccacacgcctcccccatcatgacctcttggccactcctctccaagtaccctttatccctgcctttgtacccagccccattcccaagtgccctgacctttccacacccagaccccaggaaatgatgaagctgacttgcaggtgaataagtcagagctgaaaggaaggtggtgcctgcagacagcacctcccagctcctttggggcccccgcactgtacccattatcagaaaggacaggtcccagcccagagttggtttaatctctggcttctctccaacctgagtgccctactaccctggtgccagcctatgctgatcaccaacttcagccaagggagcagtaccccttaggagtccttaagggtgatggaaagccctcccctccacctccctggtagttcctagccaggctacctgtcttgatgctaaactgggagagacagaggttccatcctgggttgggggtggagggccagggaaagcagctttaaaaggactttccttagggggttgggattagattttgctatctggaaagcaactggggattcgagtagggcctaagacaaacagagggccggggtgaggtggctgaagtgtggtggaacagtggggtggcagacaggctcttcacagcctgcgccagcccaggccccagctccaaaagtctgtttattttttcaaccgtttgagctgagaccctggagtagagccaaggggggcgggggaggttttttgaaaccgcagaaatttggttccaccctaaaaaggaaagccatgggggagctggttgggggaagacctggctagggggtatagagagcggttctgtgggggcaggtagctactgggatcccttttccattattgtggggagctgggacgtcagacatctgggtgttcatgctctgtttttgtttttgtttttggtggtggggggactggctcttctttctactatgggggctggctgtgtggggcaggtaatttgggaatctggctggcagcagggagtcgggggctgagtgggtggatctgagagggcaaagaggccaccggagaagggtggttgtcagtttgggccggtcggaaggggagggccacctccggaaaactgtggttacagaagggggagttggttcttagccaacaaaccctggatcccctctccccctccccccagcacaccagctgtctcctttctttttatactgtggtgggaagtagaggggcacccgctggaaaagacattatttgaagaagatggtgtcccctgctacctccttggggggatgggtcacagctaagccctgacacctcagcccctccccattccttgcctcattccctgggagctcctcctaggaggaggaatgtaagtttaacctgcccctttctctgtcccatcctcacaggatctctctgtgtagccccctccatgcttcctttttcttttcactccatttctgttctcccaggctgtcttcagtcctccacctcctctgttctctctgctctacttcctacctccacaagccccaaacctcacaggtcccctttctctctttagtcccctgttcttccctttctcctttcccaaaccccaaccatcatatcccttagaacaaagggtccttttctgccaagcagggaccagaggtccagggatggctgtggaggctgggggtccccttggaatctctgtggtgggcaggtggagtggggagtgtgcagagcgactatttctttgttctgaggaatggagaggtggctggctttgtgtgcaggactaggagtgcagtggagaggagagctgggggagcccaggagggagctgagagggctgacggtgttggaggagagtggaagaatggggggtcctcctggtggctgaggcttctggggacatagacaaaaattctaggggtcgtggaggttagggagagagttgagggggaggggagaagtgaggataggggaagggagtctaaagcttagggaagtcactgagtgacttgcaggaggttagatggggcctagagaaggacctactgaggccgaccagaggagttacagtggggtctgatcttagccactctggctgtggaatttgaccttggaatcaaggaggggacagatgtgaatgtgtgcatcccctgtgtgcatgttactggtgtgctggtgtgtcagtgtgtctgtctgcctgcctgccctcctattctgtacccagatgctctgggctactgttttgaacagtggtcagcaaagtagggggttcgtgctctctggccacgaggaagtagcttcatccttagcttcagtttctggttggaaatatcatctaggagctgagtgagcggattggttaggatttctgaagctggtaagagaaaaggctgagaggagctggctggacccttccgggtttgtttatgtctctttgggagagggtgggggtggggttgcaggcagcagctgcccccctcccaacccagccggcctgccttgtgccaggagggcagggagtcctggcacagctattgttcacttgcacaaatgcctgtctgtttgcatcgcttaccccccctctctttctgcttgtctctctctcctggcctgacaggtgtggccgcgtagggggcaggctgggttccaggatgcttgggtctcagggtccctaacctgatttattccttgtggcccttagcaatcctcttccgtttcacccgtacccactcccattgccagtgtctcatcttcattcactaagcaagcatttattaagtgcctttgtgtgtgcagtgatgtctttctgtgttgtttctggctttggcattagtgtttccacttggctgccttcccctctgcctcctgtcttcatcttgtccctggaagctcataaaggagcagggcccggctgagaccaccccaagccctcttctcagtcccacccccagcaatccctcacctcttcatttcccagccctatagctcctcctccaggactcagtgcccttcatagccaacggcgcctctgctgtacaggggctgagccacaggtgactcgaatcctggtggaatgctccacaggctctccggtcactattacagagggtgtggacagaggtgtcaccatcttggggaaggggctgctgccaggtacagctggaggagaggtgattctgagtactctgtgactctcccagaagtcttgatttggacatacctgagagagaagcaaaggcagctgagagagctgggcacagtggctcgcacctgtaatcctagcattttggaagaccaaggcagctggatcgcatgagctcaggaatttgagacaagcctgggcaacatagtgagacctcatctctacaaaaacattaagtttttaaaatctattattaaaaaaaaaaaagtcagatgagagcttagggcttgcttggagaagctctacctcgcctgggtggatctgcctggccttgctgcctgctgggagcccaggaagccaaagtcctagccttggcattgccttcccctccatgtacgtcactgtttcctcatcccttattctgggagacaaagtggagagaagaggggagactgtgtttgcctttgagcttttcagtagagatccacaatgccctctgccattgctcccatctttctttcttttttcttttctttttttttttttgagacagagtctcgctctgtcacccaggctggagtgcagtggcatgatcttggctcactgcaacctccacctcctgcgttcaagcaattctcctgcctcagcctcctgagtagttgggattacaggtgcccaccaccatacccggccaatttttgtatttttagtagagatggggttttgccatgttggccaggctggtctcaaactcctgatctcaagtgatctgcccgcctcggcctctcaaagtgttaggattataggcatgagccactgcgctcggcctggccctgtctttctttcccaaaagtgactgagatctgggatgacagtggaaggaagtttggggttggtcttctgacttccagaggaaaccctcagggtctaaactcaaaggaaataggagagaatggcttagagcccttcaggaggagggagaaaagagaaacaagaagagacagaaggttctaaagctctgataaggaaggaagagggtttccagaataggggccagggtgctactgagaccccatgtcttggtgtccatacatccttccttgcttctttgcttccttccttttctttcattttgagacatgtattgggtgcctattgtataccaggtattgtgctaagggctttcatattctttatttatccttgatgtagcagtagtgtggatgaaggtgtgtagcaagaagaacttcccatgggatttgtgagaaagagacagaatgactctaggtctgagcgtggtggctcacacctataattctagcactttggggaggctggggcaggaggatcacttgatcctaggagttcgagaccagcctgggcaacatagcaagacgctgtctctacaaaaaaaatttaaaaattaggtgagcatcatgatgcatgcctgtggtcccagctatttggagggctgaggtggaaggatcacttgagcccgggaggtcaaggctgcggtgagccatgatcatgccaatgtactccagtccaggcaacagagtgagaccctgtctcaaaaaaaaaaagaaaaaaaaaagtatctagatgctggagagcaaaggactgaaccaagcaggaagggcctctgagcactggggtgggtgttatggattgtggagtaatgggccctttttcttggtgcataggttgggtcttggaggtaaagggctgtcctacttgggcgtgggtaaatgggagaccaatgtgattatcttaagaatacctggaaaagagtaggacaaagaaccaaacaagcccactcactccacctctggagcaggcacccctggtaagcaggccctatgtccttccatcctcagaagcctgagccctggggcgggcacaggcaacctccgggacaatagcactaggcagtgccagggtcgcttgctgctgggcagtgcccatgctgggatgtgctgctgctgtggctgctgcccgctgctggcccacctagagcaggggtcacttcgagagagggtgagtgttgggaggtggaggaggcagggcccagagtaccagggctgtctgtggagcattgatgccagagagaggaagggccactagagaccctgttctctggctgccccagtcttctccctccctttgccactccatctgagctggtcagacagatgagtgtttgtggatgccacagggggagggtggagggcaaaggacagaggtcaggtgtggaagagagtactcgtagcagcactggggcagagctgcagcactgcccattctggagtgaccctggtccagccatgttgttttttttaatactattttcagcttgcttgcttttacttatgtgtgtatatatatatatgtatatattttttttttttatagagatgggtctcgctgtgttgctcaggttgttctcaaactcctggcctcaagcgatcctcccacctcagccccgcaaagtgctgggattacaggtgtgagccacctcaccggcctcttgcttttaattcaaatgtaatacatgctcaaacttttggtttgagttatatagaaggctgggagggcaggagaggaggagaaaagggagagtatatggcagtgggaagagatttttggacttggtgtttgaggtcctgtgaggttattattcaaaggtgaatttgaacttctttttttttttttgagacatagtctcactctgtggcccaggctggagtgcagtggcccaatctcaacccaccacaacctccaacctccccggttcaagcaattctcctgcctcagcctcccaagtagctgggattacaggtgcctgccactacgcccagctaattttttgtatttttagtagagatggggtttcaccatgttggtcaggctggtctcgaactcctgacctcaggtaatccacccgcctcgacctcccaaagtgctgggattgcaggtgtgagccactgcacccagcctgaatttgaacttctaaagaggtataatttggtgcaagataggtggaggttagaccaaagggagcattttctagtggtccgggtaggtaggtgccagaatagaaaaaaggaggccagaacattttagaggtttgagttagaggctagaggcagctcagcttcctgaataagcctaggtagaggagcagttggcctgcgtgaggaggaggggaggagaggctgtgggcgggagaggagaacagtggcggagaagcaaggctgagaaagggaaggcagagcgggaggagcctaggagggagaccctgagaagagaagggaggacatagagagagcaggagacaggaggaggatgcgaaaaatggatgattggggatggggaggatgcatgaggggagaagggattgaccccaagacctctgggctctggacatcatcaggcaaacctggagcttgggaagagaggcaggaaagagaaggatcttgggcccaggcactgcagccccatgccctctgtccctgcactgttgactcagcccctccacacttcccctttctttctaccattttctgccccaagcaccaggcccgtgcatctcttcccctcctccacctctcagctgctggcgtggcctcgtggcctcggctgagtcagtactggtctcctagagtccgggctgagtgcttcccgctgaactgtaatcctctgtccccagtccaggtcctctgacttggggcttctaccctcagccatctggatcctgatttttgatttctgagagcctgggaaaccttggagggagtggtcttctcagcttctagtcctgctccaagagcggagggaaaatccagagatcagagtcacaactaaggaaggtcctagaatagtgggaagagtgatatccccctcttctcaccttctcaggctttttgggaatcacaggggcttgaagagggacagattggaggtcagggagaatgacttgacttgcagaggcaggggcactgggggaaatgggagacagcagagatggaaaatgcggctcagaggctccgaggaaggtgtgcgccatctgcggagatcaacactgaaggatggagggtagatgtcagaaaggacttcctaggatgggagagaccagttgggtaaggagcaatagaggaaactctcctaggttttaactctggaaagtagtatgagagggataaaagttagactgcaggagagattttccgctggaagcaaccaagatggctggctgagcttccttacttaaagatcccagagtggaagagtgacccaaaggcagctagctgcctttgcctcaaggttagtaggggacatgctgcctcccagacaggccctgtgtgccgtggctgagggttggtgaaaagagttagaggtctgggatcctgacccctgggttgggggtggcaggggaggcattctgcccccttcagccaatctaataaggggatctcctgccccccccactgtgactgccacagagacagcagatccaacactggttgtcatggttataagaggagctaactcccatagattggaaagcgctggtgagctggcaccctccgcttcgcctgctctcccctcctctctgcgcatcttccccctagcacagagaagagagtacagcagctcgggggtgagcagagctagggctgggaaggtggagtgaggacgcagagacctagagccagggagatgagtggcaacaggaggcagcccagccgtaggggccaggtaggtcagggacccagaacccatccgggctggctgccccagagcctggcctggtcactcccggacagctgcctctgacacccagttgcaggctctgctttaggaactggtgtctttccagcatcctcaggctggcattttttccttgcctctgcccccagcctgtctctctggactccaggcaccctggcattttccagcctcacttcctctccctctcatcccttccacagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaagtaagttgtttggaccctgagagtcacccagactcggtgcccactgaccctgatcttttcatctgttttttctgcctggatccatgagggtcactcttctctctgatccccagctgggcccaaatgccagggccagttgcttgatcccttgctccctgtcctcactctgaggggtggtggctgttggaatatggcataagccggactatctgggaatgtgggggaggggaggctgtgctggctcctcttgcagctgtcatccaccaggcaccccccttgctccccgaacagctgctaagggttaggggaactgattggagaaggagcaggaatgttgtatgtgtggagggggtggggtggggggtgacagaggaactgggtggaaagctgccagccttgcagctggctctgcctgtcttcctgcgcagagctgggcattcaggacttcacagtccccttgcccctttctttctattgactatgggtggagcctgaaatctctgctgtttcaagcagaagatgtgattaggacccttcatctcaaatttctagtgagaaagagggaatgtagcagggatgtgtgtgttgaggggcaggggttagaattcctgcccttcatccacatctgagtgtagtcctgtctttagggagtataagccaggaattctttccttccccagtacacagagggctcctgctgccccctctccctcaattcctcctgaagttatggcagagatgcctctgattagagcaggattgaaggtattgtgacctgctactgaatagcggacaaaagctctagcctgtaaatccctatgaaacttggggaaggaacccccagaaaggaccagtgatgggcaacccgctcgggtccccttctacgctgtgggagctttgtcattttgctcttcacaataaagcttgctaccgctcaaaaaaaaaaaaaaaaagaaagaaaagaaaaccagtgaagcctccctactttcctcactgttcaatttagagttgtgaggatgaggagggaaccccaatctagatccctatagagacctgacaaaattcccaatccggaagcttgttgccaggggaacaggggaggcgggcagcactattttgagagcaggtggaaagcggaggttcaatccagagacactgagtgttgggggtaggagaagggagctccaggggggtgggggcagctgcaacccccacttctgtctgccccctctgctccaccctgtttgccttgtatttgtggaagtgagcgtggtgctgggtattgtctgaaagagttagcagagtttccggtgttgttggatgggggaggggaagctggagagggccgggagctgagggcatgtctgggaagggcacggccagggtcccagtgcctaggctcagcgaatcctcctttcttcttctctcctaccccatggcaaggtggggtggaggatggcggagaagcagatggagtgtgggagctgtggatttgcctgagttgggggaacaggactccctgggcctggaagggagaaggccaggcttggtggggagttgcctgtcccttctttaccactggagccatcaatcagccttggagctgctgaggcccagccagagtccagggcatgtggtgcgagggaaggagcacggcctttggattcaggcccaccggagtgtaaacaccacctctcccactagccgtgtgacctctgatggacgatttagccactccaggacaggttcctcatacatgaaatgaggataactgaacctccctctacgggtggttaggattaagtaaatgtggaacatttactattataaaagctcagggaatgtaaatttcccctctgcccctagcccccattctggctgcctctgtgccatcttctgttctgtgggagtcctctcttccatctgccattcgcaaccaccttcgtgcttcttgagctcatctctggcagccagtgacccctgctcccctctggtccgcccttcaggccaccttggggtcaggattgcccatcccacttgattgtttaatttcattcagcacctatacccccctcacttcatttcctgcttgaaggaagagggaggtgggaggagagggactggggtgtggtaatggcccagaagtcggggaaggggggagagtccccgaggactgtgtggccaggaggagatgggtgtctgcatgtgggtgtgtcccctcctgtaccacccggccctcccttcaccctctctaccccaccctcccagcctgcaatgtgactatccacaaccgctgtaaagacaccctcgccaactgtaccaaggtcaagcagaaggtgagacggcagggagggcagagggctgggggagagggtagtgagtgtgcggtaccctcatgccttttccattcattccctaccctgtgtttctcaccacccacctcctcaccaaggggcagcccagaccctcaaccccaggcctcgggccccaagtaggccaggcctgttgctgcagacatgtccccacagcactgggctcaatcaccctgatccccttaaccatagtgccagctttctcctaagggggccggccacctagctcctgtcccatgcctctgggggtgatccttgggtgacagccattcttggtatctctctcctgctctctgtctcacagcaacagaaagcggccctgctgaagaacaacaccgccttgcagtccgtttctcttcgaagtaagagtgagtagttggggagtggaggaggtcccctaagaccctggaccccaggctgctcaacccatgggctctgctgccccactaaggttgttcccaggcatagcaccttcctcttcttgattggaagcagatagtgggggcctaagggagggttcggactcttggacttagaggcagaaggggagagagagtccgaatggggatgagggctggggatgggtggtcgcctgagcctggccgcagcctgcatttttatcagttatttacactgcatttcgggagtgttggtagcagctgtcaagtgtcaattcagacagctttggtgtaacagaaagagcatggcccttaggtataaagagcagagcctcagtccctgcctagccattacccaagtcaccctggacaagtctttttgtctttctgagctcctgtttgtttataggcttatgtcagggaggagataagtaagaaaaagctctttgtgaacattagagtatggcacaaatgtaaggtggcattctcattaccatctttcttgactagaggggctgaggtggagtgagaggatgcctcattcctcattgaggagcctaggaggcctcaatcctgggaagcaccagagtctgatgtttgcctgctgggcatctctcccccacagcaaccatccgggagcggccaagctcggccatctacccctccgacagcttccggcagtccctcctgggctcccgccgtggccgctcctccttgtctttagccaagagtgtttctaccaccaacattgctgggtgagcctctgtttggggaaaggggcagccagagagtgtggcagtggaggccaagggggtgctgagaggtccctttccatccctgagttcagaactgtagacagacaaataaggagaacttagggggaccgcctcttggatcctggctttggttccctacctgggaagggatcttttgcccgactgggggtgatgcagacagcctccactttcttcagacatttcaatgatgagtctcccctggggctgcgccggatcctctcacagtccacagactccctcaacatgcggaaccgaaccctatccgtggaatccctcattgacgaaggtgagcaggcctgggcccaggggagccctgaggaacatgaagaggggctgggggatgagaggctggtgggagtagcctggaaggacaaggagggaagggatctagagaagggccagggacccagggaagggaactcaagacctctgagttgcttgccctgctaatgtccagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatggtaagccaagaccaccctagtcttcctcttccttcaccaggtcctgtttatctacttccttctttatttttctttttctttttttttttttttttgagatggagtctcactctctcaaccaggctgaagtgcagtggcatgatctcggctcactgcagcctccacctcccaggttcaagcgattctcattacaggcgcctgccaccatgctggctaagttttgcatttttagtagagacggggtttcaccatgttagccaggctggtttcaaactcctgacctcaggtgatctgcccgcctcagcctcccaaagtgctgggattacaggcgtgagccaccgtacccggctgtgtccttctttctaccagcccctacctctcaaaaccctttccctcttggcctacaagaccctgcctggtatcccacaggttgcccactaggtccctacctcttgatgctgttggtctccaacaccctctctttatcccttctttatctctgtcttcagtctttactctgtgcttgttccacgcttaacaccgtgctggagactgtgggaagcctcgacatgtagaagacatatggttcttaccctaaaatagctcacagcttgagatgataaggtgtaaagataaaaaatggaactgggcgtggtggctcatgcctataatctcagcgatttgggaggccgaggtgggaggatcacttgacgccaggattttgagaccaacctaggcaacaaagcaagacctctgtctctaaaaaaaaaatatatatatatatatatgtatatatatatatatatatatatatatatattttttttttttttttttttttttgaagcagagtcttgctctgtcgcccatgctggagtgcactggcgctatctcggctcactgcaacctccgcctcccaggttcaagcaattctcctgcctcagcctcccaagtagctgggattacaggcgcctacaactacacccggctaatttttgcatttttagtagagacagggtttcatcatgttggccaagctggtctcgaacacctgacctcaggtgatgcacccgcctcggcctcccaaagtgctgggattataggcgtgagccaccgtgcccagccgtctttaaaaaatattttaaaaaactagtcaggtgtggtggcatgtgcctatagtcccagctacttgggaggctgagacaggaggatcgcttgagcccagaagttcgaggctgcagtgagttatcattgtgccactacactccagcctgggcaccagagtaagacctcatttctggaaaaaaaaaaataataataaaatttttgaaagataaaaatgagggccgggtgtggtggctcatgcctgtaatcccagcactttgggaggccgaggtggggagatcacgaggtcaggatttcgagaccagcctgaccaatatgaagaaaccccatctctactaaaaatacaaaaattagccgggcctggtggtgcgtgcctgtaatcccagctactcaggaggctgaggcaggacaactgctcgaacctaggaggtggaggttgcagtgagctgagatcgcgccattgcactccagcctgggcaatacagtgagactctgtctcaaaaaaaaaaaaaaaaaaagataaaaatgattagaaaagtatctaagatcataataatgcagaatattaacctggaatggaccttgaaaacctcacgtgaactgtgaggtccttatcctagggccccacgagttttagccaagccagggtagaggccaaatgtcccaatgtcccccacagagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccaggtgggaaaaggcaggacccctgggtgacattcatggaaggaggtgtgactgggttgggcatttcttgggtccaaattctaggggttggaggggagccagggagagctggagaaacaggaagccagcctgtttggcaggaggccagaggtgtgtccagtgggtaaagtgtggctttgggggaatgctgacctaaccttactcgaccaacttctagttctcaggtcctagtgcggagcagatgtgtaagacctactcggagttctgcagccgccacagcaaggccttaaagctctataaggagctgtacgcccgagacaaacgcttccagcaattcatccgggtgagcggacctctccagatcccatgctcatggcccaaacccaccctccccaactcatgggggtagtgcctgtgagctgcacccacatggaggtcaggcattcgccacccgtgcagaccatccatacacagatcctgtcagcagtaacccctcagaatgctagagcacgttgtggtagtttcccaagtactttttgctccttcagttggtcctcacaacaaacctgtggcgttgttatccccattttccagatatgtcacctaggcaagcatgaggtaaatggccacgccagggccagcaccagagctcaggccccaggcctttctgttgccctcccctctggccctgagccctgcctcctcccttgtagaaagtgacccgccccgccgtgctcaagcggcacggggtacaggagtgcatcctgctggtgactcagcgcatcaccaagtacccgttactcatcagccgcatcctgcagcattcccacggtgagtaggcaggcccaggagagggccactgggagacggccacctggggtgaggaaaggctcggtatgaccacaggaagggtggggtcgggtgtgaaaccctgggcagcctctaaaggtggaatcaagacacgatgggaactggggtgtgagtgaaactggttgagccgttccccatgccaacccccggtgccagggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaaggtcagacctgctcggcagactaggcaggaattcaaagtcagatggagagtgggagatgcctgcaggtcttagaatcaacctctcttggccgggtgcagtggctcaacgcctgtaatcccagcacttagggaggccgaggcgggcggatcacgaggtcaggagattgagaccatcctggctaacacagtgaaaccctgtctctactgaaaatacaaaaaattcgccgggcgtggtggtgggcgcctatagtcccagctactcaggaggctgaggcaggagaatggcgtgaacccaggaggcggagcttgcagtgagcccagattgcaccactgcactctagcctgggtgacacagcaagactccatctcaaaaaaaaaaaaaaaaaagaatcaacctccctttatgcagcccatacaacagtgagactcagtgggagagaaaaataggatctctgtggcagaaaagcctgaattctgcagttaactttatggaccatacagggccttccctatcagtattttataatttctttggtccttgcatgcctagagagctactagttttactgaggaagacaaagaagctctcagactggaggacaggatcagttgattcccccagctggaatcccagctaccagggatgggagtaagcaagagctttggggagcgcagccagaggaggcccagaggaggggactgagccggtgaaggacaggcagggaggagaagagacagcagggcagagggagcagatcaggggccagggcacactttcccaggctctctttccagaatttgtctgcactggcaaagtctttctcacctaaatcaaagcaagagaatagcaggccttggctttggggatgagatgtgagggacaataggaaactgtgatacctgaggccaaagcctgcctgagcctctgtacctgtgtcatgaaatccctgctccctgggtttggatattgtcagtcttcaccagcctctttcctttatccctttctctccttcccatctctcccacgcagcagctaagaatataaaccatgggggattaaaaatagcaaggctggagagtgttatttctgaagcatttagcaaaagccctccccttctgtgtgcccacagtttagtaaaatccccaagggcaaaggaggagtgtatgttttctctctctttttttttttttttagaaacagggtctcgctttgctgctcaggctggggtgcagtggtgcagtcatagctcactgtaactcaaactcctgggctcaagtgatccttctgccttagactcctgagtaactgggactacagacctgcaccaccacacccagcacatttttaaattttttgtagagataagatcttgctatgttgcctaggctagtcttgctcagactcctggcctcaagtgattctcctgcctcagcctcccaaagtgctgggattgtaaatgtgagccactatgcctcgccctctgttttcttgattgtgacatccaagttttatggaattgatctttgtttcctccctcagtcttggagtgctgaccccataggatctgagagcttggagtgtgaagcagagaaagaaattgaagcaggggcctgctggggttgaaggagatgggtgggtgagggatggtctttcagtcctctgcgagaggaaggaaactttctccctccctaccaagctcaaaattagaagtgggaatatgccaggacagggagaatttaggtcagatagccgtaaaggtcttccttagttagatattagaaatggaatttaaaggctaaaaaatgtggtccaggctgggcacggtggctcatccctataatctcagcactttgggaggctgaatcaggcaggcagatcgcctgaggtccggaattcgagaccagcctggccaagatggtgaaaccccatctctactaaaaatacaaaaattagccaggcatggcagcattcacctgtagccacagctacttgggaggctgaggcatgagaatcgcttgaactcaggaggcagaggtcacagtgagcagagatcacaccactgccctccagccagggcgacagagcgatacttggtcccaaaaaataaaaaataggccaggcgcagtggctgatgcctgtaatcccagcacttcggcaggccaaggcaggcagattacttgaggtcaggagttagagaccagcctggccaacgtggtgaaaccccgtctctacaaaaatgcaaaaaattagccaggtgttgtggcgtgctccttaatcccagctgctcaggaggctgaggcaggagaatcgctttttcctgggagacagaagttgcagtgagccaagatggcaccactgcactccagcctaggcgacagagtgagactccgtctcaaaaaaataataatagaatcaaattaaattaaaaataaataaaaaataaaagtatggtccctcttgctctggggaaccttatgaatctcacaaaaatcttggaccctgtcacccaaaaaaatacacgagttatgttaatatgtaaaactatttacacaccttcagaaggtttacagagccactgaagcctgacatcccagggggtctgtaggccctaggttaagaaacctgaatcagtcaggtagaaagggttttctgtagacactgagtgatccctgtggttcctgctagcccacaacgctgttttgtctgatagcacatgaatctttctgcaccctgcccgccccccaccccccacccacactgtttttaagctgtaagaatgtgtgaccaggcgcggtggctcatatctgtaatcccagcactttgggaggccgaaactggtggataaacctgaggtcaggagtttgagaccagcctgaccaacatggtgaaaccccgtctctactaaaaatacaaaattagccgggcatggtggcacacgcctgtagtagtcccagctccttgggaggctgaggtaggagaatcgcttgaacccgggaggcggaggttgcagtgagccaagattgcaccattgcactccagcctgaacaacaagatgaaaactctgtatcaaaaaaaaaaaaaaaaaatagaatgggtgaggtgtgagaggtctgaaaaagtgcaagcagccagagggaagagaggccaggaagagggaaactgggagctctaacctgatgggataagcctggtccttgggaaagagggaagcagctgctcagaccgtctagtgctgactgttctcccaccttcatccccttccagatgtgctagtgctgctgatgacagatgtactggtgtttctccaggaaaaggaccagaagtacatctttcctaccctggtgagacattcattcttcacctttctcagcacagacaagtgttttagtctcttcttgctttcctgcccaagcccacgagagctctggagtcccccagagtcaaacagctataattgttactattaccgtaataataaaaaataagagcagctcacaggtactgttactgtgcacaggcacttttacacctgtgggaaaagattattttcgtcctcattttatagatgatgaaagtaaagcttcaagtcagttaaataatttgtcaagggttgcacacatttctaagtcccttctggctggcaccagtgcctggctcttaactggtattgtaagatgactcttcagtcctttcagtcctcgtccagaaggattgaaggcctaaatatgccaagggacaggattcccaggcttaatccttcctttcccctgactggcaggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacgtgagtgtctgcctgccgcctgcatgtgcttatgacctcagggtacctgcagcattagatcccaaccatagaactccctgggaacagaatccagcattcagaggtgggggaagaggttgagggagagacaaaatggcccaagactggaaaggtcacctatgttcttatgtcctgtaaagccacattttatacattgccaacctcaactccctttcaaattcagcatgagctgacaagcaagggaatactttgagctgtcacatggtggcatacctgccagccaacagtacaatttcagctgcattcacatgttcatctgtaggcagagggctgttatttggattgtattgtattttacatttatttttctaaaaatgaatgaaaaagaggataatgaaagcatcgatactagagaggaacaagtctcataaacagactcaacacaatagaagcaagaaggaaatcagtgtgtcaaagcagcaaatctttagcttctattggacacacattagatttgaggcagtcaactatgtgtctaattgtgatgggaaaaaacatcaaataaagcacaggtaagatgtttaaaatggattctggaagattatgcctaaagaatgaagtgtaagtgtaattctaattcagatttttacaggttttctttcttttttttttttaattttttttgagacagagtctcgctctcagctcactgcaacctccacctcctggattcaagcgattctcctgcctcagcctcccaaatagctgggactacaggtgcccaccacgaccccaggcaaattttttttttttttttttttttttggagacagagtctctgttgccgggctgcctcagcctcctgagtagctgggactacaggctcacgccaccatgcccagctaatttttgtatttttagtagagacggggttttaccatgttggccaggatggtcttgatatcttgacctcgtaatcgacccgcctcagcctcccaaagtcctgggattacaggcatgagccactgcacccagccaaatttttgtatttttagtggagacggggttttgccatgttgaccaagctggtctcgaactcctgatctcagatttatccgcccacctcagcctccaaaagagctgagattacaggcattagccaccatgcccagccaagatttttataatttttctttagctttcagggaatcagttctcaactttataatttgtaaacctttttttttttttaacttctgcaccatggaattttgaaaaggtttttagaaatgcatataaaagtatgaaattgcaggccaggcacagtggctcacgcctgtaatcccggcactttgagaggctgaggcgggtagatcacttgaggtcaggagttcaagaccagcccggccaatatggtgaaacctcgtctctactaaaaatacaaaaattagccgggcgtggtggcataagcttgtaatcccagttacgcgggaagctgaggcaggagaatcgcttgaacccgggggtggaggttgcagtgagtcaggattgtgccactgcactccagcctaggtgacagagtgagactccatctccaaaaaaaaattatgaaattgcctattccaagaaagcagttcaaaataacctgtcctgttgacagatctgtagtggcttctttattaatagtattaatatttataattgtggccaggcgctgtggctcacacctggaatcccagcactttgggaggctgagacaggcggaccactggagttcgagaccagcctggccaacatggcgaaaccctgtctctactaaaaatataaaacttagccaggcatggtggtgcgtgcctgtagtcccagctgcttgggagactgaggcaggagaatcacctgaacctgggaggcagaggttgcagtgagccaagatcctgtcactggactccagcctgggcgaaagtgcaagactctctctcaaaaaaaaaattataattgtggaaattaataatattaattgtaattgatttgttgagcttctgttatgttcaaagcactttaacatttcatttaatcctaatgaaaaacctatgaggaagatattaccttcatttttcaaatgaggaaatagagaggttaccacctggtaaacagtggagccaggatttgcatcctgtttgcttgatgccaaagcctgtacttgaccctctgcactgtgctgcctttccaagcgacctttggagagatatatctcagtaaacgcagataatcagtgctaagaaatgggagaaggtcggccgggcgcggtggctcatgcctgtaatcccagcactttgggaggcggaggatcacctgaggtcaggagtttgagaccagcctggccaacgtgacgaaaccccatgtctactaaaaatacaaaaattagccaggcatggtggtgcgtgcctgtaatcctagctactcaggaggctgagacaagtgaatcacttgaacccaggaggaggttgtagtgagctgagatagcgcccttgcactccagcctgggtgacagagtaagactccgtctcaaaaaaaaaagaaagaaaagggagaaggtcaggactaaattaaagctagggtgtgaggctgaggagtcttatcagaagatggaagcataaggcatgtttgggaaggagggaaggctgattctggtctataacctagcttctgtctctcaatggcatgcgacctgttacccctccagatgcccatccagggaggacttccccctgattgagacagaggatgaggcttacctgcggcgaattaagagtaagtccacccacaaggagctccttagtaatttataatacattcacacaatggaatattatgcaactgttaaaaagatgagatggctctatgagggctggtgtagatccacaactgaaacatattaagtgaaaaaagcaaggtttaaaacaatgtaaagtgtatactaccatgtgtgtaaaaataatatggaagaccaaggttgggtgagtaacttactttttcactgtaaggccttatattagttagggtatgatttaactgctatactaaaagaccacaaaaatcttcttccttaaaaaaggaagtagattggccgggcgcggtggctcacgcctgtaatcccagcactttgggaggccgaggtgggcggatcacgaggtcaggagattgagaccatcctggctaacacggtgaaaccccgtctctactaaaaaatacaaaaaaaaaattagtcgggggtggtggcgggtgcctgtagtcccagctactcaggagagtgaggtaggagaatggcatgaacctgggaggcggagcttgcagtgagctgagatcacgccactgcactccagcctgggcaacagagggagactccatctcaaaaaaaaaaaaaaaaaaagaagtagattggctggatgcagtggctcacgcctttaatcccagaaggatttgggagacaggaggatctcttgaggtcaggagttcgagaccagtctgggcaacaaaacatacatagcaagaccctgtctctacaaaaaattaaaaaaaaaaaaatagctaggcatgatggtacacacctgtagtcctggctactcgggaggctgaggtgggcggattgtttgagcccaggagttcaaggctgtaatacactataattgcaccactgcactccagtctgggtaacaacaacaacaaaaaaaaccccaacaaggtagaatattattgctgtcaacataacagttcaaagtgggaagtgcagagtagtggtgcagctctgccatctttaacatgaagttttcatctctatgtcatgtctgaagtggctactccagctcccactgtcacacctgtatcacacctagcaaggaggagtaaaggaatagagtttatacccttttttctttttctttctttcttttttttttttttttttttgagacagggtcttgctctgtcgcccagggtggagtgcagtggcgtggcgtgatctcgactcactgcaacctccatctcccacgttcaagtgattctcctgcctcagcctcccaaggagctgggattacaggcatccaccaccactcctggctaatttttgtatttttagtagagatagggtttcaccatgttggccaggctggtctcgaactcctggcctcaagtgatccacctgccatgcccagcctatacccatttcttttaagagcagatctggaagatgctcatatccattggccagaatgtagtcatgtagcaatatagtcacgtgcaagtcaggctggaaaacatagttgttaactgggcagccatgtgtgcccagatgaaacttctatgcattttctcattaaaggaagatggaaagaatgaacactgttggacaacctgcaaccccttccacaaatcttttttttttttttttgagacagagtcttgctgtgtcgcccaggctggagtgcagtggtgtgatctcggcctcactgcaacctctgcctcctgggttcaagcgattcttgtgcctcagcctcctgagtagctgggactacaggcgcgtgccaccacacctggctaatttttgtattttaagtagagacagggttttgccatgttagccaggctggtcttgaactcctggcctcaagcgatccacctgccttggcctcccaaagtgctgggattacaggtgtgagccactacacctgaccaacagaaagctttttcttttttataaatgccaaaataacaaaattaagtctgccacactgccccaccctacccctctcccctagggctgtcctctactggcgctcttgcatacccctacgtcctctcatgtcctcacttgttccttatctgcagtggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgagggtgagggagctcccagggaagagtccaggctcaagcactcaccgtcacagaatgtggacatgtgactagacatggacaaacacagacaagtgggatgccaaccctataaaccataaacggccctgagtgcctcttctgggccagttcctgggaaaggcaggggaggaggtgtggtccttgctgctgctccatatcgtccatgctgcatggactctgctgcctcgtaggcatttactgccctttacctcatcagtggttgtgtgagtgaaaccccactgccagtgcagggggcattcccccagatgcccaagtgtcccacatgtgggggtgaatggcattcccctcagggtcctgtgtcattcctgttctcacctcttcctctttccccacagtggagggtctgaaagacctgctggtggggccaggagtggaactgctcttgacaccccgagagccagccctgcccttggaaccagacagcggtggtaacacgagtcctggggtcactgccagtgagtaccagggcaggggaccaaggtagtaggtgggaggggccaaagttagtagagtggtaccagggatcaagtggtatcagggccccagggaagtgagctcagccatccttttctccttctcaacagatggtgaggccagaaccttcaatggctccattgaactctgcagagctgactcagactctagccagagggtaggtcctcaagaggttctgggacttggcaagagggtgggagagggacagccagcctctggatcctcaacacaaagctgtcaggggcaggcacccaggatttgtgtgcctgctgactccccattcttgcccatttctgcaggatcgaaatggaaatcagctgagatcaccgcaagaggtgagatgggaattgatggtataggagactgaagggaggatgttcttagtctgagtagttagagcccagtttggagtggggtggggaaagcgtctacattcaagtatgtctccggatcctactgtccccacacccacccttgttcaacttttgggcagttctcccatcctaaagctggggccctgttcccaccctgtctgtcctcaggaggcgttacagcgattggtcaatctctatggacttctacatggcctacaggtcagtaggacaagggcttgaatggggaaggggaggagccaggctagagatgcctgtttaggtggggcatggtcatcccaacaggcctttctaaataccctcccaatccaagctctccaggagcgatgatctgggccttggagggtgaaggcgaggggtagaagagcacaggggttctgataaacccttctgcctgcattctactcccaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacaggtaaggtggcctgcagtggtgaatggacctggggtggacataagggtccatggagcccgaaagaaattgggccattggggatttgagcccaaatgcaatcagtcaactgacttgaaggatattgagatactggttggagaactgaaaagaaatgtagatgggtgcaggggtggaggaaattaactcgggtcgtggtgctgaaagaggccagttggtggtggatctcctgaaggggactcatgggtgagccccaggggggagagctgctgccttcagccaagcagaacctccaatcttcacactactcagtccctgacctgctgttcttcctgcccactgtccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgaggtgagaccctggcggagacatggaccagaggtagagtgcagcctgggtacaggccattgggctgtggcttccaaatgggccctaactgacctgtgaggcttgtagtaactctagggagggacttcctgttttgtctgatgatgaatgggtggtggaagtctaggaagcaggaggggcctctctcctccaactggttggtgattcccaacctttagaagtaaaaacagattcttttttaaaaaggcatggcggctcaggcctgtaatcctaacactttgggaggccaaggcaggaggatcgcttgagctcagaattttgaggccagcctgggcaacatagtgagacccaccttctctacaaaaaaaaattcatttatttatttttttattttatttaattaatttatttcattattattttttgagatggagtcttgcactgttgcctgggctggagtgcagtggcgtgatcttggctcactgcaacctctgccttccaggttcaagcgattctcctgcctcagcctcccaagtagctaggattacaggcgcccaccgccacgcccagctaatttttgtatttttagtagaaatggggtttcactatgttggccaggttggtcttgaacggctgacctcgcgatccacctgtcttggcctcccagagtgtcgggattacaggcatgagccaccacgcctggctaaattttttttttttttgagatggaattctcactctgtcgccaggctggagtacagtagtgagatctccgcttactgcaacctccgcctcccaggtccaagtgattctcctgcctcagactcccgagtagctgggactacaggcacatgcctccacgcccagctaatttttgtatttttagaagagatagggtttcaccatgttgcccagtctggtctcaatctcttgacctcatgatccgcctgccttggcctcccaaagtgctgggattacagatgtgagccactgcacccggtctattttattttattttattttattttattttatttatttatttatttaagatggagtctcactctgtcacccaggctggagtgcagtggcacaatctcagctcactgcaacctccacctcctgagttcaagtgattctcctgcctcagcctctcgagtagctgggatttacaggcatgcactaccacacctggctaattttttttgtattttttagtagagatggggtttcaccatgttggccaggctggtctcgaactcctggcctcaggtgattcacccacattggcctcccaaagtgctgggattacaggtgtgagccaccgtgcctggtcccccaaaatttttttaattagccaggtgtggtggagtgagcctgtagtcctagctacggagagtgagagtgaggtgagaggatcacttgagcccagcaggttgagttgacagtactccgtgattgctccagcctgggcgacagaaagagacccggagacccagacagaggatctcactctaaaattttttatgttagagagagggtcttgtgctgttgccgaggctggactcaaactcctgggcttaagtgatcctcccaagtagctggggctacaggtacataccactgtgcctgggaaggtatagttttttgttttgttttgttttgttttttttgagacagttttgctctgtcacccaggctggagtgtagtggcacaatctcagctcactgcaacttccacctcccaagttcaagcaattcttgttcctcagcctcccgagtagctgggattacaggcgcatgccaccacatatagctaatttttggcatttttagtagagatggggtttcaccatgttggccaggctggtctccaactcctggccttaagtgattctcccaccttagcctcccaaagtgttaggattataagcacgagccatggggccagtttttaaagtaaaaaaagtttcaaagaacttcaagtttttacagttggttcatgaaataaaaaattaccaaaagctttaaccttaaagtattttgtattttcctaatcaaattgtatctttggatactgtaaaagtgtatccggtacctaggtatggataccttgcttactttgttgccaaaggttttcctctcacccaagaatttacagaaccctgtcatcccttcacagccccagagccccctgagcctgcagatggggaggcattagtctaggggtacagttcctcatgggagtctctgctaactcactggctttgtcctgtcccccttcagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcc

SEQ ID NO: 36931 - DNA, 86085 bp, Homo sapiens
gctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggtaagtggtgcgtcggctccggccccgagacccagcagcgggcgacgcggcgcaggaggtggaggtggaggcaggaggcggagcggagccgggtgcggtggagcagcagaggccgagcggagccgtgggcggcgggccgggaccccggggccgggccaaggactggcggggcagccgcgagttcacctgacgcggcccctcgctcggcgcccccgaggccgccggctcgccgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaagtaaggacctcggatttgagtgcccccagcgcctctgccccactttacgagcgcagtttagacgaaagcggacgcagcccgttttcccccaaaacctgggccggagggcctcgcagctgagtcattcggtcccgggcgcgggcagtctccggagtgggaagggcagagccgcgaccgctctcggaaggcgcattttcccttctgcctgagtcttgcctttttagggccatctggtaaggtttccagagcctgttgaatctggggaataaacacattattaaacatactttttttttttgagacggagtcttgctgttacccaggctggaatgcaggggcatgatctcggctcactgcagcctctgcctcctgggttcaagcgattctcttgcctcagcctcccgagtagctgggattacaggcatgcgccaccacgcctgctaatttttgtatttttagtagagatggggttttaccatgttggtcaggctggtctcgaactcctgaccttccacccacctcggcctcccaaagtgctgggattacaggcgtgagccgccgcgcctggcctcagcatgtttcttgatcctgttgcgttttatttgtatatcagatacctgagtttgaaatcacttaggggtttcctgcatgctgctcagtgaagcagcggtgagtttgtaatcacattttaagaaattgggacttacagggccagtctcaaagtgtcactgaaattgaaagagctcctttaacactgtggcttacgtacgtgactcagtttcctttctacttaatttgccgggcagatgagggtgtacctttcccttgaaacaaagatctagattgaacagtgagaggtccgctgtgaacattgcatcagattacatgaataaaccacgctgttttttatttgttgtttttttgttttttgctttgagcgccacgtttttttcctagtctttttttttttttttttgagacggggtctcgctctgtcgcccaggctggagtgcagtggtccgctctcagctcactgcaagctccgcctcctgggttcacgccattctcctgcctcagcctcctgagtagctgggactacaggcgcccgccaccacgcctggctaattttttgtatttttagtagaaacggggtttcacagtgttagccaggatggtctcgatctcctgacctcgtgatccgcccgcgtcggcctcccaaagtgctgggattacaggcatgagccaccgctcccggcctttttttcctagtcttgattctttttttggataaactttcccttcctaagtcatagtagtcttaaagtctttcaatctaaagtaatttttttcccaaaggaaggcaaattgcacacaatatgttttggccaataaatgctaagtattaaaactgatgtttaaagaactatgtattgatcccaacacagctttaacaaatatattaaaatggttttgatcctgaatgagtaaacacttaaagcattgtcagtattcacacaactttggcgaatctgtaaatagatgaatataacacttactttcccagtgaattggtgatggatatggaatcattttggtgattgcgaagttgtaattacggtgatgttttgtgtacatattttggtgacagtatatgaataaatttttattgaatgcgtaaacataggacatttttatttttagtctttttgtttttgcattgtccctgaaagttaatgaaatttacttcttcttcctgaattttaaactctggaatccatagttaataggctgtattccagtttcctactcaggtgagtcactgcctaatcaaaatacaaaatcttgcttagggttatgaccatttcatgaaaagtagggaagagttttgaattattaacatatataaggaatcctgactgaatctttaccaacatagacatatatttctgatcctttttctcccaagttgtattccctgcaaattaagtattgggccagaagattgagctaggtttattgtttaagtggatgttcttactgaaaagctctcaaatgtcctgttccttttagatagacttcttaaaataaaactgaacagtgcaaacacttaatagctgaacgattgagagacgttattttttagagcagttttacaaccattgatatttttatatttccttaccaacattgattgataaggaaataagcctgaaataccgaattttattgtttctacttaagtaaatggatggattccatatgtaaaagtcagctttgaaaatagttattattgtacattgaatacagttttgatattatcaacacaggaacttaaaaatccagtttaggccgggcatggtggctcacgcctgtaatcccagcattttgggaggctgaggcaggcggatcgcctgaggtcaggagttcaagaccagcctaaccaacatgaagaaaccccgtctctactaaaaatacaaaattagccgggcatggtggcccatgcctgtaattgtggctacttgggaggctgagactggagaattgcttgaaccccggaggcggagggtgcagtgagccaagatcaagccattgcattccagcctgggcaacaagagccaaactcagtctcaaaaaaaaaaaaaaaaaaaaaaattttttttggaaaaatgtatctcattacacaataggtagaaatgaacattttaaataattatgttaataatctccttttagacaatacattttaaatgtcttttgcaatgggaactccacaataaagactgtgctgttcttaagaataaatgcttttactcataggttttcattttctgatactgtatatccagtagagaataagcaagaacaaagaagaaaacctaaggatatcattagtggaaatttttcttgatactacttatggaaatgccttaagtcttactgcactgaataatgatgttttgttcaatgatggaccacatatatcccataagattataatggagctgaagaattcctgttacctagttatgtcctagctgtcctaatgtcagagggcagagtattaccttttctatgtttaggtatgtttagacacacaaatacattccactgtgttctaatcgtctgcagtatatagtacagtaacatgctgtacaggttttgtagcctaggagcaacaggctatcccatttggcataggtgtgtagtcggttgtgccatctaggtttgtttaagagcagtttacaatgttcgcagaatgaagttgcctaatatttctaagaatgtatccccattattaagtgaagcataactaattcagttatagcaaggtttacaaagtaaaatgatatctatttgcacatttcatgacaggccttcctaggagtgatagaggaaattactggcaacgtgtgtgtgaagtagtttttataagtagaggaaatgcataggctataaaactatatggtagttttgcttaaagactgcttaaataaccatctcgttggtcaggaaggatgcttacctctaagaaaaccttactagcaactcatcctcttgtcagacttttttgaagcctctcagatctccacaaatgagaaacatctttgtgcatgttttctaaacagtagtataaccaggccatttaaatatcaagatactaataaaatcctgtgaacgtttaagagtggagctaatgtgatgctaatattttccctgagaatttcacaaaataaactcagtgtctttaaagttatcttagtaaaggtttttttttgtgtgtttttttaaacatagcagacttaaatcatccaacttagaatagcaaaatagcagatagttttgtttatattcttaatctcaatttttttattgatagcacaaaaaatgatttttttttggcttagaaatgtttttaactggaatttatatcttagcactgattatggtgaaagtatccactttggaattatgacaactgtatcacacataaagacccacattactgaatatgggtgcttggaatgtttttactcttaaaatttctggaggagtaaaattaggcatgtttctgcacttagaaagatacaggttttgttcagatgtgtaagataggaccaatctaggtaagtaaaataatggtaaaattcttttttctgatcttaagctaattcaggtagtttatctcctttgtcagatttactatctagtagttaatacatttatacttaatacgtagatatgtgttttcagatgtacttaatgtgcagtaaagaagcatgctattgaaaacaaaacaaaacaaccttacagtgattctagtcaagcaagtaactccttcaaaagtttaaaaatttggtttcacattggccgggtgcggtggctcacgcctgtaatcccagtgctttgggaggccgaggcgggcaaatcaggagaccagcctgaccaaacatggtgaaaccccgtctctactaaaaatacaaaaattagctgggcatggtggctcgcgcgtgtaatcccagctactcaggagactgaggcaggagaatcgcttgaacccgggagttggaggttgcagtgagccgagatcgtgctactgcactccatcctgggtgatagagcgagacttgagtctcaaaaaaaaaaaaaaaagaaaaaaaaattggtttcacatgaagtggtggtggcgggggagggaggtgtttgaaaggatggagacaggccatgattatttgaatttcacttttcatttcctcctcagcagcccattctgtagttcatttactgtgaaatggccaaaagcaggcagcatgtgggaaatgaattgaaaaagagacacttactgaatagctagtcctttagtgattttagtaaagagttaagattacttaaataataacaggtgtctcaggcaattaaattggagtagccgtgaatctatattagagagcctcgtgaatttatgtataattcatgtttgaaatattaaagacatttacaagtgtttggaatatttatttacgagtatccctcttggctattctgtttttacatgaaagcgtaaagattattttttgaaagttactgttactttgcttcataaagagtataagaccaatggtgtaatttcatggtactgctttctcccattgtttttcctgtactcatcttcccctaaaatgcataaccatagtctcatccccgtcaattgcagctatatggctgtttggaattatttctcttataactagtcccaccttctcttaattttttaatcgacttggttgagaaggaccaactttacaatatgagcttcatattctcctttatctttcaaactttattgctcttgctacttaaattacagttaacctatggatatctacttttgcaaagaactaaaaccttgcttcatcacagaaccaaataaacagattgtatttctctgttctctttctcttcctgcttctgtaaaaggtatgataccttttgttccacattcttttctttttcttttgagtatgctagttgcagtgctttcaggttttcttattctttttcttttttagcctttcttttagaaaccatctcaataatgcataatttacagtttacatttttgggtttttgaaagtggagtaagaacttagattgtttggcaagtgtcttataaagaattcttaatttaatatttcccgtaagtcatagttatctccaattgtaatatctagtccaaaagcagatttttttttttttttttgagacagagtctcactgtgtcacccaggttggagtgcaatggagcaatctcggctcactgcagccttcgcctcccagattctcctgcctcagcctcccaagtagctgggattacaggtgcctgccaccgtgcctggctaatttctgtattttttgcagagatagggttttaccatgttggccaggctggtctcgaactcctgacctcatgtaatccactcaacttggcctccgaaaatgctgggattacaggcgtgagccatggcgcctgtccaaaagcagtttgttttaaagcagaaaaagcaaaactgtgtttattgtctttccaaagcattcaacttagtcttcagagaaacagttctctttttgaatcatttaatctacttagtcatttcatctaatgtacagtttaacaaaattacaaaattgcaacaagtgtggctggcacaatcaggtttggtgacaaacacaactaactcttggtaagcacccctccctgttggagtgaacataagtgcctgggcacactagagaactgtggtgggcattagctatactgtaggcttcacaggagtggagaacactgttaatatggagagctggaaattggttaagtaaactttggtattctagtaaacttgcccaagaagtttaattcttatatatacctagtttttccagaaaagttacattaaggtattaatttaaccacagcaggtaaaagttttttgtttttttttttttttcaagacagctctgttgccctggctggagtgcaatggtgctatctcggctcactgcaatttccgcctcctgagttcaagtgattctcttgcctcagcctccagagtagctgggattataggtgcacatcaccatgctggctcatttttgtaattttttcttttttaaatgagagtctcgctctgttgcccaggctggagtgcaggggcgcgatcttggctcactgcaacctctgcctcttgggttcaagcagttctcctgcctcaccctcccaaggagctgggattacaggcgcatgccaccacgcctggctactttttgtatttttagtagagacagggtttcgccatgttggccagactggtcttgaactcttgacctcaggcgatctgcccgcctcagccttccagagtgctgggattacaggggtgagccacagcgcctggcctcaacatttttaagtgttaatttaatactatcttttctctatcagcatattgtatttgtttgcttatattatatgagcattttccaacatttgctttattaccctctctgtaatatataatcccatattcagatttcaccatttgttcccaaaatgtcctttatagcataatcaacatattttaaatatcatttgtatagaaagctatatattgaaggataccgacagcagtgaaattgagcctggcatgatggctcaagcctgtaatcccagcactttgggaggccgaggcaggcggatcacttgaagtcaggggttcgagaccagcctggccaaaatggtgaaacaccatctctactaaaaatacaaaaattagccgagcatggtggcatgcgcctgtaatcccagctactcaggaggctgaggcatgagaactgcttgaacctgggacgtggattttgcagtgagctgagatggtgccactgcactccagcctgggcgacagagcaagactcagtctcaaaaaaaaaaaaaaggaaagaaaaattaattgaagctgttgcaccacagggtgaatggagcaacatactggtgaaagtaaggtgaatgccaactgttgtttttgtaatcatacctaataaagtttttatcagtgtgttagatggccttcaaaatatggcagagaaatccataaccaggcaaaataattttgggtctcatttcttcttataagttattacttgcctataacaaactaatctaaaatatgcctttctgctctaaaagctaaagcttaagagtcccttggcagatgggacttttaaattattcctgtagaaaattggtagtatataagtgttttaatttattatgtgttttaatttattcctgtagaaaattattcctgtagaaaatcggtagtatataagtgttacagctcttagaatttgtctagcaggctctccggtttttgccagaatgcccaccaccccccgaaaaaagaaagttggtagattggtagtatacaggatatatcagtatcctttgggtgtttaggtataaggagatctgcttagaaattataactggagagctgagtacagtggctcatgcctgtaatcccaacactttgggaggctatggtgggaggattgcttgaagctaggaatttgagacctgggcaacatagtgatacctatttctggaaaaaaaaaaaaaaaaaaaaaagagagacattaaaaaaaaatgagacaaagaagatagaacaaaaggctagataatttggaagaaaagcatgaaagtaatgtcataaagaattcaaagaggacaaagtttcaaatagagggggaaatgctgtaggggtattgaggaagatggggactagaaagcatccttttagatttggcaagcaggcaagcgttcattggtgaccttgtggagaatagttggaatgaagtaagtctctgatcatcctgagtcagggtcaagtttatcttgtcattattcgggtatgaggctagtttttctctttggtatcttgtggctcccatggccggaagttggtgctttcttcagtgctagttacctctaggaagaggaagcgggcggctgttcctggacttctctgaatacctttttctagttttaaagttttgaaccacaagaatgtattacttattcagcaaataaaacatttccaagtgaaatacagaaattggccttttttctatgatatagtgctgtgattatcattattgttcaagtgctattattattttgttgacatatctgcccccgcctttagattgcaggctcctggagagctgtctcctgcagtgccccagtgtctagtatgagggggtggcatctaatgggttatacagttgttaaggagcataagatgtccctacgtaaaatgctagtgtagcatacaatgaggtttgatgtcagaatggcatcagttctgctttttgttcctcttgtgaggagcctgttcaaatgccctactgtctcttgtccctatgctgggggcacatggtagcagtagtaaccatcgccttagtgcccttagtgaggtttgataaacctgcctgctgcctacagttccaaatttgaccaggattatatgacatcatttagaagaacccttaggagggaactctgaaagcaatgtgtctgtctaagcactgctgttgctggcagaggtatctagaggttacttagggatgagcacgattgttttctccagctctaaaagaaattaaggactctcagttttttttttttttttttttgggactctgtctcaaaagagtttaggtctgtgaatggtcttgctctgtcacctaggctggagtacagaggtgcaaacatggcccattgcagcctcaactttccgcgctcaagtgattctcccacctcagcctcctgagtagctgggagtccaggcctgtgccaccatacctggtcagttttcttgtagagacaaggtctcactgtgttgccaaggcttgtctcaaactcctggattcaagcaaacctgctacctcagcctcccgcagtgctgggattacaggtgtgagccaccatgtctggctcaaatgttcttttgtctttttctttgccagttttacttctttccacatgtcaaatatatatttttaaagatattagtaaaaaataaagagagtttaattgctacagtgtctaaactaggttttttaatggattgaaggctatcagaaggacgttttgaataaacttattttgtttggagtttaattttttaacaaaaacccaagttggaatttaaggtaaatgaaaacttttttgcattggagtgaaatataaggaaataataaattcattaattttattaagtgatcattaacttcttaaaaatagagctgatacctatgagctatacttagtattagatgatttagatagcactgctttctcttcagtagaaaataatcagaaaaatagtttatcatttaagttttgtcaatttttttccctaggaagataagaaaaatacagtagaagtaagattgacaaaaaaccgtacagggctgtttttagctttctagtcttttggttttttttggtgggggggagttattttttatttttagttttatagaaattagaatattcttcctggccttgttttgagaggttttaatttaaataaaatttaatttgagagtttttgaagtgaaatgttacgatctcccaattcaacattataattttactgcaggataaataaagaaaacaggaaaggaggaaagcattgattacaaatatcttaacaatgagcaaatgtgcaaggaaaaaatatattaagacaaatccaaggtaggtagatgtacgtttttctgttcttttgaaaattctacttagcttaaagttcatgatgaataaattgatatatagatgtacacatacatgtatgtatgtatatatattctattataatatatactcaaattattcagccattcacttaaggcaccatctactgtgtaccatgctgggcactgtaggagatgtgtcggtatgtcagttgacttatgctaagtactagtcttttcgtttagaaagtagaccaatatgaggatgtcgatagttaagtggaattgtagaattcgaagaatccccagggttttattcttcctcccggcctttcggccatacttgtacttaaccttataaaacagaagaaagtctctaccaacgttttaaaaatatccaaatagaatttttcaagttttcttttgattactttcagagacattctgtttcgttagttggatgtagtcctaaagagaaaattgattttccactttttgtaaagttatttaaaataatagaaacaactttaataacttccttttccaattggattctatttttagaagagatgaaaaattttttcaagggtagtgcacttcctctgcaatgtaatttgtctttgaaaattggatacaactaaaattttagaatttttttttttttttttttggagacagagtctcactgttacccaggctggtgtgcaatggcacaatcttggctcagtgcaacctctgcctcccaggttcaagggattctcctgcctcagccacctgagtagctgggattacagggtgccaccatacccggctaatttttttaattttatattaaaacaatttattactaaaaaaaattttttttaggccgggtgcagtggcttaatctgtaatcccagcactttgagaggccaaggtaggagaattgcttgaggccaggtgttaaagaccagcctggggaaaaaaaaagagaaaagggaagaagaccagcctgggtaacatagcaagatcctgtctcttagaaaaaaaattgttttaatggagggtcctattttttaaaaaaacaatagatatattaatattttattaatttggatcccagtatattcaaaacaggttgggataatatttgcttttctatcaaagtttgctaaataatataaaggagatttcagagaaatatttaacttcaaaagaaaataatcctgctattattagttgtttgtaaatttaaatatctccattttagcaattttttttttttttgagacacagtgtcactgtgtccaggctggattgtagtggcacaatcttggctcactgcaacctctgtctccaaggttcaagtgattcttgtgcctcagcctccgagtagctgggattataggtgcgtgccgccacacccagctaatttttgtattattagtagagatggagtttcaccatattgaccaagctggcctcaaactcctgacctcaggtgatccacctgcctagccctcccaaagtgctgggattacaggcatgagccaccatgcccagccaccattttagcaaatttttacctgttttttagaattgtggaaccaaatatttgccagtattttgcttgttgttaatttatagtgcttagtggacttgtttgttttcgtttttattgttttatccttacatgtttttatttttaattattttgtaattcataattgcccattggttcttttctctctaaaaaggattattgtttaagattaaaatactacatagttaattaaagactattagttttagtacaactatgtttatttaatattatcacaactatgtttaatacagaaggtgagatttgggaaaatatgttctatgagacatctcttcaattttaatgtatttagctataaattatatagtgaataatgtaagattataatggactctataaattctatctggagcagctgtggctgatttatagatgttaatgttgtatgtacatcatttacagctgagtttggggtcctgcatttctgctgagatagtgcctgaaaaatgcctggtacagtgcttgacccatgttgagcactgaaatgttagttgaatcttctgcactgagtcctgtataggagttgggttttagtgggtttaggaggttgtactggagggcataaatctgcagatttggatataaatctgcagaataaactggcttgaaatagcatatctattttaaattgctagtgttgaccttttttgtagatgatttttaccttcaaaaaaataattttagtatcaaacttgtactaaacggcatgaactgaacaccgtgctaggtactctggcagaatacaaatggaataaaattacagtccatacatttggtatgaaagagaaagcatatctgagtgagattgcgacaacaattgcagcatactccaaaacacatcatcatcgtaaaatgttgtccaaactgtaattcgcagggcactggctgtggaaggaaccctggagtcacagtcacaacacctctttttcatccctcatcatgctacctattatgttccctgtaaaagtcccttaatctctctgaacgttatttttattattataataacacctgacagttgcacagtcttccaggataattgattaattggtttatttagcatatactgtactaggcactgggaatgcatggaaatctataagatgggatccctgtccctgagttgctcacgctggtgtgtgaatacatgtattatatgctacacaagtgttataacagacttgtaaatgctttgggaactcaaaagagaataactaattctgcccatggctattagaataggcctttgaaagttggtgtcctcgaaccaggccttgacagactagtgagaatttgccagttggacaaagaagggtaaagggcatttcaggaagaggggagattagatgtaaaagattaaaactgggagagtaagatatgtacttgaaaaaatgtctgattaggaggctggcatgcagcgtgttggaaagagtagagggactggagataaggctgtaggactaaaatgggtcacattgtgaaagagattgaatggcagtgtggtttagtaatggagtgtatggactttggaaaaagaccttggttgaaaacctggctatgccacttaatacgttcatggtaagatcaaattcttaacctccctgagtctccttttccttatttctaaaagaagaactaattattttttattttttgagacagtctcactctgttgcccaggctggaagaactgatgatagtgatcttatagagttgttaatcaaaactaccaggcacttaccacatggtaaactctcaataaatgatggttatagttatgagaattagaagtttggattttatcctgtagtcaataggaagctactgaagagttttaagcaaagaagtattttaagcagaaatacatgttttagaaacataactattggcatggattggagccaggagttagagtggtggctgtggaaaggtagagaaggagacttaattgttctttagaaggtagaatcatcatacctggtgatgatgctgtgtggaatgacagagagggagtttcaggggtttctggcttgaacaactcgttggatgatggggtcccatttcctgagatagggaactcgggtagaaagtttgtggaggaagaagaggagtttagttctggacccactgattttgaggttcctgcaggacatgtgtttggagatgttaaacagggatttgcatattggattttggaattgagaagagacgtctggcctagagtcatgggtttaaatctggcacttgaatccagagaaacagaccatatgaagtagggagagatttgagagtgaggcaagaaagctaagcagagtcccgaagacatgccatgttgaagattaacattgaggaagagaaggaattgtcaggggagcttgtggaggaattgtcagcgaatcagatgagaagaggaaaatgtagtatcagaacgctgagacagtgttcaagaaggaagatgttgtcaacggtttgaatgctgctgagggatcaaacaaaaggtaggacttaaaatgtacgttggatttagtgacagagattagttaccatttctagagacgttttagaggtagaaacctctctaaacttgggggtatctaggagtatgtgggatgtgaagtaacggagatagtagtgttggcaattctttcaaatatttcagcagtgagaaggggaagagaggttcaagggaatagctcgagagatttctgatccagtggatttgtggctatgtgtataagttgtgagatgggagagacgtgaatgtgtttaagtctttacaggaaaaaactgttagagggggagagaataattgatagtataatcccctggggcatgggctccaaacaacagatacaggtattttaagagtagggaggaggcaggaggcaagggaacatggtgagtgtagatgtcaatagctttgttgatttggttgtgggaagttgatggagttctcattagagacaggaggcaagggctttcattgaatgcagtcagtatagaaacgcagggattgagaagagggagaacatttgaaacagttgttgagaatgggagagtagtaagccaaggaggcaaactccatcagtttgccgcccatttgaggttgaaaaccaagaatttaatagctatatttatatttttagagatggggtcttgctctgtcacccaggctggagtgcagtggcacgattatggcgcactgcagtcttgacctcctgagctcaagtgatccttccatctcaccctcctgagtagctgggactacaggtgcccatcactacgcccagctaacttttttgttttctatgtggagacggggtctcactatgttgcccagtctggtctcaaactcctaggctcatgtgatccttctgccttggccccccagagtgttgggattacaggcgtgagcccctgtgcttggcctcaatagcttattctgtcttataatttcattcagtattgttcatctgccttggtgcaggcatagaggagatgaagagttggttttatccaagattggtacttactaagaatatacagcaatggcacaatcttggcttactgcaacctccaactcccaggttcaagcaattctcctgcctccacctcccaagtagctgggattacaggcgcctgccaccacacctggctaatttttgtatttttagtagagacggggtttcaccatgttggccaggctggtctttaactcttgacctcgtgatctgcctgccttggcctcccaaagtgctgggattacagacgtgagccaccgtgccgggctgggaaacagtaattaaaatgagaagccatgttagctgaatagggtgggaagtgaagaaagggggaggcagatgggcagagagaaagtggtgtggagatctcagtgtgttggaataacaagtgtgatgggagtggtcaagggagagggtaagatgggaggataggatgttgtaggcagagtggaatgttggaattaattttttcagagctggaccaatttgcacattggcaatgtccagggtgtggccagacactccagtagatagctgaagtggcataaagtaagtcattgatctgaggcatctgggtaagggataggtcttcttttgagtgttgaacatagacagaatggtgaagaggaaagcttttacatcaggggccagagtcttcagtttacatcctggaggtgagtagatgattatcttatggatgggttcaggatggtacacctgatgaccttgagcctcagttgaacaagggtttttacgagggagtaaaggaggtacaggtgggaagcaacagtggggaacaaagcagatggccagtcaacatgctgaccttgattgggtgtgggaagatgagcagtactctcttgagaggacagcagagaggctttgggagttccagatagcatattgctggaatttggaaggagaacaggagtgagggattgtattatggagggaaaggaagcactagttatgagagtgaagatgaaatatggaaggagcttatatcttagtgatttgagtgtgattctggcatgggtgcaggggcattgaagtttagttgtggcttaggaaaaggcccattgtctgtgatttattgtcttcagagtggatagcagcaactgtgtggaacagcagctcaactgctttgtccagtgtggtgatgggaggttacagtggacagtgcccagtgctaaattatggtaaggaggaggagttgggatggctgctgaccttccatctctgcctttctccctaaggctcaacgcctcatggtatcctgactgatgtttagctttgtggggttgctttttgtggttgatctcattctgactgattatatatagacacacgattctagctttggagcctgaatggatgatgatactcttgactaaaagaagaaataaaagagaggggtcaggtgtccatgaaaaccccaggttgagatgctcagtaggagggaggtgtgtgtaaatacagatttgggagccatctgcatataggattgaagaaaccatagtattcatagtattggaaaattctgtagtattgacaaagggaaaagggcaaaggactgaactctctgggaaatgcccccagagaaaaatggaccagttaagatgattgcatgagatggtacgttatcaagacattttcatgtataaaacattttgaaatctgtcttttatcatatctcaaaaattgaggcctgaatagtttatctttttaatcattaaaactttttttttttttgatgggagacttcttggattctacagtgtgtacccctctgtccttaaagtatactgaacataattagcctttttttcatgactcaggatagttattataaatatcagttattgagttgtaacttccaggctgggcatggtggccatgcctgtaatcctagcactttgggagactgaagcgggctgatcacttgaggccaggagttggagaccagcctggccaacatggttaaaccccgtgtctactaaaaataaaaaaaattagccgggtgtggtggcgcgtgcctgtaatcccagatacttgagaggctgaggcgggagaatcgcttgaacccaggaggcggaggttgcagtgagtccagatcgcgccactgcactccagcctgggtgacagagcaagacactgtctcaaaaaaaaaaaaaaaaaaaaggtattattcctaatttaattccatgcagcctttccagccctatttgtaccagtcctactctgtctcttccccactaaatctaattatccccctttccctcacccagattttctactccaatcacctattctgtttcccagatatcctctgtactttcctccctctcatagtcgacctgtcctttctacctggtgaaatcctactcacccttcaatatacgactcatatgaccacattctctggcagacttggtcattctcttatgttttccagagcatttcatggatcacatatatcacatgattcaagaaattacggccagttgcaatggctcacgcctagtaatcccagcactttgggaggccaaggcaggcagatcacctgaggtcaggagttgaagaccagcgtggccaacatggcgaaaccccgtctcttctaaaaatacaaaatagctgggcatgggggcatgcgtcagtaatcccagctacgtgggaggctaaggccagagaactgctggaacctgggaggcagaggttgcagtgagccgagatgcctctgcactccagcctgggttgacagagtgagactctgcctcaaaaaaaaaaaaaaaaaaaaaaagaaattactttacttgtgatttactttaattactgacctgccaataaactgtgtttctcaaattttagtacatattggaattgtttgcatataagaagttaaattctcaagaaagtttgattcactaggtttggggttgagcctaagcttctgcattttttacaacaaatacttctcgttaattctgatgcgagttgtccaaggaccataatttgagaaaccaacaaccatgtagttaatggattccatcagggcaagggccatgacttatctgcttttgtattttcagggcctgccatgtagactatgctaaatgaatgtttctagaatgaaatatagtttactggggaaggcctttcggcatataatttttgagttgagacccaagttgttgcagaatcttaagaaaggttttgcctttcaaaggtgtaaaaaatagcacaagacaacatttcccaggtggtttccaaaatactcctgctagggcatgctttgtgggaaaagggtttgtttggtagtcagatacttttagaaaatgctgtctgttggacctgtgcccttcacccttctcaagacacactagcagattgaagcttttgagatgttctgtgggaaagaaacccttttaatctttaaaacgttttgacaaagcattttccctaccctttttccccagataatgcctttttagaacctgcagaactaatgtcctgaggtattttctttggaaactgctcacataaccaaaagtataacagtaggaattaacacttcatgtgtgatgatgacctataattacctagaattggagaggccactctgggaagttataagaaaagagataaaggattaggcaatattaagggaaagacatttttctatggtaggctcgacgtttgtattttggtataattgctctaaattgtcctggtcagttataagtattaaaataactgtagtatagatgatagcagacaggtttgagcatggaaggattggatttgggtaacggctactggaatgcaaaaggcagtaggaagtcaaagacagtagatgaaggatctgtagaatctggtaactaattaaatctggaaaaacaacttggatgttttaattcaaagatctaagtggtctatatactttttggatgtatagttagactaaggtgaaaaagaaacattgtattattgacagctgaaaagatgtgtaacagcagggagtagtttctataagttttttgggtttttttttttttttttttttttttttaagacggagtctcgctctgtcgcccaggctggagtccactggcgcaatctcggctcactgcaagctctgcctcctgggttcacgccattctcctgcctcagcctcccgagtagctgggactacaggcgcctaccacggtggcgcccggctaatttttcgtatttttagtagagacggggtttcaccgtgttagccaggatggtctcgatctcctgacctggtgatccgcccgcctcagcctcccaaagtgctgggattacagacgtgagccaccgtgcccggcctctataggtttttaaattttagttttgtttattttgtttatattttaacaggataaaatttattataatatagtttgccttctaaaaagagtccatatagaaatcactaacttaaactgaattcatacacaaacttcaaatcacatcagaagtttttcctggaaaaattaggtcctcttttttcaataattggggcttgtttatcagaaacgacttagtgataacaaagcaagacacatttttgtattattatacatttaatttagacgatggggaaattccttcacactacctcataacataaagcaggtttattaggccttaagaatcatagaatatttatacttttcatgtaaaatagaaaacctaattttccagccattcatgctaaacagcagggttaaagtaatgatcaggaagactttatacgttttaaaataaggtagttttcatgagacattttgcagtgctcccttggtaatgttcatattcagtgagcagaaaagaaaagatgagagagttaggactctactattgaacctgtttcttgaagaaaacaaaaaccagatagtacaattggatgtcagaaatgattattagaaagctaggtaaaaacagtacaggttgagtatcccttatctgaaatgcttgggaccagaattgtttcagaatttggaattttttggattttagaatattcgcatatacatatgagttaccttggggatgagagccaggtctagacacgagattcatttatgtttcatatacaccttatagtctaaaggtaattttatacaatatttttaatgattttgtacaggatacaaagttttgagccatagcatgaggtcacatgtggaattttccttttgtggcatcatgtaaatgctcagaaagtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagtctgccaggttgataaggtgaggaagcatattctaggcagagcgaagagtgtgcacagaggcacagagccagagcatgggatgttcagggaactatgggtattgagtttaactggagccaggtgtctgggctgggcagtccagctggtaaaggtaagtagaggatcgtatacatttcagggtttagagtacactgtactctaaatagtattgaaatattttcaggtgcccaccgtattttcagttttgacactagtagccatgtggaggtggaattgaaagtcagtgagtcggaactgaagacaccatcagggtgcctggtggagtcaaagtagcgtgagatacagagcagtggtgagacctttgtggtacattaaagggagaataaaaaggacctggtggttgactggaaggcccaggggaaacaccaggcacttcttgggttatattaggccagactggtgtgagagctctcctttcctgtgcacccagcctgcttttctttcctctttaaagctgccaacacccactcgttccctgcaggttttctgcggtattctgtagagctgtatctccctagcaacaccttttgttacactgagagacaggcatttaggttaggccaggccttttgcttaaacacacacacacacacacacacacacacacacacacacacacacacacacccttgttaaaaaaaatgcatgttcattgtagaaaataaatattaaaatgaagaatataaaaactatccataatcttaacatccagagatttaatcattgttaacattttggtgtagctcctttagtctttttgtctgtgtgaatagaatagaaagcatatactttttctcatgattttgggattttccagaatctttagagctatggtttctggtcagtaattctgccctttgctgaagttgtagttgaaagcactttcttttttttttggtagagacaagttctcactatattgcccaggctggtctcaaactcctgtgctgaagcagtccttgcacctcagcttcccaaagtgctggaattacaggtgtgagcttcttgtacccagcctgaaagtacattttcttccttctgactctacttccttctaggtgggtcccggctcactaagttctacagatgccttttgccccagaattctggggctgaagtcccagcaatagatttccattatctaaatatggtaatttgcaattctgaggaccttcaggctgggcgacagccacctctgtgagcctcactcagaaattgccaacaggtggccaggtgcagtggctcatatctgtaatcccagtactttgggaggccaaagcaggtggatcgcttgaggccaggagtccgagaccagcctggccaacatgaagaaaccctgtctctactaaaaatacaaaactaggtggttatggtggcacacgcctgtagtcgcagctgctcgggaggctgaggcacgagaatcacttgaacccaggaggctgaggttgcagtgagccaagttggagccacttcactccggcctgggtgacagagtgagaccctgtctcaaaaaaaaaaagtgttgccaacaggttaagtaatgtggagtctgaaaagtagtcttaggtttctgagggcttgaaagtgttgccaacaggttaagtaatgtggagtctgaaaagtagtcttaggtttctgagggcttggaattgaataggagaccagtggacagaaactaggttttagtaggttatagaataagtaagaggaggggaagtggaagttggaagtatagactcttttaagaaatttgtcttgaactaatagagaaagatgggtttgtgaaacaaaggggtgagaactgggatgtgagaaatttgggaatgttttgaataaaatggaacattatagagacttgtgagaaggcagaatcaaggaactagaaaaagcctgtgtttacgtttgtaatgcttctttaaaaatctcaaataatgttgtatgctaataaatattgatagttattaaatctggatagtaaattcttggagttttgctgtttttctattttatattgttagaagtatttttttgttgttgtttttgttttgtttcgttttgtttttttgagacagagtctcactatgtcacccaagctggaatgcagtggtgcaatctcggctcactgcaacctctgctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggtaatgtcaaaaagttggaagcaggagttgccatcaacaaatcctagtacggcaaataactggaagttaaatgttgtcttggctttcttcttgcctaaattatttttatgctgatttatttttaatggaagctggtatcttatttattaagtacgtgtgttgatatacaggactagactcgctggattctggtaaaactgttgataataagttggagagtccattttaaataacctggccaggaggaaatcttttccagaaatcaaaatggtgaaaagcaaaaatattgtatgtacaatacaagtagttttaaaatagtgacacttacatcctccggaaataatattgtttttaaatgggtaatgggaagttaaaacttcttttgttgtgaaagacttcaaacatacataagagtagaagaatgattccacatatatataaagttagtaattattaagattttgctagaccaggcatggtggctcatgcctataatcccagcactttgggaggctgaggcaagaggattgcctgagcccaggagttcaagaccagcttgagagcttgtctctttaataaaaaataaattaatacaacaaaaatttttgccaggtgtgatggcatgcccttgtagtcccagctacttgggagactgagaccagtggattgcttgagcccaggagctcaaggctgtagtgcactgtgatcatgcctatgaataaccactgcactccagcctgacgacatagcgagaccttgtctcaataaaattaaaaaaaaagattttgtagcacttgcctcatctatcttctttttttcttcttgtcgctgaagtattttaagctgctcagcagatctcagacatcatgtcattttactcctacttacttctgggtatacaactcttaaaacattatggacattttcttatataacaaaatgtcattatacctagttaagtataattaatatgcaatccatattcatttcacaaatgtatgatctactctgaaggcagtagagtggacaccttgaacttttcttgttcctagactcttgggaattggtaacactgccatgaagacctaggtgggtaaggtcattcagatggagccagtggaaaggatgtaccttaaaactgactttctgaagtataattctccatagctgctgctgaagcctggaggcctcgactctgaaagctaaataactcttctttataaatgactacttctcaaggtttcagcaaagatagaagggaaagatgaaaggagcagtatgctaggagtcaaaaggggggaaggaaactctggagattgtcaaggtcagcaaactgcctcgagagaattagttctgatataacacttaacctctccaaggacctctgtatttttggaaacaaggagacactagggaggcagagaaagccgctagggaatgttgttcagagattatactctcctaatcaagctgaactctgttaaccctatgatgtttgccaaaagtgactgactcttctgaatttctgatggcttcatatcttatcctttcttatcttttccattctaagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgtagattttttcactattgctccttatttttatgtattctttcccctggctgtttttcatggttcatattttatctgttacacagaacatttgtattctgttagaattatctataaaaatgaacaaaggatggaagaaaaaggaagagagtaatttttttcaataaatgctaaatctgtattataaaatgttccttagtcatccaattcagaaaaacccactgctttgaaccgtaactcattattgaaggtaattcaaggttcagaggccataataaaaagtaactggtgaactgttaatattagtaaccaacttttttcaacttcaacaagaatttgttatgtatctgtactcatattttgataattttgtatataatagctagtatatttctttaaaagtttgtttttggctttagaatacgcttttatgttttcatcccagtagtgtattaaaggtgacagtactttgctttaaataaattttgatgttgcagaggtaatttcaggaagtataaagcaatcagagtcaaatttcagaaaaattttggttttataattacaataaaaatgcatacaaatttattttagtgtttgagagactgttaaagatttttttgtaatttgtaatgattatgaggtttggatactcgtagaaaatgttcaagttccctttcttagttttactaatgggtagtttgtcactagcagtaatgaaaaaataactgagtataaatacagttactccttttgcctttttctgtatgattttctttagtaaaagagtaagctgagaggacggaaaaatggggagtcattttttaatgggtatggagtttcagatttgcaagatgaaaaagttctgtagatctgattaacaataatgtgaatatacttaacactacaaactacacttaaacagtgaatatgttatgtgtcttttaccacaataaaagataatgaataacaaaaaaaataggctagacattgaaatttgaaaaaagaaacattaattttatagtttcttttttgagtaagacttagggattcttttcttttcttttcttttctttttttttttgtagagatgggagtctcgctctgtcacctaggctggagtgcagtggcacaatgtcagctaactgcaacctccacctcccaggttcaagtgattctcttgcctcaggttcccgagagctgggactacaggcgcgtgccaccacacctggctaattgtttttgtagttttagtagagatggggtttcaccgtgttagccaggatgatcttgatctcctgaccttgtgatccacccgcctcagcctcccaaagtgctgggattacaggcatgagccactgcgcctggcctcttctttctttctttcttttttttttttgagacagagtcttgccctgttgcccaggctggagtgcagtggcgcgatctcggctcactgcaacgtccacctcccgggttcacaccattctcctgcctcagcctccttagtagcagagactacaggcgcccgccaccacacctggctaattttttgtatttttagtagagatggagtttcactgtggtagccaggatggtctcaatctcctgacctcgtgatccatccacctcagcctcccaaagtgctaggattacaggcgtgagccacagttcccggccacctcttttcttttctttttttttttaagaaacagagtctcactctgtcacccaggctggagtgcagtgatatgatcgtgactcactgcagcctcagtctcctgggctcaagtgatactcctgcctcagtctcctggagtaactagaactacaggtgcatactgccatgcctggctaacttgtaagttttttgtagagatggggtctcactgtcttgttcaggctggtctcgaactcctggcctcaagtgatcctccctcttcagtctcccaaaatgttggcattacaggtgtgagccactatgttcagccagagactattttctttcccttattttatcgtttgttattataacccttgtaaatcccagactattaagaattatatttggaaaacagaggctttgggaaatttctgcttcattgcatagttgtgacgatatcttcatagtgctctccacaaatgtggatttttgtagccctatcagagataaaactgtagtggttttcttaaaaggtataggggagaaaagcctggttatggtaatgaatgtattaggtagagacaatgttagatgaagaaaacagacatagttcaggaaaaacacatgtctttaaacaggtttcattcagaagtagacctctattttggcagataataactattttcctttaaaacaatgcatataaagatgcaacaacaacaacaaaaactacaggtcaatatccctgatgaacataggtacaaaaatccttaacaaaatactagcaaaccaaattcaacaacatattaaaaagatcattaacagtgatcaagtaccattcatcccagggatgcaaggatgtttcaacatatgcaaatcagtaaacctgataaatcacatcaacagaatgaaggaaaaagaccatatcatcatctcaatacatgcataaaaaacatttgaaaaattcattatttccttattataaaaactctcaacaaattacataaagaagggatgtacctcagtgcaacaaaggcagtatatgacacacccacaactaacatcatgctgaatggggaaaggttgaaagctttttctctaagatctggaataagataaggataccaggccaggtgtggtggctcacacctgtaatcccagcactttgggaggttgaggcaggcggatcgctggagcccaagagttaagagaccagcctgggcaacatggtgaaagcctgtctctaccagaaaatatacaaatattagccgggcatggtggcacacacctgtaagtcccagctacttgggaggctgaggtgggaggatggcttgaggctgggaggcacaggttgcaatgagccaagatcatgcccctgcactccagcccaggttgcagagccagaccctgtctcaaaaaaaaaaaaaaaaaaaaagtcacagatgcccatttttgccacttctatttagcattgtactcaaagtcctagccagagcaattaggcaaaagaaagaaaaggcaactgaattggaaaggaagaagtcaacttttccctgttcatagatgacatgatcttacatatgaaaacctttaaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcacaaaaatagggaaaaacaatccccaaatttatacaggaccacaaaagaccccaaatagcgaaaggaatattgaaccaaaagaatgaagctggaaccactgccatggccagtccattgcagggtatcctgcagctgctacagaccgagaagcaggctgctgagaaggtttccaaggcccacaggcagatgaaccgggggctgaagcaggccaaagaagtagcttaggctgaaattgaacagtgccgcctgcagagggtaaaaagagttcaaggcgaacgaagctgaagcactgaagtggagaaggaggcccaggagaaaagatgatcaccctccagacctacttccagcagaacaaggatgaagtcttgaataacctcttggcctttgtctgcaacatccggccagaaatctgtgaaaactgctgcataaatgggtaggagaagaaaaaagcacctgttctatgaattggcattttagatgctctcatggaatatgaagcttcaacatagctcaagttatattcttaaggcattaaattatttctgtatattatataataggtccctccactttttggagagtagcaaatatagtgttttttttttgttgttttgtttgttttttttttttttttacagacttagaacttatctaaagatttcatgtttcttagaaaattaattggtatatgttgtctatttttatatgccttttggttcaagcaacatatatatcagtgttgacattttctttcttagatctaattaaacaaaaccaattttttttgaagaaagaaagtgattaaataatttttccccctaatgcattcttgaattcatcagggctttatctatgaaaaagtagtaaatagttatttgtaacctatgtgaagcaacattcagccttaatctattcctgctaatgattagaacaacaatattggtatagttgtttgggttgcttttagtttctcttaatcatgtttactagatgatagaacttaagaacttgttacatcttattacttggtgtatgataatcatttgaaagtcaagactctttgtcatgcaggaaaaaaaaaagaacaaagctgaaggcatcacactacctgacttcaaaatatactatagagctatagtaattaaaactgcatggtaccagcatgaaaacagatacattgatcaatggaacagaatataaagtccagaaataaaaccatgcatttacttacaccaacttatattcaacaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgatgagttttttgatacaaccttaaaagcacaggcaacaaaagcaaaaatggacaaacagtattacgtcaaactataaagcttccccacagcaaaggaaacattccacagggtgaagaagggacctacagaatgggagaaaatatttgcaaactatacatctgataaggggttaatatccgaaacacagaaggactcaaacaactcaatagtaagaaaacaacctgattttctaaaaatgtgcagaagacccgaatagatttttctcaaaagaagacataaaaatggccaagtacagtcattcatcacttaacaacaggtctacattttgagaaatgtgttgttaggcaatttcatcttttttttttcccttatgatccaacagaaccaatggtgtggtgatttcatctttgtgcaaacatctagagtgtacttacacaaacctggatggtatagcccactacatacctaagctgtatggtacagcctgttattcctgggctgcaaacctgtataggatgcgattatactgaatactacaggcaattggagcacaataataagtatttgtgtatctaaacataggaaaggtacagtaaaaatacggtatcaaagataaaaatggcacatctgtatagggcacaaaaccatagtggagcttgcaggactggatgttgtcctgggtgtgccagcgagtgggcagtgagggaatgtgaaggcctaggacattattgtacactactgtagactgtctttttttttaatagaattttgttcttttgcccaggctggagtacagtggcacaatcatagttcactgcagcctcaaactcctgggctcaagtgatcctcctgtctcagcctctcgagtaactgggactacaggcacatgccaccatgcccagctaacttattttatttttttgctattgtagacttgataaacattgtacacttaggttacactaaattcataaaacatcatttcttcaatgaactgtagcttactgtaagttttttactttttgacttttgtaataacacttagcttaaaacacaaacatattacacagctgcataaaaatgttttcttctatgcttatgctgtgtaaaccttttctgtgtttgaaattttttattttttttatttttaaacttttttgttaaaaactgagacacaaacacacatgttggcctaggcctgtatagtgtcaggatcatctgtattgctgtcttccaccttcatatcctgtcccattggaaggttctcagggaaagaacactcatggagctgtcatctcttatgacagtgccttcttctggatactcgctgaaagacctgcctgaggctgttttacagttaactttttaaaataacttgaagtaaaataataataaaaagtatggtaaatacataaaccagtaacagtcatttttttattatcaagcatatgtactgtacataattgcattgctatgcttttatttaattatttatgagacagggtctcactctgttgcccatgctggtgtgtggtgatgtgatctcggctcactgcaacctccgcctcctgggttaaagctattcgcgtgcctcagcctcccgagtatgggattacagtcgtgcatcaccatgcctggctaatttttgtattttcagtacaaaatttctctactaaaaatacaaaaataagcagatgtggtggcaggcgcctgtaatcgcagctacttgggaggctgaggcaggagaattgcttaaacccagaggcggaggttgcagtgagccgagatggtcccagtggactccagcctgggcaacacagcaagactccatctcaaaaacaaaaaataaaaaaaattagccaggagtggtgttgtgcacctgtaatcccagttactcagaggctggggcaggagaatcacttgaacccgggaggcagaagttgcagtgagtcgagatcacaccactgcactccagcctgggcaacagagtgagactgtctcaccaaaaaaaaaaagctcgacatcattaatcatcagggaattgcaaatcaaaactacaatgagatatcaccttcctcttgttaggttggttattatcaaaatgacaaaagataacagatgttggcaagaatatggagaaaagggaacacttatacactgacggtgggaatgtaaatttgtatagccatatggaaaacagtatggaggttcctccagatatgaaaaatagaagtaccagatgatccagcaatttcattactgggtatctatccaaaggagatgaaagcagtgtgtggaagagatatctgcacttccatatttattgcagcactatgcataatggccaagatacggaatcagcctcggtgttcatcagtggatgaatggataaagaaagtatggtatgtatacacaatggaatactattcaaccataaaaaagaatgaagtgtcatttgcaacaagatggaggaatctggaagtcattctgttaagtgaataagccaggcccagaaagacacatactgcatgctctcactcatgtgtggagtctaaaaagttctcatagaattagagggaagaatggtggttaccagaggtgggggtgcttaggcagagggaaggatggggaaatgttggtccaagaatatataattacagttaggaggaatgagttcaagagagctatcatacagcatggtgactatagttaaggacaatgtattgttgaaaaatgcagagatagttgaatgttaataatgttctcaccacaaaaacaactatgtgaggtaatgctattattaattagctagatttaactattacataatgtatatatactccaaaacatcatgttgtacatgataaatgcaattttttctgtcaattcaaaatgtaaagtaagaacatttaaaaggtacatctccaacctccacatgctttccttgcccagtctttctctcctgcttgtctctctccctgtcagtatgagacaccctctctaggaagccgctgtcatcctttacaaagaaggagtccagaatctaaaatcttacacagcctgcttcaggcagtactgaagcctggacttctcagaggccacagtagaggccagttgtagcaaatttggttgaaaaagcaagaattatttttaagtttttctaaccacctgagctccatttgcccagttgtgagattaaacactttcttcgggcaccagcaaatcatggccaccagaaaataaaatcaaatacaaaataataattaatgggagaggagcagtggctcatgcctgtaatcccagcactttgggaggccaagtcaggaggattacttgagcccaggagttcaagaccagcctgggtcaaggtaagactccatctctacaaaaaaaaaaattagccaggcatggtggcacttgcctgtagtgctatctactcaggaggctaagatgggaggatctcttgagccctggaggttgattgaagctgcagtgattcgtgatcatgccaccgcactccagcctgggtgacagagcaagaccctgtctcaacgcaacaaaaaacaaaaataaaaaaaaatagagaacaaaaatattaaatgtgtgcgtatttactattggatatggtaatataccatggtaggtattgcctttgtaagttggtctcccctgtcttttgttcctagagctttctcattttctcatctccaagggcttgtttactgcttcatacataaaaagaggccaggtatgatggctcatgcctgtaatcccaacactttgggaggccgagatgagatgattgcttgagcacaggagttcgagaccagcctgtacaacatagggagaccatgtctctatgaaaaattaaaaacttaggccaggtgcagtggctcacgtgtaatcccagcactttgggaagctgaggcagtcagatcacctgaggtcaggagttcaagaccagcctggccaacaacatggtaaaaccttgtctctattaaaaatacaaaaagtagccaggcatggtggtgggcacctgtaatcccagctactcgggaggctgaggcgggagattcgcttgaacccgggaggcggaggttgcagtgagccaagatcacaccactgcgctccagcctgggcgacaagagtgaaactccgtctccaaaaaacaaaaaacaaacaaaaaaaaacaattagttgagtgtggtgacatgtgcttgtagttcaaattactcaggaggctgaggtgggaggatcgcttgagcctgggaagctgcactgcactctagcctgggtgacagcaagaacctatctcaaaaaaaaaaaaacaaaaaaagagccctaatttatacatgtattctcagtttgaattaaatttagcttgtttacttaaaagtagtgttgaaggtatttttcatactatattttaatactagattaaagttgatactaattttatgcagttttaagtattaagactaatcatttgacctttgctttctttacctaaaacatggaaaatactgatttcatagattaaatgagatgatttgtgtgaagcacaagcacagagtttggcatctggtcaatgtgcaataaatgcttgcttttatcctcatagtgaccttccttgatcttaaaatggtagtaattaggctttaagatgaaatggcttatgctggttttaaaatatattgtattcggaatcctttgtaaagtaacaaaaatctacaatgcttagtaggcctccaaagggtatagaggagaaaagctaattttttatagttttataagcaaagttccggtatgtcaggagcttgcttaaaattatatgttttatgcttcttaatttaggtactttagatttctcctagatattttaaaacattgctggccactttgggcataaaaatctaaaatataatctgtaactatttcagatttcatggtaagaccaaactgcattataatttttgtaaggagctaaactcttagactttactatttatgtactctgaccattggactggaactgaaaacaacttaaagatgcaatttggcctggctgtgttaaattagtctgctttgcattgctataaaggaatacctggctggggcagtggcccatgcctgtaatcccagcactttgggagcctgagttgggtggattatttgagctcaggagttcgagacgagcctggccaacatggtgaaaccctgtctctacaaaaaaatacaaaaatcagctgggcatggtggcaggcgcctgtaatcccagctacgccggaggctgaggcaggagaatcacttgaaacttgaacccggaaggcagaagttgcagtaagccagattgcaccactgctctccagcctgggccacagagcgaggctccatctcaaaaaaaaaaaaaaaaaaaaaagaaaaggaaaaagaaatacttgaggctggataatatataaagaaaagaagtttgttttggctcacggttctgcaggctgcacaagaagcatggcaccagtatctgcttctagggaagcctccagaagcttcaaatcatggcagcaggagaagggggagccagggtatcacatggagagagagggagcaagagagaggggaagtgccacactcttcaacaaccagctctcagaactaccagagcgagaactcatgaccattcatgagggatcccccatgacccaaacacctcccacaaggccccacctccaacattgaggattatatttcaacatgagattgggagcggataagcatccaaactgtatcacgttttgtcaaaatgattctgattttgacatctacttttatgtaattcttctttcctgttgcataaaaagcctttttttggcttagaatcttactgcaaattctttatgtgtatttattattttgaaatacatttggctagtaaattatgatcagtttcagtcttactgaaaccaaatacgagattggctttcaaaagttccttccagagctaaaagagtttgacttctataaaggtcatgtccatttttatagtactttaatatatatattattataataagtgaaacatatctcatattggttagaatataaaatgatgccccaaatactataaataggaaatccaagatactgtacagattagctagaaaaaaaaaagtttagctagggcactgttctcaaaggataaagaaccctaattttaatttaagtgcttactggaagcattatcaaaatagattatttaaacccttctggataattaagaatgactgaattataacacttgctttgctttcaagaagtgaattttttagaaacatgaaatttgaccatttacgtttacagtatcagaaacaatgatccttttcccccttttcaattcagattatggatttcagcttatgcgctatacataaaaaaaaggattggaggcaacaacaacatctctttagaagataatggatagtaaatatagaaataataatcatacttggcttatctctttgtaacaaatattttcaacatatattcttaaggtaaaatttaaatgcattgaatttgcaatttgttagccacactatcttaaaaacaaaacaaaaaaaacagctaggccagacacagtggctcacacctgttatctcagcactttgggaggccaaggcgggtagattacctgaggccaggagtcgagatcagcctgacaacatggtgaaactccgtctctactaaaattacaaaaattaactgggtgtggtgacaggcacctgtaatcccagctacttgggaggctgaggcaggagaatcgattcaacccaggaggtggatggaggttgcggtgagcccagatcacgccacttccctccagcctgggcgacagaacaagagtctgtatcaaaaaaaaaaaaaaattaccagggtgtggtggcgggcacctgtaatcccagccactcgggagtttgaggctggaggattgcttgagcctggaaggtggaggttgcagtgagccaacattgtgccactgaaccgcagcctgagcaacagagctgaactctgtctccaactcaaaacaaaaaacaccttcatgggaaggaagtcactcaagataaccgaaatgaagaccaactacatttttcattttgtgtttgtcttactcagcacaatcaaatatgacttttaaaaattaaagtgggccgggcacggtggctcacacctgtaatcccagcactttgagaggccaaggtggatggatcacctgaggtcaggagttcaagaccagcctggcagagatggtaaaccctgtctttactaaaaatacaaaaatcagccagacgtggtggcacatgcctataatcctagctatttgggtggctaaggcaggagaattgcttgaacccaggaggtggaggttgcagtgagccgagatcgcaccactgcactccatcctgggtgacagagcaagactccgtctcagtggggggaaaaaaaattaaagtggaatattttacatctttattcaggtatttgatttataatattcttattattttcagctttaaaacatttgaaatattctaatattctcttaaatgctttttcccctatagaacagacttttgagaatcctgtcttaatacataaatatcaagatagttttcaacttcttgcttagcttgttagtgtatttttattgtagtccttaaactaggtagtacagagatttgatttttcaggagcagagttgatagagcagtctgctatattgtgaattcacattttaaaatcctttattgtcttgaatgcaggcctagtagctttgtgacatgtgcagctatactatgacatcataaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagtttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgtttttcctttaaaaagtagcaataccaagaaaaaaaaactcaagtcttaatttaagtcctgactactaaaacaagctataatctttaatgtatgagaagactttatatagtcattatttttgtggagctttttagagtttttcttgtagcagtggtagatttgcagtagtaaactattaaatacattctctgttggtaattgaggggaactcctaccatgatacctagcagatccggggtgtagtgtattcacacgtttgacagggcacccagtagacttgtccaaagtcagtgttaggaaaagaaaatccccaccatctgtaagaaatagaccttgaggtttacattgtcatttttttattacttctctcgtttacatgctcttttgtctggcacactgggaatctctggtgggttttagaactgtaaaactgaatatgccagctgatgagcctctacagcacagcacgcaggttatgagagtgctgagtgcctcgtccccccgtccccagaggggctgggcagaagctgctggcgcctcctggctggtcagccctggccttgagcagctccatccactcaccccagtgggctgtacacatgtcatcatgttctgtttgtgtaatgacagggaaaaggttggaagtgactgctgaaatgacactaagacttctcaaagtgttgggaaccactaagatgctgtcatcgtaacatttctctggcatatgctaatgctacttaggacttctgatagaagcagtgattcctttacaagttgatagggaagcagatgctgtagggttaacttgtctagattattagctgaaaatttgaaattgtgaaaatgtatggggttgaagctggagaggatgtggaaggaaccatctttgtgccatttgcaaactcaatgatcagagcaagaagctttattaaattcacatctcaggttttagtctttgaagtgggaataatactaaattgccaaactctggggttcctgtgaagacaaaggagataatgggtaaaagtagggggaaaaagacatgctactattggcatgaaacagagaaattaagttaggtgtaccattgtctcattcatgttcattgaactttccctccagccagccccaatggcttcattccctgtgtccttggtacctgctcacagcagggggctggccttaaacctcactctgtgtgtctgtgggggggatgagaggagcagagtcaggaattttggttgagaactagaaaactgcatctgtagaaattagatcttaggccaggtgtgatggctcccacctgtaatcccagcactttgggaggtctaggcaatgagggttgcttgaggccaggactttgagaccagtctgggcaatagagtgagaccctgtctctacaaaagaattttaaaaattagcagggtgtggtggtatgcgctcatcccagctactcaggaggctgaggtgggaggattctctgagcccaggagtttgaggctgcagtgagttatgattgcaccactgcactgtccaacctgggcagcagagtgagactctgtctcaaaacaacaaacaaaaaaaacacatctgtctatttgccacataagaggtcatggactatttcttactttggtttcttaatttgagtctatacagtatgatcctagaaattattctgatgagaagttatagttctgtatgtacagtctgcaggtaaaaattgccatttgttcacacaatgtgaatttcttttgttaaaaatgcattttggggacatttagtgaaatatatgtagataattctttgagaagtgaatactaacaacattcaaactttttagaagacgtttactttaattggagggtaaacatacttacacacacaacatccatttttattgatcttattttttatagaactaacttagcagatattaatgctttaatgttgtagcagaatgtctagaaatggaaacaattgccagtttcctttggtttttgaatagaggaacgtattttattagaatttctggagattttcctatttttttccttccctttgagctgtaaattttttttaatgctctttcataaccttttattataaaaaaaaattttaggtttaattgttcagcttttatccatggatggctttctcccaaactttgcttttatttctttttttccaatattttattagttatttttaatttggaataatgagttagctggtgtttaaaagaactaaatgtgtatcaaagttgaagaaataaagtatattcaagttttcccatatacaagcagttacatttttaatagttgaaagatatttggcagaagttggccttattatattgacttactattatcacaaaaactaaaaagtgaaagttggaataggctgctccctggggagtaggaaaaagcataaaatagacagggatccattattacaacaccaagtaagtgagctgtacctgcagaatcctcactggaagtacagatcttagtgataggtgtgttgcataacagttgagctggtcgaagaaagtcttttatttcagaagcatatacccgagagatggcgggagagagacagccttagaattaacaaagaatgttacttgctgcatgagacagttaagataggcagtaaatgagtgaatttgtaaaagcaaccgaggaaattaaaatgtttgaagcttcctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttcagcctgggcgagaagagtgaaagtccatctcaaaataaatgaacaaataaataaataagaagtgtataacatcgccaggcttggtggtttgtgcctgtagtcccagctactcagaaggctgaggcagaaggattgcttgagcctagcagtttaagaccagctagaccaatatcaggatgtggggcaacacagcaagaccccatctcttaaataaatagctaaaatagaagatatgtctaaattcattcagttaatttcatcttattttttctatcttgatttatgtttattgaaagcacatgttatgctatccttgactattttgaaacctaaacagttttctcctcaaatctctgaatacagacaggcccacgtaaaacctatttccaggatcctgaggcactgggaaattttgtttattgtcagatgagagagaacattttcaatgggaaggtcctctgtcatttgataacaacaaaatcaagagcacctttggcataaaaatgaaaatgaggctgacgtgcctgacttaatcagtagaaatgttttctcactagagccagtgtgtgaggggtgtgtgtgtgtgtttgtttagcttttgttttccatatctaattatataatgacttccccagaaaataaaatgagaaacagattcttgatgtgtcagctgttcatattgtgaaaacaaagttttttgatcagaactgtggggaaacattactgaaaagaaaaaaggaaacgagtaaagcaaaaagaaagagaaaaaaggaagtaaaggtctttgttatctacctatttaggggttcttaccctgaggcagctactctcacctcagattgacttgatcgttatttaaaagcttgataatttggtgttgaaaaactaggttctatgattggaatttgaaaccatacctcatttaactctcctagattcacagggggcttaagttttttataatatcatctgtcatgaggaaatgatagccattcattcattcattcattcattcattcattctattttttgagtggctgctctgttctaggctttgtacttcttttttttttttttttgagacggagttttgctcttgtccaggctggtgtgcaatggtgcaatctctgctcaccgcaacccccgcctcccagattcaagcgattctcctccctcagcctcccgaggagctgggattgcaggcatgcaccaccacgcctggctaatttcttgtatttttagtagggacggggtttctccttgttggtcaggctggtcttgaactcctgacctcaggtgatccaccaacctcggcctcccaaagtgctgggattacagatgtgagccaccgcgcccggcctaggctttgtacttctaatacactgtggttacctgaccttgggctgctctttctaaagcactatttctgtgacatcaaactaattatcaactgaaaaatacacattcaaatatatgaaaacatacacaatttactcatgtctagccacaaggggccaagaaagcagtgtcttttgacattttcatacttgtaagaagttagttagatctctctcaaacccttttactatgagggctgaatcctgagacccatgaaatctttggaaagccatggtttaaaaataccctgtttttaaagtgtgtacagaaaataactgctctaggtgagccagataaagtgctgttacatcagggtgtctcaacctcagttctattgacattctgtaactgactcttcagtttctgccacactggcctgtcagtgaaataaaacacagagaacgcagcatgtggaagtctttttaaaaatgttaatctatcttcctgtgtagacactggcaccttaggtgaaagaagtgaaaatttgttgttgttactctttccataattctcataggtttgtcctatcaggttatcgcctaagtgcttttttgcctagatgcctttaaaaacgtttggaaatgacttgaaaatattcagagtgtattttaaacactactgttacgctactgtaaggtatttacattgatgtatagatgtcatgttattctggtgatgtgtttttaaaatcttcattgtaaagcctagttagctagtttatatgtgattttttaaaaagcatagcctctggtaccatttaatatctactgtttgaagcatgcagttggaatctttatgttaaaatatacagacctttcagatattttaaataatacttgtctattagagtgaaattttgaaacaaaacgtttgatcagttattctttggaagcttcaagtcaattaatatgttaacttttaaacatgactggcagatctcagtatttaaaggaaatctacttcctatttgttgccattagctgtagttacttgagatacttggtagaggtaaatattgtagcacaaatccttttagtaacagttactttttaaggacctttgcaacttgacaatttatatttcaggattctcctgacatagacaaaatggcaaaggttacagttttctagactttagctttataaccaaaatatgtttttatatatatttatatataaatatataatatatgtaaattatatagttatatataacatatgacatatataattataataaatatatattaaaaattttggtcatatatacaacatatataactatatataattatatatagttataattatatatagttatatataatatataacaaattatatataacataattatgttatatataattgtacataacatatatacatatataggtatatatacgtatatatgttatatataattatatattatatataaaatataaataattataaaaatataataattattaaaatatatgttatatataaatacaatataaattatatatataaatatataatttatatattatatgtgatatatattatatattatatataatataatatataatatatatcacatataatatatattatatataattaatatatataattaatataataatatatataatatataatatatatgatatatattatataaatatataaatatattaatatattaatatataatatatataatatatattatatattaatattaatatataaatatattaatatataatatatattatatatttatatatataaaatatataattatatataacatatataattatatgtatgttggtttttttttttagatggagtctctgttgcccaggctggagtgcagtgccgcaatctcagctcactgcaacctccaactcccgggttcaagtgattctcctgtctcagcctcccgagtaactgggactacagacacctgccaccacacctggctaatttttgtatttttagtagaggcggggtttcaccatattgatcaggctggtctcaaactcctgacctcaggtgatctgcctaccttggcctcccaaagtcctaagtttacaggcgtgagccactgcaccttgcctatatatttcttaaaaactactttcttttgatgacaaatcagaaaagtagttagctgaatgaaggtagaaattcattttaattgcaatattaaatgggaatttttcttttcttttcttttctttttttagagacagggttttcctgtgttgcccaggctggccttgaactcctgggctcaagtgatcctcctgccttggcctcccaaagtgctgggatcacaggcatgagccaccacacctggccttaaatgggaattttaaatggtagaagaatggtgtttataaggaaaaacatctgagagaatggagaaaaccaggaagctggactctccctgtctccttctccactcttcctcttgagtgatgtagtcagctggatgctaaggaggaggaacactccatgggctctatgaatctcaaacatttctgaatataaaatattttcaagtgtttataagcttttcctagagtatcgtcccatgacgaagctgatcttccttctcaattcagcatagaaaataagggtaacctgagaaagaagcaatggtaataaatagacccagagtatattcttccaataggggattattaaaaataaatcttgaaattctctaatatttcttttctttttctgttaagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaaggtatattttattaatctaatacatttagaatacctatggattactatatcacaccattgagtggtgattttatagttttttgaaatagatcgaaggtagatggtggggggttgggaggcacttaaaaaggcttacagaagaaatattttaatacattaaacagcaaattaagttttatcatttttcgccttttagcaggttttactggctctggagaaaggccaaattcagagtagcatgatagaaaaagagagatagaaacatgaatgaattttttttttttttttttgagatggagtctcgctctggcgcccaggctggagtacaatggcgtgatctcggctcactgcaacctgtctcctgggttcaagtgattcttctgcctcagcttcccggggagctgggattacaggcatgagccaccacgcctggctaatttttgtatttttagtagagacggggtttcaccatgttgggcaggctggtctcaaactcctgacctcagatggagtcgtcctgacctcaggtggaggcctcagcctcctaaagtgctgggattacagacgtgagccaccgcacccggccacatgaatgaatttttaaattaattagatatccttcatttgggggttgcaaatgttgtacctaatagatttctattacctaatctatgacaatttaagtattcaggctatgatgccccaaatttgtttttttccctagctgttactttcaagtctaatttctaggcaactcatttcaaaacaaatgctgactttgggttttttgtttttttttgtttgtttgtttttttgactgactgttcttagttgtttgaattctgaagtatccattctagctcttatggaagctgtcagtaatgaaataaaagttgagatgtagccctaagcttttagggttacctgagatttcaactggatttgcgttatacattattttaattcagttgtgcctatgataactgtaatagatgtatttaatacagctttcaaaactcctgtgttttaattgaattctattcctcttggtccattcgcttaggatttaggatatagcactattttttaaaaatttgcttgcttgtttgtttgtttgtttatttatttatttatttatttatttttgagacagagtctcgctctgttgcccaggctggagtgcagtggcgcgatctcggctcactgcgacctccgcctcccaggttcaagcaattcttctgcctcagcctcccgagtagctgggactacaggtgcataacgccatgcccggctaatttattgtattttagtagagacggggtttcaccgtattgcccaggctggtcgtgaactcctgagctcaggcagtccacccaccttggcctcccaaagtgctgggattacaggcagcactaacgttaaggaaagtaaaatcagttattttagttcgaatgtcttgcaggtatgataagcatattataattgatgagtctcttgataattatactcaggtattttgggggttaatgtggactatggtaaaagtgtgtgaagaactgaggtggtggcatttatggagtaaaaaatgcatagtacaaacccagtactttaatgttttcttgaaatgtaaaatgaaagccacctgttctattccccccatactcatggaccatatttatgtctaggtgaataatcttaaagaataattatttcttctcattttatctttgttacatggaagaatctactgcaaacaacagagttttgagaatttttaatgttttacacaatatgcacgtaagtttgtgccttggggtttttaagaattttcttccacaagtcacaaagatttttttccacattttcttctatttgctttatggttttacctttcacatttatgtctttaatgtatctgggcttcacttctgtatatagtatttggtgggaattcatttttaacttttttctccgtatatggagccactcccaagggtttgttgtttcctcactggtgtatggggcagccttaattagacagtgggtttgcttttgcacctggatctggccagtcttctgtctgattcatctttttctgaatcccagcgccatacatgtttgttatctcataaaacaagttccccttgtcttttttctcagtttgatacagagttagttttttgtgcacgattattctttcatatgcatttggaataagtttgagtttctaaatagtagtagtaataataataataataaaaccaatgatgagactgcattaattttttttttcttgagatggagtctcgctctgttgccctgcctggagtgcagtggcacgatggctcactgcaagctccacctcccgggttcacgccattcttctgcctcagcctcccaagtagctgggactacaggcgcctgccaccatgtccgactaatttttttgtatttttagtagatacagggtttcaccatgttcgccaggatggtctcgatctcctgacctcatgatccgcccacctcagcctcccgaagtgctgggattacaggcatgagccaccatgcccagccaagactgcatttaatttagggagagctgaagtcttcataatgttaagttgacctatcccaaaccatagaaagtcttgtttattcagatctcattttacttcttttaacagttgaacatttttctttttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttatacaaatagtgatgttttgtttcctcccttccaatctttattcctgttttctttttctctttttttcttttccttaaataatcatggccaggagctccagtttaaacacagcaaggccagtgggcattcttgtcttcctgaacttagtggcagtgttccctgccctccttctcccttcatctcactgaagggccctgtcagcttctttgtggattctcagtgcctgtcttggctgatgcctcagcagtatttaacactgtcgacttctgcttcctccacttcctgagactgtgtcctccttgctcttctctctctgctgcttctctgtcagtcctgttgctgggctaagcttcccctgcccctgtcctgagtgtttcagtgatcctcaggctcactcccccaccctcttcctgctgagctccctccctgaaggactccctcccacgctggcttcagttcactgtgactatgtcctgactccagctggttccttagatggccacacatacctctgactcctaaaatccactcttcctatcttcagtgattgaccactactatccttgatgccagaaacctaggtgttgtccagtattcttcccagtctccattcaaagtcactgtgtagattcttctgcctggctgagccatgaatgcttctgccactccacagccctctgtcctggccctggccctggcctgggtgctatccctctgacccaggctacccctgtgggctacagtctccggcagccaccggaagctggctattgtggaacagctttctgatcctcctaatcatgccagaggcagcagctcccttcttggctcagttttttgggaattgttcctgaaagttcagctaaactcttcattcctcacagtgattctgggagccactgatagttcttaaaaacagcagtttcttgcccccaacatctccattactgcattgcacttgttttgttttgtttcgttttgttttgttttgagacagagtctcactctcttggccaggctggaacacagtgatgtgatcttagctcactgcaacctctgtctcctgggctcaagcatttctcctgcctcagcttcccgagtagctgggattacaggcatgtaccaccatgcccagctaatttttgtatttttagtagagacggggttacaccatgttggccaggctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagctaaaatgtggtgggatgtcctttcattgacataaggttgggttgaattctaatcatacaagggaaagggctttgggtgcggtggctcacacctgtaatcccagcactttgggaggctgaggtgggtggatcacctgagatcaggagttcgagaccagcctggccaacatggtgaaaccccgtctctactaaaaatacaaaaattagccaggcatggtgggcacctgtaatcccagctacttgggaagctgaggcaggagaatcatttgaacccaggaggcggaggttgcagtgagccaagattgcacctttgtactccagcctgggggagaatagcgagacttcatctcaaaaaaaaaaaaaaaaaaaaaaaaaaagacaaaaggtctcagtggcatgtcacttatttttttgcagtggaaatgccaataatttttttccaggctatggtctgttctatggttgaacattcgcccatttttgtgtctaaccttataatcactgaatttcctataatgatccagctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgttttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggctttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggtttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccac

SEQ ID NO: 36932 - DNA, 40933 bp, Homo sapiens
gggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggtaggccacagaaaaattatttccaagccttggccttgttcagctggctgaggggaaatgactgagggaggggaagctccagaggtactgtgtggcgggcgaggggtggggggagagagggaaaatgagtgtgtgtgtgcgtgtgtgtgtgtgtgtgtgtgtgtgtgtacgcgtgcctgcctgcggtctgcttgcatgtgcctttagtggaaaacttgcatttaaaaatgcccacaataaagtagtcaccatttagattcataaagaaaaaaaaaaagatgcccaagaatagaaactcaagccgatttgagcaactaaggtctaaaaatgaataagaaggaggtacacagtttgcttctttgagaaaagaggggcatttatttattttaggttctcaatagcatgctttttgtccaagggtatacttcttggcaggagggaagcaaaggtgtgtggaaagccttggctaacaagggaggagagaggaaacatgggaccttggagcaggttccctgaacaaatgagtattctggccagcagacaggacacaggagttctttgctgaagtaaaccaggctctgacctaagagcctggagctgaagggctcatctcatctctgtatttacttcctggctctgttgtttttcctgtgacatttttcccccttatcttctcccctggtttcctttctacaccctgtaatcaggaggcatctttccactcttgaaagcatagcttggagtggtttcaaatagggcttgcttctcttggagtccaacaccctatcaccttctgctctcaccacctttcccagcatcggaccaagtgccccagcctagtaagtgggcctgagactatatgggtagttaatgtttatccttcctttggtaggcaggtcgagccaggcctcacaggtgttgggtctaagcaggtggcaaggctgggctggggtggggtggagtggggtagaggagaacgtcagcagcagctgctgcctgcttccgttgaaagcatggtgcatgctgtctggaaaagaacatactttttaaaaatgttttctttttgattgtcaaaagaacaaaagccttaaaaaagctctatgtctagttcatcttaattcctgacttttccaaagaatccttgtttctagatgaaaggccctcaggtaaatcaccttttaaaaggcctgtgggaaccacaagcctcaggtgattttccttctaaggtttgcgtggggagatgatcccagagaatctcagggccttctaaggaaacctccgtgaaaaggcagtgttggaagtggcagtgttgtgtcctgtttctgaaagaagaccaagcccctctgtctctgggttggcaggcctctgtcctgtagtcttgctttctgtaaaccattgctgggggatgaaggcacatggaaagaactcctcttcctgtgagatttgtacttctaggcattcagcctcagctaagtagctctgtgctccaggtcagattacccttcaagtccaccataaaggaggggagcatagcttgaagcaatgaatttagcaaaggccctgagccagatgcggagagcacatctgcgattcagcccttctaactatggatgctcagaagtttctgatgttggatctgccaccatgccagctaggatggggtctcactaatgaaggccaagaagatagtcttctaaacttctcagggatacacactcagaggaaacccattcagtggaaattatactatgaaatgacattcctcccttatgaaggattctaaacatgcatcagcaacaaaaatagcaagtgagataaatccttctaggatagcatttaccaaaccaatgttctatagagccccatcctgagagaatgttaatagattctgttttaaaataagtgttgggggtgtgtgtgtgtgtgcatgcatgtgtgtgtattctgcagttcaatacttttttggaaatgcttcttaaccgaattctcattttggagagtcacagtgtatgtaacgcatattaaagactctgagaagtactgctgtaaatgaatgtttaattttgtttaacccagtacatcccagactggtttgaccagggaacacttttctgtatggaaaacactttttgcctcttgcagatacagtttggggaactgctgctaaaaaaaaataataaaataaaaaataaaaaaataaaaaactggaagaaatcgtcacatggataacacttgtaaaataatctagtccaacaatgcatttctaaacatgaaaaacccaagaggttaatcatattgttttccttcccatagctgatgagaatctgggattatctcctgattccccagcccactgtacccaactgctgcttctctagcaggtcccctcctgtgaaactagttccaggaaaatgaagcagatttaaggaataatccttaaattttgagtgcaatatttacatttaatacatttcttctagtattttgctatatgcaaaaattgtcaactttcttttcagcatgggctttgttgcattcttttaaacaatgtgttatgaaatatctttgttcattcaaaaaggtataaaaataatatggtgaaaatcaggttattcactgcccagcttaataaagaaacattaccagtagagttgaaaccttctgtctattctccatgattaaagttctctctttccttccaaagtaaccactatcctggatttggtgtttattattcccatgcattgatttatatacttttactacacatgtatatatttttaaacaacatatactactgctttatatgttttaaaagtttgtatcagtggtgtatcatacgtattcttctgcaacgtgatttctcttttcttttttctccccgccaagagacgagatcttgcactgttatccaggctgaagtgaagtggtgtgatcatagctcactgcagtctcgagctcctgggctggagcaatcctccagcctcaccaccccccaggtggcaccaccatgcccagctaattttttttccttcatagagacagggtcctgctatgttgtccaggctgatctcaaactcctggcctcatgtagtcctcctgcctcagcctcccaaagtgttgggattacagccatgagccactgcacctgccttgaaacttattttttctattcaatgttatatttgtgaaaagcatccatgttgtaacacgggtctctagtttactcatttttttcactattgtatactcctgtaatgactataccacactttatctattctgctgttgatggacatttaggctatttctagttttgagcaatcacagaggtactgtgatcattcttgtgtagctattcttaggtgacaatttctactgggtaaatatctgggtggaattgtccccttacagggtatgtgcattgtcacctttgggagatattgtcaaatcactgtgcaaaatagtttactaacttacactcccaccatcagtgtataaaggtttcaggtttattgcattaattggctcttagagttttctcccatggggatgcatctctgattttttaattggataataaattttatttctcaaaattgcttgacagctaaacttctcaggaatacgtttccttgttttcatttgtaaatgaggggattggcctagatgatctcaaaggtcctttctagcttgaaaatctgagtttctatgatttattcattaaatcaggtacatctgaagcagaaccttggttttttgggtgcattgcaggaattattttaggaactataacaaagtttgttaccagtgaaatgtgtatcttctctcttactgccatgctgtcaggtagaaagccagtggtatgagagaaaaggcagttacacagtgttaccttggattggggagaggattctgtagcccatgggaagggggtcgccttcccattgccctgttctttacagaacctctacatcttagaagtcttccctatctcttgaattttttctcccaagaataataaatgtttgctgggttttttttgttttttttttttttttttttttttttttttgagatggagtctcgctatgtcacccaggctagagtgcagtggcacaatctcggctgggaggctgaggcaagataatcacttgaacccaggaggcggaggttgcagtgagccgagatcatgccactgcactccagctgcactccagcctgggcgacagagcgagactccgtctcaaaaaaaaaaacaaaaaaaagcccaaaaaacccggatgtccaggcttcctttctgcgcatgcgcacagtagattttttaaaaatgtttttacaaaattggagttccactaagcatgctattctggcatttgttttctttggcctaaaatatataactttgaaatctgtccaaatcagtgcatatagatctacctctttctttttaacagctacataatattcgccgtgtgagtggctatcgtaatagataacatttgaatatctactaaatgccagaaactatgaattaactcctctcaacaaagctaagaggtaggtctttttgttatccctgtttcacagatgtggggactggagcacagtaaggttggggagcttgtccatatatgtgccgataagtggccaaggtgcaagccagagcatcctggttcagagcctatgtcccagacaataatgctgtgatatgtctcagacatagtctactcaccagtcccccgctggtggacatttgagtgaatgcagatttttgctattgcaaacaatactgcagcaaacatctttgtccacttctggaggtctttttgtaacataggctcttagatttctctggtttctaggtggaaagagcttatttattgaaaaaaaaatttattgagctctaggcattggggaggctctgagcttaaaataggagacttgaccagaatttcacttctcagatgtcctataaaggtcacttaagtgcttttcatgatttgccagcctggtgctgccccattagactcactgcatcttatctgtttttaattgcttgtgtctttgcctgggtagtggcataactgagtcaatgcttgggctcgcacctggtggtctatagccaaaaattgtctccattgtatccattgtatggatacactttccaggtatcagtgattacaatgcctcagagcctgggttctagaatttacagaggcagaatagcataatgataaataacttgtattctgagacacaactgcctgggtacaaatcccagctcttcacgatgtattcacaatatgactctgaacaagttacttaccatctctgtgcccccattttctcatccacacaatgaggatagcaatagtaactactttatagggttgttgtaaggattaaatgagttaatgtatgtagactgcttagttaatatatataaaacacagaatacagttattatttatttgattatggaaaagctggcacaccaatctttccataaaatagttgttgacctccttgtattttggtggggagcggagagggggcgaagaattagctgttattaaataggtaatgtgttcacatgggtcaaaattcaaaaagtacaaaatgatatttagtaaaaaattttatctcctattggcaacatggggcttatgtggtgtggggaataattctgtttctcaacctgagaagtgattatatgaatttactttataataatttaatatactttacatatatgctttatgtacttttataggtatatttctcattttgaaaagggcagaaatagtagaaatcccaaagacatggggagaatttttactgctcagttcccttctccaatggtaacaggctcttttgtatacttccaaagatatttttttgcatctataagcacatatttttagtatacaaatgtagactaaccaccaccttgatttttctcttgttttctttttacttaaggtatatcataagagatcattttgtattggcatataaagagttcttaattattttttaagtagctgtatagaattccattgtatggatacaccattatttaattagtcccctagtgatagacgtttaagtttttgcaattttttttgccatttcaagccttgtttcaaatgctgacattgtacttattattgtacttgtttcaaatgctaacattgtacattattccacacaaatttaagtagcatatgttcctatacatctccagtttatgggtgcctagcactgtgttaaaaatatgtgggatataaataaatatcaggtgtgggttttgtcccccatgagccaacaatcttgctttcatgctgaaatcctaatatctcccctgtgtttttaaagctttttatctctgctcaagagaaacaatgccttcccactgaatcctcctcaaacagcctgtgtatggcttttagaaccaggaagagtatttgtagtagcaaaaagccacagtttggtatccagcagggtccctaggggagggcagggaaggcttattgccacccaaaaagcatcctccacacctgcatatgtcaaaatcttctctttcaccttagctcgaaagcttcttttccataaatacatcccaaatccctccaactagaagtgaacacttcctcctctgtgacctcttataccataatttctgtgtcttgctgtctcagtccattttctgttgcttataacagaatacctgaaactgagtaatttataagaaaaggaatttatttcttacagttatggaagctgagaagtccaagtttgaggggctgcatctggtgagagtcttcttgctgtcataaactctctgaagcatcccaagatggcacggagtatcacatggctagagggcttagtgtgctagttcagatatctcttcctctttttataaagccatgaattctcctcccgtgataacttattaattcattaatccatgagtggattaatccattcatgagggcaaagccctcatcacctcttaaaggctccagctctcaatactgtcacattggggacagatattcaaaccacagcacccacgtatggtatgaataattttccccgctaaaattatccttttttttgtttgtttatatgtcttgtttcctacatttgaccagttggggaccaagtctgattcatcttcaatctctcatagcctttgcaaattaaaaagaggaataggaaaaaaatcagtatgtgcagatggtgatttgagataggatggagctagatagaggcagaagaatctttgtgtataacaaagagtactcgcccaggaatcaggaggccctggttcacttgtgtctcagcatcttcatctgtaaagtgggatcttaattctgactgggacaactttactaggttgtactgaggatcatgaaagacagcacagccgactacaaaggcatgctatatgaatacagagaatgatagtgtttggtgcttagcaacccttaaacattaacacttgatacattagcaaactaaggcctagagaggcaatatgacttgaggtcacagtcaggggcaaagtctaaaaagagcagaggatagtcattttaggaccagaagaaatctattccttttctgcctgtgttaggattagaaggtctgaattctctgactccttggtttatcttagttttgttttgtgaagccttaacctagcatcaggtcagtagaggaataagaaagaatcttataatctggagagaaatgaatctcaaaagagaagaaaagagatagttgatgaaagaagagatacaaacgaccactaaaagtgtggaggaaaagctaaatatctttagcaattaaggaaacgcaaagtaatcctcaaaatgccattttcacttacaaagttggcaaataaagtaagaatacatactgtggacaagtgtgctgggaaactggcactctcatacattgctagtagtagtgtaaaatgatataactttttctagggcaatttagacatatgtatcataaacgctttgatccaggaattctcccttataggcaattatcctatggaaagaatcacaaatatgcacaaggttgttcactgcactttgatttataaaaaagaagaactataaacatatgtctaattgttaaactatggtgtatccattcagtgggatactatacaatgacgatagctaacacttattgagttgtgtattgttgccagacactgtgctaagttatttaaattattaactttaatcattagaataattctgtgaggatgctatcattatttatccccattttgcagatgaggacactgaggctcagagaggttaacttgtcctggaccacactgctaataggttgaatagtgtggatttgactctaggtctgtctgatgccagtgcccatggcctcagtcacagtgctgtacttcctatgcagctgttaaaaatcatgttttaggctgggcgtggtggctcacacctgtaatataaacactttgcgaggctgaggcaggctgatcacttgagctcaggagtttgagaccagcctggcaacatgacaaaaccccgtctctaccaaaaatacaaaaaattatccaggcattgtggtgcacacctgtagtcccagctacctgggggtactgaggcaggaagatctcttgagcctgggaggttgcagtgagccaagatcacgccagtgcactccagcctgggtgacaaagtgagagaccctgtctcaaaaaaaaaaatcatgttttaagggaatagttaatgacattctaaaatgaccatgatataatggcaagtgaaaaaagcaggctacgaaatgatagcatgtgatggcgattttattttaaaagtgtatgtatatatttttcagagaaaaactaaagttcatagctgttagtaatgattatctctgggtggtaatattacagattatttttattttcatccttattattttttgtatttcccagtttttctatcaagaacatgtattacttctataatcagcaaaaataaaaatgttaacataaaaagaggtctgaaagcaagcctcttgtagcctttatgcttataacacatccatagcagtacttcattttttaatctaagtgactaatgcttttgtggtgtctgatcacagaggagccatattttcagtcattctttggggatgagtagctacatagctgtataatctatagggactttgactacaacaaagtaccctttagaccacaacctcttgtgcccttgtgatttgtaataatctccattctttggactatggtctcctgaggaggaggggtgggtacttaatgcaaggagtccacatatctttaaatgcataaatgtttttctcactcggtaagttctaaaagtacagctactattgtgggtgagagtgggtgaagtgagattttttttttttagtcttaagaagggcctcttatatctaaaacattgtgaaccactggaatagagtctaaaaatggtggttatttaattatctgcatcatgaataaaagatgctcagttccggccctttgaatcagggtttgtgtgtctttgccccacactaaaagagatcaccttattatttgcaagcatcatctttgccacccattctcatcacatttgtttacattctctaaaccatcaattggtttgtacatctaaactttgtccccatatttctcctttactaagcttagctctttacatctaaagctgaatatgtctcaagcatagcttattatgcaacactgcccctattccctacacagcaaatttactctttctcctgtcttccttctcttgctgttggcaacattatccactcagctcccaaattagaaacctttgactccttctcctcccttactgttcacatccaattgatcatcaagcccagtgtattttacctctccaatgtacctcagagtcatgctgtctgcttcatcctcacggcaactgcctgcctattctaacagcttctcaacaggttcttccttttggagaatcactctataaggaaggcagggggctctttctaaaatgcaaatctcggccaggcacagtggctcatgcctgtaatcccagcactttgggaggccgaggcgggtggatcacctgaggtcaggagttcaagaccagcctggccaacatgacgaaaccccatctctactaaaaatacgaaaaattagtggggcatggtggcaggcacctgtaatcccagctactcaggaggctgaggcaggagaatcgcttgaacctgggaggcagaggttgcagtgagctgagatcgcgccactgcactccggcctgggcaacaagagcgagactcccgtctaaaataaataaataaataaataaaataaaatgcaaatctcattatgtcactccctgcttaaaatcttcagtgcctccccattgtctacaagataaagcctacaatcctctgcttgtcattcaaggcatggcccaatgtggccacagcctcacctcctgctacacacaacaaggcacctaccttgtactctggtcacacggaacacaccatatatttaattttcatgtttgtattttttttaaccttcactgcctaatgacaaatctgtttctctttcatgactcacctcaagcacatttcctctagggagacttttcttgacatgaccagatagaactcacgattccctcatctgtctcttcacttcatcccataaacaattccattatgacctcaaataacactttatggccattattttctccacatttgttctctctgtatgtgatactcctcaggggaagcccccatgtctttttcatctctgtgcctcttaaactctaaccataccgatcccattgtcctctgaacatgctaggcctttttatgacatccacctttgcacaggtggatctgtctgctgggaatgccattctccctttctcctctgcacaagcaaatatctacttatcttttgagactcatctcaagtgtgctctttctgaaatacgtgcatattctcagagttagctgttccccactctgtgctcccttagccttttggtaaactcttgattttagcatttgctatgtaagcattttattataattatcagcatacatgactgcctcccctacccatcttgcccacctccacccttaggctttgagatctcagcagttatctttatgtctctagcacaaagcactataggtaaacaataaatgcttccttggtcaataattaaataaagtattttatggtacatggtggcctgggtaggtcagtaagttttgaatacttatttgtatatctggtcaaggcacctctgggtagatgcttgattcataggcttttctaggtcttgactcgaaatctctctgtattgcttttccaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggtaagagtctgatagtgaaagaaagacctgtggagaaagtggacacaggatctgtgtgtccttggggtacccacgcttcctaaggctcaggggcactctctgtatacatgcaaccccttggatagcatggggaatatattgggcccatcctttattactcattatgtcttttattggggggcataaggaaaggaagggtgttgggctgggcagctcagagggcccactgcagctgagcggggctggttccatgttaaccttctaagagttacaggtccaggaatgtcctagaagagtatgatccttcagggcatggtctaggactaggcaggtccttcctttggcttggcttctctgtggcatgccttccattttccacaggtgtctctctcctgccatcggcttttcctctcaagttcctagcctttttcatagctcctggctcatccccacttagaattccatgagctccatatctgcctgtcctctctgctcctgtagtagtgcgatggtggtggtgtatgtgtccgcctgtgtatgttggtaggcaggtagaggatgtgtgtgagacagtagagagggcagccccctttcccgacaatgagggaggtctagggaaagttgactggagaagggagacgcataagcatactttggttgccctacaatgctttggggtccagagactatgggggtgtgagaaagtgctatgtctcctggagcctcacagatgggctgcagtgctgagtcactgctgggaggcaggcagcggccgaatatacaggaaggaggaagggaggaagaaaggaagtggggatggagaatgtggatgctggggagcctgttttgggggcagtaatgaaggaaagtcaaggtccagagagacattagagtcaggtccccctgagctattttccccacatccagctagaaagaaattactgcctcgaacatattctcaaagcgagagtcaacatagactcccccattaacctaccccttccccggagtgggactttcacagggtcgagggattaagaaaactgagcccttccaaaggcttaccctgttcattgtctaccccctccaaacaccaccatgtaggcagggaaacctgagggcttcattttgtgattgccaatagcatgggcaacttctctcttctgccacgatccagtttctcttcctttcctgcaacctttttctcaaagattcaggggatggatagagagccttgaggggagtggggtgcaagaagcaaatatcctggctacaaaagccagaagtagaaggtaattgatagggaaggagaaagaaatgtgcctattgtgtgcctggctctgctaggtgtgacttgagagtataccgggaagtaggagagggagagcagggtgatggagaatagtatggcagctgggtggggatttgggaaaccaagaagtctgcagggaatgcaaagctaacatgggtagagcccagctcatcgtgggtgctcccctcagagccaggacagcttggttgtggctgggtcacaaggggctttttctaactctggacattcccagtgcagaggacccagcatgagtgaagatatggcccagagctagaacgactccctgctcttggcctgccatcccctgccatcccccagccaccctgggtggctccaccccagaaccccagaaagagtcaggcagctgttccaactattcctgtaggtggacctcagcatggaaacaatgtggaactgttggaaagcccagaagactctgtgggagataaataaggatgggaacagaaccctttttggtaaaaacgatgtgttttccctcagtgctgagggatgggggaccagcttgggaatgttaacctttccccagacaagtctgctggaaaaggagaagagtggccacttccaggaggggccctacccctcaggccagtggcttacaggaaagggccttcccctgcccccacccagggtagcacaggcaggacacaggagcctccctggcaatggctgcctacatggaactgctgggtcccagtgacccctttccctcccctgtgaaaattcaacgggatgcccactaactatccatttccctttggcctcagggtacagcgagaggtctgagggctatggctctccctccactcctctctgcctctcaaaggcagggcagagcacccctccattttcacagtagactctgacgaatctcctggcctctgcactcacccaaggataatcacatttagagggattctgctgcgcctgcttgccgatgctgccatcccatggctctgtccccagatgtgccacaaaccttcctcactgtctctgaggaggcttacttagttgaagacaaggcttattttccaagcccatcctcttatgtcttagggaaattgcttaccagaagcttgtcaccaaagtggtctgatcttatcctccacctcaggggaggggtgggcctagaggcagagtgagccctttgtgtcttccatggaaagggaaaataaatcaacagaagctgccctctgcatgcccctcctcagcaccatggaatgcccagtcccactcccgccatccttgccagcctgagagggccatcctggccctggtgtggcaggcccagttgggagtgaaccggaattctccagagacaaagctctgattcaccagccaggccctgacatagccgccccctccagattcctggggggtcagtaaacaaacagggtgacccctgcctcctggcctggctcagcccctcctgcctccctgagagggcttgctcagagcctgtcaggattctgcctgtttgtggctcaccagacactaggtctggattcctggtgagggatgatcatggagctgccggatcctgctatggactccccaggcagcacaggtaggatcagctcctggggctgcaggctggctgagtgctgagcttttcccatagcttgactgcttcctcacttccctttctcggtgtggctgtgagctatggttttaatgggatgattggtttcctaaattgcctggagagtcttgtgtgggaaagaagtatggttgggggcaaggggagactacaagagtcttggccactgactagcagggccattttctttgcaaatgaaggcaagcatgtagacaagcaggtaggcaggtgtgggtctccctagtctggggtagagcagcccaggctgatttcctcctccaattccccttccctctgcctgctcctgccccctggctgggcagttctgacactgttctataggtagctaccttccttagggctatccgggataaccaccattcccccaaaccccacaattacccccatagggccttaccagtgcccaggagagcaagcaatagactgtgtgcctgagggctcaagactagactttggcaggctccatggcttgtcctcttggccatcaactctggtcagagtcctctgctcatctttatgagcagttctcttgaagactgtgtccaggcttcctgactgtggtggacacatcaaagccaagtttcatatgggaagtaagacgtggaccactgatagttctctcttgccagtctactccctctataaatctttatggagaaactcctcagcttgcttttctagaaggttgggtaaactgtaggaccctgaagtatgagccaacagcttacctgcaatggtatggttgcccataatttgggcaattctgtgcagcttcttacctaatgcaggtacttccaagaccccatctgggcagtggtcctgaggagtgggggcccagcttgggaatgttaacctttccctaggtccaaaatttataatcatgagtaacaataatagtaggcagcagttctatgtaactgacctgtaccaagagaagacttggcaatgaacaggaccacagggtctttcttcatctcagtccctgaacacacagagaatagcatttctgaaccctggcagcaacccttctctccccttgttcacacttgtctcacccttggcttggtgcagaccagggtgtggcacaatccaaggatcacaggatgtttgtgtttctgtccaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccggtaagaaacaggtgccttagggaattggcttagatggtgttgggctccttttgctgctgcaccctgtccttctcctctcagcctgtgcatccccctttccttagcccacccacttctccctttcctacactggcactggggaaacagccttgctttagaagtcaggagacttggatctgagcctcagttttaagtagttgtgtcaccctgaatactttgtttgagttctcgaaatgttagcttccatttgttttttataaggacaaaaaatgagtggaggaataatacctgttctaactacctcacagtgtggtcataggaattcaaatcagatgtggaaatgctttctaaacttaaaaatgccgaggtataaatgaaggggatgattgctcccttctcctcttcctctcatagctgtcctatatcttggtaggtctcatctgttcacttccccatccttttacgttctatccataagttttcagcccacctatttctccccaaactaagggtagctctgtaagagcctgaagtcaatttttttctcagttgatcggctttccctagctgtctgtgcatgcctgccactttttttctccaccctctatcatcaaagtccaagcttctggcttctgatgggctttgttaggggtgaggcattgtggataagttgaaagaatgcaggctttggagtcaggtaaacctgagttcaaatcatcgctctatcaatgacttaactgtgtgacctttgggaacctacttaccctttctgggcaataggaatgcctacttaataaggtttttgtaagaattagttgaagcaataatttaggtaaagatcttggcctaggtggtggtgaggggggggcaatgaataaagatagttattattgtcagccaaggggaatggcttgatggctgcacatatccttggccagcctccagcttcctaccatggttcatttggagggcagcggggtaggagggcagacagagataattatacagtacagatttttctgtttccatatctcagacctctagccaatgttcctttgggtcccaaggactgttatattcgtatgcatccttgcacatgtgcatgcctatactcaaccacccaacttgccctttccacttactgaatcctctcctgctcagagggcagttcggaacagcctctatggttgagcagtttggcatgacttgaattctaccagggcaagaggggaaccagacagctgtcacctctaatgcccttgttcagtttcctacccttcccagcctgatgtttggcatgcaactgaagtaactgagatccacaaagtgacattttaagccattgaagtttgggatgcctccacacccatggttctacctactggttttagtactgtgctctatgtggaggtgccttgggaccctctttgggtgggtaagagggaggactccaggcctcctcccacttgaaccagaaaagctcctcctgaatttgttttctatattaaagttccatataacttagtttggaaaaaaaaatgttttgccacttaaaaagaagactgaacatcactggttttactcattgtgtgcagcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggtaggttagaatcagagaagccgtggtgtgtagcctctcagctggggaggaatcccttcttcagtaccctgacagacacccagctctgctgagacacctaaatgaataggaggctgtatgcagtcctattagtctgtggctagcatgccacagcctaagtcaaatattttctttctacccctcccatcaaattctagcctcccttaaaatactgccatgatttttaatgggaacatggggaaatgaacataacataatgctaagtgaaaaaacacaggatacaaaactaagtgcaagtggatctcaattgtataaaaatgtatatagatgagtgtgatgtttacatacatataacagcataggaaggaactatatcaaaatgttaacaatggttaactctaggtaataaaattggagttcttaattttcttcatatctttctgaaatttctaatatttctgtgatatatattactgctgtagttaaaatacttcttaaaatgactacagaatgaaatataatacagcaataaaataaactataaccacgtgccacagcatgggtgaatcttacagacagacaatatgttgagtgaaaaaaagccggatacaaaaagagtatatactgtatgattccacttatacaaagtttaaaaataggcaaaactaatcagtgattttacaagtaaaaattgtggtcacctttgtgggaggggagggaggggtggggcatgaaggtgagatagtgactaggagggcccacctgggatgctgatagagttctgtttcttgatctcagtactggttacatcaagatgtacagttttagtttgtgtatcccgtatatatttcaaccaaaaatttaattataattttaatataaatcctgcctatcttggttttgatttccataagacccttacaggaagctttctgagtcttctggagaaccaagatccccacatttttctctatcctgtggcatagacagacaaatttcatactaaacagaccttccagtgtcagagttatttttctgtctatcaggaggattgcacgcctttttgtctaggtagttcaaagatacctgataatgccaaagaatcaagacacactgagaagaagaaaggttgtcaattgcaggatggaatgtaaagtgattgaaaaactttcctttcctgttgaccatattgctaaactttataggcctttatggaagaagtcaagtctcggggcccctacatctattctgtgctggagtcagctcaggccttcctgtcccagcacccatttgaggagttagaggagcctcattctgagagcaaaggtaggtggtcttctgtttttcccacttcttcttgagccatgtactgctgaatgctgaacaaacaccctcctgccttccccaaactcattttcttacctgttatctaggaggatagtttcccccaggagtccatccaaagttggggggaagcaagattcctactgcaggaaaaaaagcaaagagaatatagcctggagcaggggtcaacagttgtgtgacccaaagctgtatgtggctctttggagcagcatgtgtggccatttaatgagatgtggaaaagaaaaacaaaaaaccactcaaatgaattgaactgactcaatgaataaaagtaccagtatgtcctttaaaaacatagtgctggctgggcacagtggctcatgtctgtaattccagcactttgggaggctgaggcaagaagatcacttgtgcccagaaattcaagactagcctgggcaacatagtgagacccccatctctacaatttttttttgtgggggacggagtctcgctctgtcgcccaggctgaagtgcagtggtgtgatcttggcccactgcaagctccgcctcctgggttcatgccattctcctgcctcagcctcccgagtagctgggactataggcacctgccaccacgcctggctaattttttgtatttttaatagagacggggtttcactgtgttagccaggatggtctcaatctcctgacctcgtgatccacccacctcggcctcccaaagtgctgggattacaggcgtgagccaccacgcctggcccaaaatttttttttaaattagctaggttttgtggtgtgtgcctgtagtcccagctacttgagaggctgaaatgggaggatcacttgagcccagaagttcgaggctgcagtgagctatgattgctccactgcattccagcctgggcaacagagcaagaccctgactctaaaaataaataatatacaataaaataacaaactaaaataatcataatttaaaaatactgctttattccaacatcgagggacatgcaaaccagcaaataataaacctttataaaatctaaaaagttaggtgatgattgcctttgaaaggcaaattgactatgactctttggaatttttttgtgtttagtctttgtttttgagacagcctctcacttcataacccaggctggagtgcagtggtgtgatcacagcttattgcagccttgacctcccaggcccaagctatcctccagcctcagcctcagcctcagcatcctgagtagctgggactacaggcgcatgctaccacacccagctaatttttgtgttttttgaagagaccaggtctcgccatgttggccaggctggtcttgaactcttgggctcaagtgatcggcctgcttggcctcctgaagtgttgggattacaggtgtaagccactgcccccagccgactgtgactctttgatactgactccaataacttctagccccttcccttgatagagagggccactctggtctataaggcagtgggatgggactcatggtgactagatctgagtggtggtccagcaagccctcttctccaaaaagaatcctcaaccctctgagatggattgtgaatagcctgaaaggacccttcatgaattgagccctttgtcaatgccatatgcccatctcagtttatttctggcccttcaatgggagggctagtacttaatttgatgcccgatgggcctcagataggacaagctctagaaagagcagcacaattctagttagcctggggctatggggctctggatcttctgaggagagatctgagggaggaagaagaaatctacagattaggagcctaggtggaaaagccagacacattataccaacttctcctgggctgagccttcataaaatgcctccctttggctggaagtgggcaacagaaactaatgcaaaatcacattccagggtcgtatgaatagggctctagatgacttgcctcactataccttttataatgtcttactttttcatttcctactgttttaaaatatgaggaaatcctcatgatatagtaagtggaaaaacacaatatggtctcttgactgtggtggcggatatataaaccaacgcatgtgataaaatcacatagaactaaacacacgtgtacacacacacacatacacacacgaatacaagtaaaactggggaaacttggacaaaattggcagattatgtcaatgtcaatatcctgattgtgatattatactgtagttttgcaagatgttgtcatttggggaaactgggtaaagggtacatgaaatctctgtgttattacttataactgcctatgactctacaatgatttaaaaataaacagtttttttttaaaaaaaacgtgactgtattaaagggctcaaccatggaaaaatatgtatttgtgtgtgtatgaatatatacacaaacatgcccacatgtgcacacacacatacacacacattttataaagggctgtttctgtctctttctttgagctgaccctgcctggttggcctaacctggcttcctgcctcctcttgcagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaaggtatgcaagccccctcccctgactacagtctaccctgagacctgacactctccccagacactgacaatgtttctgctgctgagactccattgttggcctggactacaactgagttgctgtcagtttatgtgctagatttggggctggtttggctggagtctcttctgttttcctactttcttctcttttcctggtgttttctgaggatgagaggaagaggataaggacagtggccgcccacaccttagtctggttgccctaataggcaagcactaggctgtgttattgaaacaaaacctctgggtgaagagggaagagtagaggtgaatgactaatgtttcttctttcccactctgtctgctgtggcacttgggtcctggttctccagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggtagaagagcagcctggagtgaaccatggggaggtgcctccatataactaggcttgggggaaacttcttcaggggtatggaaataggatctgcatgggaaaagaggagtggagaatgtggagctagggaatgggcttttcaacctctaagctgcagggaatgattaaaatgaataagaggggtctttctggatttgggcactcagggtagacaggggcaggggaagagtgactgtggcctggaattagggatgctctgctgtgacctttgggagttctgggggatggctaggagttgggtgacggtgggagaggctggaaccagagaaaagccagtccctgaggaagctcataaagattcccagaggcacctggggatcccactctaaatagctggaatgaatctactgacctcaccctgttctttccataggcgtcagttagtgagaggcttaagcagctccaggatgcccaccgggactttgggcctgggtcacagcactttctctcctgtacgtgaaccaaactggactccacttagcagaacctcagccatcttcctggagagtctattgttatcccctggggccctggtgggagcccagtataccttgacatccgagaagcagtaaggataaaacagtgtggtatagtggttaaaagaacagtctctcggctgggcgtggtggctcacacctgtaatcccaacactttgggaggctgaggtgggcggatcacctgaggtcaggagttcgagaccagcctggccaacatgcaaaactccgtctctactaaaaatacaaaaattagctgggcatggtggcgggtgcctgtaatcccagctactcggaaggctgaggcaggagaattgcttgaacccaggaggtggaggttgcagcctgggcgataaggatgaaactccgtctcaaaaaaaaaaaaaaaaaaacacaatctctcaaatcggagagatctgggtctgaggcacagcacctcaacctaataactgtgcaggctcaaaaaaaaaaatagcttactctttctgaacctcaattttcccatctgtaaaaggaaggaaaaatattacctagctcatcaggttatgggaattaaatgactttattttttcaacaatatttattgagggccttctgtgggccagatactgctctaggcactggggctgcatcagtaaacaaaacacacagaaatccttagacagcttatattctagctggggaaaccagaccacaaacaaataagtaaaatatatataaggttacttggtgacaagggctatggacaaaaagcagggaaggcgtggatagggagtgctggacttaagcatggaggtgttgcaattttgaacagggtggttagcagaggcctcactgagaaggtggcaattgagcagaggtctaaagtagatgaagagatgaaccgtgtggatgatagctgagggaagagcataccaggcagagggaacagcatattccatacctttaaggtaaggatgtgtccaagaaacagtaaggagagcaaagtgtgggggagtaggggaggctggagcatgtaaggccttgtaggcaatgggaggaacttcagattttattctcagtacagtggagaaccatcggcagggtttgagccaagggatggcatgatctgccttatgtttcaacagagtcagggtgttgagaagagactactggggagcaagagtgggaacagggaggcctatttggaggtacattgcaataatccaggtgagggattatggtggcccagactagggggctggtagcagtggagatggtgagaatatacagacagaaaaatgagatatgcacacaaagcaatgagcataatatctggcacatagtaggagctcagtaaatgttaactgtggttaaaattgttgctattataatcattggcatacagctatacctgcaggcggaggactcttgtaccgaggaaaactgcagtgagcaagctggccatgtaaactgagccattcgtggaaggtccaaaagatagacacaggcagagagaggcatgagtttccagagttcctcatgagagagagagaaatgggcagtaccattacccacagtcccacaggactgagaagcttgaccttctaggggaagagctttgagccctaaggggaaagtggagtctacttcatatccgcaagagtaatccagctgcctgcagctgatgggtagaaatggcagtctgctcagggagaagattgtcagggtggccaaggccaagtattcctgttcatgcccttgccacatctctggtatgttaggatatcggtgacaacctcttctccttgccttgccctaacatcagggagagaagcgtgttcattagaactctttgtcccaccctcagaggctgttaagagctggcaatgaaattcagacatccccttttgggcttgacaacctctttgggagaatagagcaagggagtagctgggggccttaagagcattagtggccagctttttttctctttctcttctcctttaccagcctctgtccaggttccctgggaaagagcaatttcacccaataaagttccctactacatcaagtgagtgaccatctgaatcagaagcgggtcagtcacctgcccaccccctccctctcctgcctttttgctacctgtccttgtcactctgtctgttgggattcctccatccagttcggtttttctcctactcatctcaagatctcaagattctacttgggtaaaggtgaacccttgggctttggcatcttgggtttaccctcgaaccctgcagcttcttgcatccaacctgtcacttgagtggtgtgcacatctgagtgtgggggtgggtgggtggtatagatgctggtactattgatgctattgtttgtagccaccaggctcagaccacatgctgggaccatcccaagatgacagagttataccaaaccctaggtaagaatgtgggcttcctgtatagggtgggcatatacacagctgcctttgtcctataatgtccatctacagatgaatggataaagaaaatgtggtatatccatgtaatggaatattcagcctttagaaagaaggaaatactgccatttgaaacaatgtggatgaacctggaggacattgtgctaagtgaaataataagccagaaacaaaaggcaaatactacatgatctcatgtatgtaaggaatctaaaatagacagactcatagaagcagagagtagaatggtggctgccagtggctgaggggaggggaaaatggggagatactggtcaagagtacaaagaagtttcaattatacaagatggataagtcctagagagatctacggtgcagcatattacctatagtgaacaatactggattgtatcgttaaaaatttgctaaaaaggtagatcttatgttaagtgttcttacagaaaaaaacaataaagagggtagttggaactttttggaagtgatggatgtactaatggcatagattggggtgatggattcatagatgcatacttgtctccaaactcatcaacttgtagacattgaatctgtaaagctttttatatgtcagctataactcaataaagtggttttaaaaagaatagaagagaatcgcagtcaataagcaggtgggagagggaatgagtgcctcatcgtttctccaacagcctgccttcctttatcctcgcacctttctcaactggaggctctacattcccctctggaccattttatcaccggattagtgcattattcttacagatgtgaagtctgatttgctttaaaagactgtccaggctgtgatgagcgtaactcttgtgtgccttatctttgcctactgtgagagactcatcattatgtttgttgcacattttatccatgctgatgcatgtgactacagttcattcttttttaccactatagaatgttccattgtatatagcacagtttctgctgttgacagacacgtgggtcatttcttgttttaagctaatgaggacagtgctgctgaggagtttcttatatgtgtcttccagtacatgtgtgcaaagatttctctggggcatgtttttcagtctgcaggtcataacatcatttcagtgtgttgtgacaaacatttaaaaagttgaaatagaccaggaaatattaatatgcaacagatccttagcaagagtcatagttgatattaattttgttgttttcactctatgcaatctagtaaggaattgcttcctgaaatgtttgatttagttatttttacatatatacatgtatactataaaatgaatttcatactgtaagtcttgatcaaaaagcatttgcaagtcactgctctgggatatatagctggctgggtggtgggatatgtgactgttccattttactaggtgataccaagttgttttcaaagatgattgtgtcagttcacactttcactggcagttctcattcatccccactcttgttgacacttgctattgtcagacatctattggttgccagtctggtgggtgtaaaatggtatcttgttgcggctttaacttgaatttttctgatctgagtgggtctctctccattctttgcagctgatctgaacaacattaagttctcagcttatcgcactgccatgaaactccgcagagtccagaaagccctgcgctgtacgtctcctgttgtacttccctatgacgttcaccacccctctcctgttcctcatctgtctgctgtttctcattttcctcccaccttggcaaaggttgttgattggcttggtggaaactctccaaagcctgcaatatgctagctgtcaacttctgctcttcccagttcccttccactctcgctaggccccagacgtgtttccaaattaaccccactgttatgctcctccttgacccttttcccatgctcagtatgtataatcaagcaactgctttgtgacaggaagtactgcaacccatgatttgccatcttggggttattggatgtagcagcaaaactgttgaagcaaataccagtggttagggaacagtgtggctgaggatataatatgccttctggcctttctcggagacactgttcattcagacttcctggctcaggcatgtctggctaggctgagccagcatttgggggtaattaagatgtcctcttgatgtatgtcacatttccccaaccatacctgagccttcattgctggtgtctaggttctcagaacaaaacttacagacgaacctatttgcaattgaaactcatgcaaagacagaaacttaaaatgggatttgatcccttgagagttagtataacataggagttgagtttactcatgtcccatcatctttttgaaactgatgtcaaagaacattggatataaaaacatgttgggttaatttgaggaacattttgctgccttctgcctccttggatgagggtcttagtaaaggacaagcttgtatcatatttgcaaatggttgatctggagattgagtcaaatttggtgatgctggtggctttatctccttatttaatccctggggttctacttttggctatattttttttctcttctcttctttccttaccagtggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgataggtaagggctttcagctctggaagcctccaggataaaattcaatgggatatctcaagtgggcctggtgggaaggtgttgctcccatagtagacttggacccagctcagcttggggcatggttggaacagggccctgctgggatcaactttgtgagggaaatgattgccaagatgttaaccctttacatacattcatattctcagtctcttctttttaaacctagtggtcgcagcggaaagatgcgggcattgtcttttaagactggcattgcatgcttgtgtggcacggaagtgaaggaaaaacttcagtgtgagtagaactccaaagtgtggagtggtgttgggtagagggaaaggtgttgcagggaggaggaagggtgtaagataagcagaaagtacatcttgtgactcagcagagggctacttgggctaccttatgatgcttcttggttcacactgttgcaaagaacacatgacagccaaaggacaagatgggcctaaggcctattactattcccagtgtcactccaacgggcttcattccttctgaattgatggaagtacttagtcaggatctatgttggcattttgaggtacccagggccctgatgttctagttgcattcccctgtggcctatcaggcttagccctcttccagtctgaagctcaagccatgtcactagagacttcttatatacacaggcagggcacaataatacccaatatctgggaggcggacactatgttcttctgtagtttttcacatctttggcttatagtacctttgtgttcccctctgtcctccatcttgtgttcagcattttgaacttctcagtagcagcatgattagttgttgagtcctaatatgtgactgctaaatggggtgagtgctaagttaaattagacgtggtccctgcttccaatgatttacagtccagaggaggagatggaagtacacagaaagcattttttagaaagtactgatgagaataatccaaatggccaaaaatatatcctatatcatatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccagaagttcaagtccagcctagacaatatagtgagactccatttctaattttaaaaagtaaggaaatggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcatagtagattccacagagacttagagataatttttagatgatcagatgttttgaattagcttctctttttggattatgcatgccagtgtttccttccatttgtgtggacaattgagagattactgcagtgtcagactacataaacaggagagatggtatggcagcctgactgtgactcatgttcaggtgcccctgagcccgtaccccatcatcctgcttctggaagaatctgttttcccaacagtatcatatctgtgtctggcactgctcttacacacagtgcactcgacctctctctctcttgctttcactctctctcactctttctctctctgtctccccctccccctgatattctctctttgtgttggcctgatttttctctctgaactcagagaatgctctttttagaactcggctactagaaggtcagggatagacctctatgtagtccagtttgaaaagtcattagctcagtctgtgctctttccctattttccttttctgccctttctcctcaccattctccggccattcctgtgtcggggttggccattcttgacggtggggccagcagacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttgtgagtatggaactggggagtgggggagggaagggaggttgcaggaagggtgggaagaagggaaggaggactacgagctaggcttttgatctgaagtacgcagatgcaagggagtttattgggatggaacaacagggcagagggttctctgggctctagaatcatagtcctgttagggagggtgtcagctcaactagcacagggcagaacgtgaacatctctggagaacaggccaacccagcccctgctggttctcctgcccctctgagggctgccattctagggataagacactttgggcctcagtcattcccattggtcttcttgtttccgtagagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtagggaaaacaatacctgctgggatgataataataaatatgtcatgtgacatataactcagatattaaaaaataaagtgtcacctaattattatataattacagctagtctattgtacattattatatactgttataatcctttatattgcagaatgtttaattgtttttaaatgggaagtgaggaaatattttgttttagttgtattataaagtattacagacctacaaaaatgtatagaagaacataggtgtaagagcacctatgtactaaatggtatgccagcaaatggttcacaacctactctctagaaagaaaaaaggaaagctgatctgtagcatttgctaatttctgtgatgtatatactcccactgtgaatgacatcaggctatttacaagaggtctctgagcagagtcagaaacagatcctcagttgcacaccatttatatagtatgtcaaccatgcagatacaatagatgttaagtaacctcaagaacatagagagtagcaaagtaattaggaagtaatgagttttgagtatttattacctttgtttgtaatataatttatttaattgtgagtttatataatttaataatggctagatttaacaactggcttagaaaacccctgaaattttaacagccaactgtcgtgagctggtatgagctggcatcagcacaccacagtatatacctgtgaccaacttaaggaataaaacattactgcaatacatctgaggtctccttgattatattcctctccttccccaacaaaggtaaccactatcctggattggactttcatcataaaacactcaactttttacctttgtaaaacactaacccacaactctccctgtcatcaccctgcttttcgtaagatgagcaaatgaggcacacagctagttagtggtagatctagactagatattggatcatatgactcctctaagtctaggcatttcactgtcctatgctacaaggttgggcagttcagccaggctttggaagtagatctgaagggctattctttgttctgcaataataggtatattattatgaacaacctttggaaataacttttagccaacttagccaaggctggtagaaagaactgccttcatattggaagtgtaatttctccagggtaggtggtggtccctgggagcctggacctgtttgggccatccttgtttagaaggccatttgatatgatgagatatttacccctgcttccctcctgtctcccttaaacaaaggtggtgagacaatgctatttcccacacttcatgggaatctggccttgtgatttcatagagatttatggtctctagaataaagttattcatctattgagaattcagccactgctatgtatacgaggttgggcatgttatggctccatgcctcattcatccccttctactgtgtgtgtatattttaatgttaggggaacagcggggaggtcactgtggcacgttggactctctttcctactacatctcctctcccccaaggtaccggagtctgaagcaattcaacgttgacatctgccagacctgcttcttgacaggcagggccagcaaaggcaataagctgcactaccccatcatggagtattacacaccggtatgaagcctccaggctgggtgggagggttaggcagctctcaggtactaggccttgatccactttgcccagcattggctcattgttttctgctctcccgtggggagcattctccaaggagctctggtgattcactggtttgggaaattcaggcctctctattcttccagcagagcttctccctcaccaggcctggccacagctggcccaggacactctcagccatttaaagggcactcactgttttactgcagagaaaagtctcaggaaaaacaaaacaaagcaaaacaaacaaacaaacaaactaaaacagagagagcaaggcagttccaggtgattcgccttccattgctcacttgagtttttcctggctagcttcctatattgcttctgtactgggtcactcagtctttccctgatgctttgtcattatttctaccccttctagtcagtaccaaagcttatgctcaaattaattattcatcccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttttttttttttttgagacagagtctcactcttacccaggctggagtgcaatggtgcgatcttggctcactgcaacctctgcctctgaggttcaagcgattctcctgcctcagcctcccaagtagctagtgtctcctatttttcaacctgtttccccacaatccatctgtccaagctttcatctcttcaaatcctgttgacacagaaacgtgtggcctggtgggaacagggaccatgccctttacttttcatttattatcattttaaagaaaacattagaaaagtcatacatggaaaactggctggatctggtagactgataatcctctaccacctgctcgtcctctacatccttagaattcatagaaaagctattttaaaaattaacaaacatatgctcattataaaatattggaatcatataaaagcgtttaaagtataaaaaaaaggctgggtgccatggctcacacctgtaatcccaacactttgagaggccgaggtaggaggatttcttgagcccaggagttcaagaccggccttggtaacacagtgagacccctgtctctacaaaattaattattattattattagttttgcttttagaggaactgagacaattaaatttttaagtataaaatgaaagtcctcctgtctcctcaccctggcccccacccctccagttcaacttcccagaggcaaccagtgttgagtttggcatatatcctcccagaccttcttctaggagcagggtatggtgggcatgagcaagagtggattacccagcaggctgtctgctctagcagagcagccacacctgcccagtatatctggaagccattagggtaagttcctctgccctgtctcctcctcagaccacatccagtgagaacatgagggactttgccacaaccttaaagaacaaattccgctccaagcattatttcagcaaacaccctcagcgaggttatctgcctgtgcaatcagtgctggaggctgactacagtgagacgtgagtactggtggctgagcaggggctgtgggcagcctcactgagcccgatcgtatgctgtgaaggggctgagtcccgagtgggctaggagaatgttccaaggtaaatcccactagtgatagggccgttcagcttgggcctgacctgcactctggcctgagaagtagactggaatccagtctttgtattttgttcccatcagctcttgcccatgtccataatgtagggagcaggagagggaggaggaaacaggctgcccagtctttggtcctccgagtctttgctgctttcttctaggccggcttcttccccgatgtggccacacgccgacacacactcccgaattgagcattttgccagcaggtaccaccaggtttgcgggaggtgggtaggagctgttgtaggaagtccgaggggaaaggatcttcagtcggggcaaggagaatggagtcagggccaggggatgtgcacagtggggtgtgcagcagccagcaagacccaacacttaggagtagttggggcagctctcaaagccaatgatcctgctgtgagattaaagtccttgagatggaagcaggccccacatcctgttttctctcctgcctctgctctttattcctaggcttgctgagatggaaagtcaaaattgctccttctttaatgacagcttgtccccagatgacagcatgtgagtttccacagctgcttatttgccagaaatagttctccttgagatctttgtgccactgtttgggaagggtatatcctccagggaatgggggtgtgtggtggttaggatccttagctccctaaggaaggaaggctgctttctgggcacggtgttcagtaagaaaggcagtcttccctctatcaatcaacctaggaaatgagtgatgtactagctctctgccatctttccaagtcccttcctgttgcaagatcccatccttctatacacaactttgaggaacgaagaatatgccctccctcatctgaagttgcagaaaggagccattatcttgtgctcaagatgccaaagccctatctagtgctacactaaccctgggagacatcagggacttggctgaactatagccaagggaactccctggtatgacagcccagagaaggggccttgtgtctctagggaggtccccaccctgctcagaggtcctaggagcttctggctacatggatcaatctgccctgactgggacccagatccctctagaggaagaggaaacaaaggagggtagagtaggggaacagcacagaaagggaaatgatttgctcattgtttcccggggaggggggtgggctgtaagtagaacccagatacctgcatcctgaaaacactctctcaatacccccaaccacagcctctgcctcctttgaacactttcatccctctcaagcctcagtatatgtcctttccctctcgatgtgacttagaagtgaatcctccagcatgcatttcctggggcctgagctgagagctgagttgtttctctgttcaacaactggtcacctactctgctttccccacacccatgcagagacgaggaccagtacctgctgcggcactccagccccatcacagaccgggagccagcctttggacagcaggctccatgcagtgtggccacagaaagcaaaggggagctacagaagatcctggcccacttggaagatgagaaccggtgggtgtgatgatagcagaaatctgtgtgggttcttgaggcagacagattgaatttaagtccaggcacttctacatcctagctgtctgaccttgagcaagttacttatattctgtaatcctctatttccttatctgtaaaacggggatgatgatcatcaaacctgcctcctagggtcacttgtgaagaccaaatgagatcaggcatataatgtgtttggctcagtgcctggcttatagtaagggttcaataaatgctagctattataataattatttgaaaacttttaaattttttttttttttgagacagagtctcactctgttgcccaggctggagtgcagtgtcgtgatctcggctcactgcaacctctggctcctgagttcaaacgattctcatgccttagcgtcccgagtagctgggactacaggcatgcaccaccatgcctggctaattttttttttttttggtatttttagtagagacggggtttcaccatgttggccaggctggtcttgaactcctgacctcaagtgatctgctcaccccggcttcccaaagtgctgggattacaggcatgagccactgtgcctggcctgaatccttttaatgtaacccaaatttttccaagaacacacaagatgcaagcagagagaatgcatagagaaaacaggagagggtatgacatgttcctgccctcagagacctttcaatgttggaagtggaaagaaatgtgtatcacctagtaaaagtattccagaggacaatgacactacatagagcgttggaggtctggaatagggatggtgaagaagaatacagggaagacatgactttccataaagtaaaggtggcagcaggtacctaaggagggtccaagcctcttatggggcatgaagtagaattcgtagtaccccttagagcagtgctttgcaaacagtagtgcataagatagtcacttgggaagcttggtaaaatacaaattctaagtcacaggtctgggtggggcctgagtttctgcgtttctcactagctcccagtggatgcccatactgctgttccacaggccacacttggagtagcaagtctttagaacagtgctactcagagtttggagagcagaccagggccagtttgtgaccagtttgtgaccagtccaaggcaagataaaaaaaaaaaaaaaaaaaaagagagagtaagcttttagaaacttttacagcaatttgacattgctatgatattcaagcaccaaattagtaggctcatctcgttgaatagggtagagaccagtttgagtgttgttgaacttgtgtgatgaattacgtggtgtgagctatgtactagtcatgtgcattgggaccacatactggtccacaacagagtgaaaaaaaaaaaaacctggatttttgccatgaatcatttgagaaacactgcctttgagcagcagtctgcaggccctgggaaacactgggctgagagtgactgttctgttgcaaataaagaaaaaacgaacaaagccaaaagtgatatccccaaaagtaggccacctgtttggaatttgtttttttgatgacccagcatgggtgttcaaagtgggccaaagaggaggattgtggagagaagaggcaagacaggtggtctcttgtttatgttatgttttcccttggaatctaaacatctaaaaatggagtaggtgagtcagtggccctaatgcctcctttatttgcagactgtgtttctgcctgattttaaggtcagaattaatccctaaagcagcacatcaaagccctgagacatttcttacgcaaaatgtcaactttctctgctctgaggtctcaggatggcagagtaaatgacatatgtgctggagaggaagtggatgtggccattcaagcaagagcacagctgggggtggggatgggggtgggggtgaggtagggtggaagagcacagggattgttcacacctaggcctgaggggacatctgaaacctggacagtcagagccctgttagagccataggtcttggtgtctctctccatggcaggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcaggtgaggatggagacaggaaaagagccagggtggcctctgagcccaggggaagggctggggagctgagggctgtggcaaagaagacacaagagagagctccttggcagtggctgtcaggtaacttcctgaagagaactgggcctgcggttggtgggggggcgggggaaagaagagactggtatggtcacatcttcagccaactctcttccacctaccttccatgccaccctgtgtgtcactctccagccactgtggggcctggggcagagagaagacttctgagggcttatttcttcacaacccattggaatcccatactaaaagaacaaacttcaaaaatcatctaaaacattgattttgctagtatggtatttgctagaaagaagtgggttgggacaagtttggcaagagaaagattagtgctatctaaaggtgtttcttgttactttttgcacctttcatctctgagaggcaatgtgtatgctgtggtaaagctctggagtcaggcagctctgggtttgcatgtggctctgccaattgactgtggggtgtttggacagttagttaacctctctaagccccagtttcctcatctgtacaacagagatggtaacagtaccaacttcatagaattgtggtgaacataaaaggagataatgcatttatggaatttagcatgatgccaggaatttagtacacacttcataaatgttacctattattgtcattatatgtaatggaaaataccactcttctgcctcttccccagatcctccaaggaatggcctctatggattcctggaggtttctaacatatgctatgtcatgaaccaaggatcaggtgtgaaactctacatttccagagagaattgtgttctaaatagcttaattatagctgaaatgacagcaagagacctttaggtacaatgccattctttatttaattaattaattaattaattaattttcaagacagagtttggctcttgttgcccaggctggagtgtaatggctcgatctcagctcactgcaacctccgcctcccaggttcaagcgattctcctgcctcagcctcccaagtagctgggattataggcatgggccaccatgcccggctaattttgtatttttagtggagacggggtttctccatgttggttaggctggtcttgaactcctgacctcaggtgatccgcctgcgtcagcctcccaaagtgctgggattacaggcgtgagccaccgcgcccagcctacaatgccattcttataagaactgggagcctttgacacatgttgttaaaggaagaaggtaatgggtaattcaatattctaagaagtttcctaaaagtggaagccactgttttaggtaataccaaaagcttcttaaagtctaagggtaaagggatggtatgaagtctctcaggtcccttctaagctcaggagtctgtcagagtaaggtcaggaaggcaaatccacttaagtcatgccttacctcttgctagccacccaccgaatcagatggcagtggctctgcaggctcgtccctagcttcctctccacagcagtcagaaggcagtcacccccgggagaagggacagactactccagataccgaggctgcaggtgagttcccctggcctttcccagcccctttctccatggctttgtcctgccctcgatttcctgcccaaggctttgcggggctgggactggtttctcctcttggctttgtgcttagggtcagggatgattggtttactgattgattaattcatatgcttattccacaaataaatatacattgagcacaacctatgtattaggcattgtgctgggaagatgcaaatgctgcgggcaggtctgcccttcagctggcagaattctatctgaccccttggcctcataaaggagtctctagttctcttctcaaatctctgttttttaacccagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggag

SEQ ID NO: 36933 - DNA, 16669 bp, Homo sapiens
gagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaaggtaagtcgtgtgtgagagctggtttgaatgaggttctagggtagcagtctgctaatcgcgtgaccctttcgtgtcaaagcctccattcctcttccctggtaagtaacttaatgaaaaagccagactggcatgtaggcagccggtgctttaaaaacaatccctttgtagcatttttgcagtacttttcatccagcgaatacatgtaaggagtgcaaacatttaggtcagcgtccccaaaacgtaaagaataagagtgatctcactttacagccaggtaagccgaagcaacaagaattacttgcctgaagttgaacttagataataattaaggaacgcagaaattctcctttggaaagttaaaattcagacggaggaacttcaacgtgggtggagacagagcacccccttccccacctgacctttcaccaatgtagaggaaaagatttattttctgaacacatgagttaaaaaattcttaacatacaatgtgttcaacgttgtcaagtttatcgttgttaaataaaaggtgtatgttttctgctctaaaaatggtttgatggtacgttcatgaatgagttaccaaataactcctgttccattctgtaagaatagggtgaactttaaattttcgtttttttcttttcgtttgcttttatgtcgtttgctttgttctattctgtggagataagttttgaaatctttgattgaaagtttatgcaagttttttttttaacggaaaatttccccgtcctttcctgctgtcattcctatttgaatgtatacacttaggcttttatggaacagcacttctgaaaacttcaacagtttcttttatcctggaaaggatttggtcccgtaatagggatttgggggactgtattctggtggtttcagagaggagaaacatatttactattcataatgtttcgggaacgtaccttttgcgatatttttacatgtactcttgtgaaagagttgtactcaatttgaggtgagaacttgccttttgtaataatctaattaaagttattgattgcttgtgaaatcagggaaaaatgattaattttaatcattttgataggcaggtggttgtctatcacttaatttttataatttaactttttaaaatgtgactttcctgttgtactgaagtagagaacacatctgcttatattgaccatatccaatattttactctcagtattgacaaaaggattaaatgattcatttttaatcctttatgacgtcttgaaagtagttttaaaatatatcctgccatttcagtacacaagcagaaaaatccctaggaaaaagcatatttgattcttaaaactagtactagttttttttttttctacttgtttggtgtgctgaatactctagcaagtaaaatgaaagccaagttgtctattttttcccttgtgtatttatttttacattgtatgtgtgattgctgtcataagtctttcacaagattatccagcacagatagctataatttctttttacaactcttaaaaaggaaaaagaacctttatcaacattgcctttctaatgaaaattgcaaaagatttcagcagggtctgcctaaacatttgtttacactacagaagtggggatcgttccaaaaacctaataacacattacagtctgtcttcttggggagagttgattcttttctaggatatatttagatttctgattgacatgatggaatagaagtgcagctgtagcaagcagtatgctaaataattcaactttggaatatgctaaattcagtttaatgtgtgagtcagaaagctatagtgaaaaagcatttccattgtgtaatgaagatgatttgtttttaaaaatcatgtattgacgtgttaccttaaatttaaaaatttacctttttttcttgtattatgctattcttaaaagtggttaagaatctacattttcgcccaagaattctccctagttggggttgtagactttatacatttataatctcatattgcttaattattccaaagaagttttgttttgagagattacatttttaaagaaattcttaaggtttatatgttttaggtgtttgaagtgtgtgcctatacactaatcataataggacatttttatacttttctgtcagcattgattaggaatgtagaatatatccaaatggaataagtaatgtacattttaaagtgatatgattctcacatgttgaagtttgggtttttagtgataagtttaatgaattagactttgcttcaggacatttcacttgttcatttctcaccttgctttatcttgtctgagcaaattaagcattctgagatagttctgtaaaatgcaagttaaagttgaactaattttatcaccagtatatctatgaaataacttatttaaaaaaatttttttttctgttttgcttattttgagtttaagaaagtagacttggtattgaagaccatagatacatgaatagagggagttctaagctataaaaggtgttcctattttgttgcagttttttgtgaacacgtattcttgaatgagttctaacatgttctgttgccttatagaaagaattgacattgagagtcagctgtaagttccgcactgagaattctttaaccttagggaaatcttttaactaaggttttcttatttgtgtacaaataatacttgatttcaggtattacttgtaatttttgagaattagtcaggggttgagaaccttacatgaaatatctcccctcacatttatgagaattgtaactgaaagtagtaaaagtttgaaagagtatctgagaatttgcgtcttcagctgttgagttgctccaagctgtcttacgttgaaggaatttttaaaaaattcctgtccttctcacactagtagctttgtaagataacatgaaaatagatcactggaaaagatgagggaaagaccaacactcaattttttactatttgattcaatagacataaaattattttgtcaaattgcaatgaaggtacttaaatgctttgaatttccatacttaactaatgttaaccattaggagcagttttggcataagtccatggaccacagtttgagaacctttgctctaaagcctaaaccagtctctgttggaaagtggacgtaagtagtaaataatcgtttatacagatattttttccgaagggacacatctaatttgcactgcaaaatttatcacataatcaaatgcttttcaagttaggattttattaatacttttctttaaattaatatatcttttatttctgttttccttctgccaccccacaattacttattgaatactaccaattatttggcatcatgctaggtactactaaggatattaagataaatgatactcaattccttctctgccattagtctctcattgttgtccaagatttccagtagtgataccatggaggacatggttcttaaggggtttcagaaacctttgccaggctaatgagccaagaagtcactttggcctacatcctcttaatgtattttatgtgaaatacattagttgcttccttcccacaaacaaaagaaaatggagaaattagagaatgctgatttatatagtatttaaaaggtactgtatatcacgtaattttacaaatgaaaaacatgttttatgcatatgaagtataaagtgagtcacataaattcatgttatgacagaacctttcaggagtacatcactttgtaaaataagataagcctatatgaagattattgttgcttcaaagaaatttttacttcttttttgtttttttaatagctgtcttgttaacatctgtcttttaagctgaaaaatgtgcaaagtattttttcccctaatgtacaccatggacttttctggttgtagttttgagatacacggcatagggtgacagatagtgatgtgtgttaattttactcacaaatttttaaaaaaatatttttctgttttggaaagatgagatccttagaaatagggccatgaatagtccataaggtctctgtacaaattagaaaaaggcactccttccttaaaaagcattactactgtctgccagaaaaagtatcacagtaaacatacgaatttatggtatttacaataagaatggccctctagtatgttgtgtactgaacaacctacctaactgtatgtaaatggtggccctgcttgggagccatttcctttatcctttaatattctctttgtgtaaaatgggaatgataactaatacatgatagcaaataatgtaaaatatctctctatttagaaggtattatgtccagttattgatatctgttagcccaatgtgtttaaaattaaagtcaatgaaatttttgaaattaaatttatggctgctccttttcaaccattttgttgagagtatagtttttacgtatggcaactctttgaataatattaaatattaaccttggacctacttgaaagcagtgttctcagccttaaatgtttttaaaggtagttatatatttaaaaaaaattcttaatccaagccctccatggttaaaaatagcttggattggattttctttctttttttttttttttttttttttgagacagagtcacgctgtcaggctggagtgcagtggtgtgacctcggctctctacaagctctgcctcccgggttcaagcaattctcatgccttagcctcctgagtagctgggattacaggcgtgtgccaccacgcctggctaatttttctgttttttgtagagacaatgtgttgccatgtgggccaggcttgtctctaactcctgacttcaagtaatccccgtgccttggcctcccagagtgctgggattacaggcatgagccaccatggtcggctggcttggatatccttaatgtctagtatagtaactatggtattttgaagggttgtctctccattgtgttgatttgttaattttataaatttgatattttataaatatgcttgtccagcttgtatttaaatatgatattgtatagctatacatttatttaggtcctgtacacttatgagggtactcttttaaatttaaaataaaaaatacagatgagaaatacatagtctgagttggttaagtgattcttaggtgctagacactgtcaaacgccttatattaattacctgttgattcctacaaccctaaaactaataacaatatgatatttattgcttcatttttaatttttaagaggcagggtcttgctttctcacccaggttggagtgcagtgccacagtcatagtttactgtggcctcaaactcctgggcacaagcgatcttcctgcctcagcctcccgtgtagctgggactacaggcgcctgccaccacgccggccaattttttttgtatttttagtagagacagggtttcaccctgttagccaggatggtctcgatttcctgacctcatgatctgcctgccttggtctcccaaagtgctgggattataggcgtgagccaccgtgcctggccatgttggtgaatttgatatacagaacttagaataatgcctttctgaagtttttagggaggtcaggggaagtgagttaacttaataataggacagtactatgctttttggcatcagattatttctaaagaaggttgatgaaaacagcttaacatttgaaatacttaaagttgtaaatcattcaaaatgtctaaaaaccacagtttgcatgggcatgtagatttgtaaaggtgtttttggcattctcccagaagagcaaatccctgaagttagaagtgagagcatgtatactaaaaggagtctggttcaacataatgattgaaagacttcaagaactgatgacttaaattgatttactgttttttgccacctatgtttcatcattggttcacaatacaaaatatgcctttggggcattagtcaatataccaaaactataaaatataattttaaatactatgacccaaaaggaaattttatgccttgtcttttctggattacagaaggtatttagggtgtgtgaatttttttttttttttttttttgaaacagggtcttgctctgtcatccaggctggagtacagtaacgcagtcatggctcgtgacatcctcaatctcctggacttaagcaatcctctcacctcagcctcctgagtagctagaaccataggcacgacccatcacactcgactaatttttttactttttgtagagacgaggtcttgccatgttgcccgcggtggtcttgaactcctggactaaagggatcctcccaccttggcctcccaaagtactggaattacaggcatgaactaccatgcctagcccatttttttttccttataaaatttcctttctaaatacgaaaaggggagaaacatttttattagtgcttcttgtatctttatagtctttcagctacgttttttttgccacatcatttaaatatgtttttatttttcctgttaagttttattttcaagagaaacctgttggctgactataagtgctgaatttcatgacttttatttccaccagtattttttaaacttggcagtttgagtatctgctaaaaatagcttcctgttggtatattggacaaaagaaaaacttctgttcttttattctgtcctaccagaacttagtagagaatgtgttaccagcctactttttctaagtcaaatgacacaaaatgttttttcttactaaaaccatatgttcttataatgggcttttttttcttccctgcttacaggaaatgctttggtcttttaaaaattagtcagaatgaaaagtgaaggcatgtgccttggttcttcaagttttaactgatttgccacctaatatttagcagattgataaaatatttgtcttggctgcccagacagttgttgtacaactataaaataggtaaaattattagaaaacagcaaaacattcccctcccccaaagaaaagcccacaaaaactttaggtctacgggttgggggaaagctgtgttttatcaccctttcatattttaatattttcatttctctagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagtaagtaatttatttaaattattttcctctgaatcctaccctgtttgctaactgaaattgcttcctaaattaacagacatacccagaggattccctttttctaggtagttgattatagattctggtgttcagagctgaccaatttgactctggtttatgtgaaagtaaatatttgcagcaatctgttctaaagagaacaactccaaatacctattgaaatttcacttgatattttttcagacagaatgaccattttaaggcatgaaaagtatacctaaatattcttaagatttaaaatgatgagctgatgagaaaatactatatcaaattttatgatgcatgacataccagcaaaatctgattaatatcaactgtgtagttaaattaggtctttaatatacacctttgaagcattttaatcttaaaaaatattttaaagctagtagagcaaagggagaaaatgtcttcttccttgcttgtaataattctaatatctagactctgaaggattagaaccaaatactaatgttctctgtttcaaaaagagaagggaggggaattggtggcaatgctgtgttttcccttctaagttctggcctctcatttgaaattataaggcagctttggattgaatagaagagaagccgtagtaaccattagaactgggaagtatcattttaggtaaactcttccaggttagtcctgtagctgatctctctgcagccataacaatcagtttggtttacatcaaactgcattttagtcttaagtattgttggtcactagacaccaagtaccatttaaacaagataaaaagaaaaacttacatttattgagttctaaccacgtgttaatcacattgccaagtaattttcctgcattatctcatttaatcctcccaacaacctatcataggcactaaagaggaaaagcctttgaagcaggcgttagtacatgcaatgttataattcatatgaatatgaggtacaaaagaagaggtgttgatgttttaaaaacattaatggctatttattgatattgcagaccacctagagaatgctaaattgaacatttagtgacagaagattttctcctggatactttaaatacataaaaacttggcagagtttttatgaaatataaattttattgtattcatttacatattaaaaaatagactcagaggcggaaaaacttccttgaaattgtttgtcatttgttctacagttacttactgaagtcattactatttaccaagcatcatgctaggtgctaggcttacaagagtgaacaaggagacagggttcctgtcattatagagcttaatctactggggaagattgagtgggaaagattgacttaaataaaacagtaagttcagaaagttaggaagtgttggagtctatatttaaacttaggtattttgacccaaaagcctgtactgtttctaacataccatgctgatgctctagcctccattttatatgcttaaacttattatggggcttttaaatagaatatgtattatccttgccagggcaaaatataaagaaataattgactgcctgctatatctgtcttcacctttctatccctattatctgtttttttattcctcttttttgtctcccttgtttcttaccctgacttatgtatgaagatctctagtatttctttactattgtgaggatgaccagcggagaggtaatattatagcagttgcctagtacttcttccctagagcactgaagttctaaatatgaaagagtggataagtaaatatatcttttttatcactttcattttgtttcattttttagactttaaatattaacacaatgacagcctcatttgaagctagcagcaaatatttggaaggagggaacctttaatacatcaagattaaagttaactttaaattataaatgagtcattttaatatgtgggagtgagaatcttaaaacataatgaaaacctccaaaagaaaagtgaattaggaaatacatgcctgcttacctgtctttcacaccccaattttagaagaaaaatacttgggatggattgagtagggggcaagagagaaaaaaatatattacagtaaatatcactgaaaaatgttcaatttgtggaaatgaatacaaataaaattttatcaatcaacttttttttttttttaaagagacaggatctcaccatgttgcccaggctggagcacagtggctattgacaggctcgatcaggcacacttcagcctagaactcctgggctcaagggatcctcctgcttcagcctcatgagtagctgggactatagatgtgcactagtgagcccagctcaacagttagttttaaaggcatagaaatgtttttatgttcagagaaaagtatcagcgctgatacagggccgtggtagctaaaagtcaattaaatttgaaatgtaactagtacacagctttgcagaccattgaatagactaccaaatcaagcacctttgcagtaaaacctttgtagagacttgaaattatttgaattttttccatgtcacaaaattataccaacttgtagttgattagaccacaaaatataggtatgcttatgttggttgaatttatgtatttgatttgccctgcaattttcttatgaactcttacaattttttttttttttttgagatggagtcttgctctgttgcccaggctggagtgcagtggtgctatctcggctcattgcaacctccgcctcccgggttcaagcgattctcctgcctcagcttcccaagtagctgggattacaggcatgcaccaccatgcctggctaatttttgtatttttagtagaaacagggttgcatcctgctggccaggctagtctcaaactcccaacctcaggcgatccgcccaccttggcctcccacagtgctgggattacaggcatgagccaccgcgcccggccttaaaatgtttttagcgaagctctgttagttggttttgaactctggatattcctgccgtaaaagtaaatatgctattgtgttagaatcaactatttttcctatttctttacaaaaatggatgacagtcattattagggagaatggatggtttctaatttcctaagcaaaatgaagtttttgtttactgtaaaagttgtcttatccttgttttttctaatatctatagtcttttccttacttatttcttcctctttgcctttaaccatatacgggtcttctgcatttccttgtatcccccaaaccctttcatcttttgctataatgatctgtgttacccaccaagcaaggtggcaccttcctgtagtcccagttactcgggagatggaggcaggacaatcccttgaggctaggagttcaaggttgcagtgcataacaactatgcctgtaaatagccactgcactttagtctggacaacatagcaagaccccatctctaaaataaataaataaataaataaataatgatcagtgctaccattttttgaaaatgtacaatcacttattcctcaaatttaacttctgtcctaccacagaggcatttaatcaccaaattcagtaattttttttcctttcaattcttactcatctgtttttttaaaaataacatttaatgtagacctcttcctttattagtctctgatactatggttacttggatagctttcccccaaggtaatagcttttcttcttccacttcactactgccacctacaccagcaccaccctactcctgcccttcagtcaacaaatttcaagtcagaattcaattaacatgtccctactgtatgtaagacatatgtggtactatagatataaaaaaaaatgaagaatatatcattatgagactgactacttggatgaggaagataactataatatgaggctgaccacttatgagaaagagattctggctgggcatagtggctcacacctgtaatcatagcactttaggaggcccaggtgggagaatcacttgagcccaggagtttgagaccaacctgggcaatatagtgagaccctctctctacaaaaatagaaagaaagagggaagaaggaaagagaaagaaatcccaagtatggaaacattacatcaaattttaggggtacaggagtatgccaactagtaagcaattatcttagctccagacccacctttctatgctctgctttgtgactggacctagtactctgcaagccacatgtttctttgctagctgactctccattagactctgttgccatatggggctatcgtgggagattgcatggatggaggaagagaaagggttttctcttactttctcttgtctttcagttcctttgaacaacccagcaacacttcttcaccctggttgcatcagttttcctgtagcagagactgaacgcggtttgcattttctctaatacaccaccagcctgaacccgcaccccatccccccactctggcagtgtggatcccaacccttggggccctcctccaagcgcagatatattagtactagcttatctatgcccattcttccgaggcctgagtttcagttccatgaagtggtttcttaagcttctaaattttaaaaattccagcattttcctttattccctcagttttagggttggtggctgcttcctgtagctgctactttcatgacatcttcatgttctcttcctgccttttcagctccctaataacaactttatacttgtttaacaattcttcgtattaaattttttccattccagtaactcatgtgacatctatctcttgattatacactgactgatgccaggaggagaaaatagtatttcagtttgacttgaaggaagggtagaatttcagtaagtggcaggaaatttcacataggatgagtgtcagcatgagtaaaggtagcaaagatgaggaagtatggtgtatatttgggaaacattttgtgttctaggcttttttgaagcacaaagtacatgttacaaaaaaagactatagagaggttggggtagacactaatttggaagaccttgaactctaggctaggaaatttggatttgattgataacaaatgattttttttaaaaaaatgaaatagtgacctgattagaatttatatctagaaatgtttggataataaagtcatgacagattattcagaagagtgaggattgtacatggtaaaatcttaaatgttactggttatgctgggcatcactgttttcctgtagcatgttcattcagaaaatactgagggcctttatgttaggaatgcaacaaagaatatggaaacaatctctattctcaagtgtggtggaaaaaaaggatataaacttagataattctagaacaaagtggatggatatgggaatgcatagggaattatggtatattaaatagagcataaaatatggcttggaaaggtcaagaaagactagctgatttgcatttcagatgatgactaggaattagctatgcataaaggggagggtctgagttggacttaaagaacaattccaagaacagacagagaaggagaaaaggattgttttggcagagtctaatgggaaattgtaagacctttttaagaacaggttcattttttcccttcttggtgtggtttttctgcaaacagatgaaattaaattgtgaaggagccttagctgtttcataggtaattaataatgtatgcatcctggtttcttaaatcctgtggttgtttttaatagaggatatatcagatgaatggattttaagtagtatctttttactagtgtgtatacgggaaggatatgtatatttgtatgtgtgtatatgcaaatgtgtgtacttacagagagggaatgagggacacagagagataggcatatagtaggttagggaattgtaatagaaactcagaaagaaataatggggtagctactgcatacatgtacagtacttctttcctatgaggtagaggtactatactagagaacttttaaaccatataaataaattttagattgaaaaatgtttgtatcaaagttgtaatatgagggtacagaagagtcaagtgaaatgaaaggaaaagaagagggaaagagccagagggaatattgtgggtttttcacaatattggttccactttttcaacttcttcagttgaatcaaaggtcataaattacgtgaaataaaacagggccatttataagagatccaagtttgagaaatttcttagacctgtgtagttagaaaaaagcaatctctaattatatttacctatagagtttatgttctccagatgtgtgacaattacatagtacttggacagtatccaagtatgataataaactgtctgaaattggcctaatctacatttaaccaaagtgtatatattgtgggtttgtaaaaaattgttatttttttttatgttttgggtgtttaggctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttat

SEQ ID NO: 36934 - DNA, 110553 bp, Homo sapiens
cctctctcacggagacggaccacagcaagcagaggctgggggggggaaagacgaggaaagaggaggaaaacaaaagctgctacttatggaagatacaaagggtaagaccaaaattgatttgatctgaatccttaagaaaaaaaaaatagaaggaaaaataaaagcccagaccaaaaagcaagtacttgaaagctggaggcaaaaagccctgaatgaactttcccaccctcttccttctgagaggaggcagagaaagagctttgggaaactttttaggaagcagagtccagggttgcagtcaagggtggctctagagcaagctggaggggctcatgaatattcattatcaatttgtattcagagttggtttttttagaggcaaatgactttttcagtccccttgcagtttaagaggcagctgcctcatctgcagtccggactcatctagcctcgggtctgtacctcagggtgtttgcttgaagatgctgggctctgcgtgtagatttgttttgttctcgaatttcttgcatgctttcctgttgtgaaattagcaaaggcttctttgctgggaacaagacagagaagttaatgtggcacaaggctgtcacaacaggaccccagagtatgtctttcaaaatgctgaaagtttcttgagatatgtgggggagttttatgtgggggacagagtgggggacggggacgggtagagggaggaaatagaataattctatcttaaaagggcaggtcacatctgactacatttagattttgtctaaaaactacaagagcagcctggtttgcacagatggtgtgcagtctctatcttttacctcttttgggcattttctgccaagacggagagccagctgcttgccagcgtgtgagagccaggaagaatctctgcagcagtgagggagtatagggttgtaaacctccttctcctccttctttatcatctctaacttctaacattcccacatgcttataccgtatagaacatggaagaatagcatgagtagccaacatatttcttaatacttacaataatgatagctgttaatgttgactaagtctttattctgtgttgggagctatacctagcatattacatgtgctacttacttgtcacatgaaccttacaagtgctatcattgacattcccattttccagatggcataattgaggtactgagaggataacttgccttgagatctcatagttagtaagggctgagtgtggatggaggtggtctgaggcagggctggtgggcttttccactccccaatactgtttctctgctttttctggtgccctgacattgtggatttcaggtttgcaaatccttgaagctactggggaagtgatactggtaaaatcttaagtctgtgaaggaatttgtactttgcactcaagttcacatacattttcctcatttggtgctcatggccattctctatgagaagcaggtattgttattatggtcttttgcaaaaaggagaaactgaggtcagaaggggttagtttggtgacaccagtcacagctagttgtcaaaagtctggactggggggctggatgtggtggctcgcacctgtaatcccagcactttgggaggccgaggtgggcggatcacctgaggtcaggagttcgagaccggcctggccaacatgatgaaaccctgtctctactaaaaatacaaaaattagctgggtgtggtggtgtgcgcctgtagtcccagccacttggaaggctgaggtaggagaatcacctgaacccgggaggcagaggttgcagtgagctgaggttgcaccactgcactccagcctgggcgagagtgagacactgtctcaaaaaaaaaaaaaaaaaaaaaaaaaaaagatttggactggatctgaaaccctctgcttctggtttttcttccaacctacagagcagacccagtcatctctgaacgtctgtccccaccccaagctgcgcctcattgagttgctttcagttccccaaaggaactgcatctttcctcagactgaagctaggcactttcttctgttttaagggcctatctggtactctgcttcccctttagtctggagccgagctgcctgggtttgaatttcagctccaccatttactgtgtgccttagtttcatcatctgtaacatgaagagaataacagtaacatctatcttacagggttgtggtaaggactgaatgagggattcatgcaaagtttttagaacagggcctgatatatagtattgctaaataaatattaacatttgctatcactgcttgaagcctcatattgggtgttattcccctttaagccttctctaatccttcaagtctagattagcccccatcttggatgcttctatagtacctcatcagttatgcctaaggtggcactcatcatacttgtccatgctcctgccctctgcatcaccttctctcccttccaattatattttctgtattcacctttagatctgcagtgtctagtgcaattttatttttagtctctaaacttgtggcaactttctcatcagtgtgggcagagtggtgggagaggggcctcagtcatgataggggtacaggaggtagccacagaggatgaccatatagcagtcatagagggccagaagccacgcaggaagtggacatatgctgagtactgattcaggaagagcacatgtcattcagcaaccaatggttaaggtgtcaggtttcaatgaccttctccatgaggtctgtgaggtcctctgacgtacttattgtgggtcagcttggcagccacattcatcagcccctgggacaggttcttgaatttggtgttcctctcagagaacatcccaagctttccttagaaggtggtacacaccaggctcttgtgcaagtccaaaaggtccttgtcagccattagcaccttgagttccctaatgggaactcaataaatatttagtaagtgaagtattattattttagctgatgctcatttgagaccttcaagaggcttgtttaaaaggggacctttgagtttgcagtagggttccccactggtacatatagatctttggcacaatctgtaaagacgtccctctatgtggatacactgaaaaacaaaatgcatccctctgggtggatgattttcagagctaatgtaaccccatgccagggcaccctgttgggcaagtgaagctctggctgaacttcagcccctactccctgctcagccaagggccaaactggagatttcagatgcctcatagccaactttgctttctctgaacagaacatctggttccataaatagtgtctttctagccctactttatagcaaccttgctgtctgagataatgtactctggtaatgaaataaaaacaaacactacagaagttggccctgggaaaaatcataaagtacgctatggttttttccagcaccctccctttcctcttcctggcataccttcaaaccattttgacaaatattattgtgtgtctaccatttgtaagttcccatgccacacagatccttggataaacagtttgctcacggtctagtggggaagcctaataataatagctgggaagtgctaataataatagctaacattgatcatttattatgtgccaaacattgtaatgtgtgttgtctcatgtaatctttacaaaaattccatgatattggtttctgcatcttccagctgtggaaggaggtcatttggttaaggccacacagctaataataggcagaggggaaattttgactgatgtggttaggctgcaaagtctgggatcctaatggatacgttctacctcctcaagagctgtaatgtaagtctaaacaaagtgccatgacacagtggtgcacgcttgtagttccagctactcaggaggttgaggcaggaggatagcttgggcccaggagtttgaggctgtaatgtgctatatttgcacctgtgaataaccactgcactccagcctgggcaacatgatgagactttgtctctaacaaaataaaaataaaaaataataatacaagagaaagtgccatgagaagcagaatagggagcgatggcttctggagaaacttctcaaaggataggacacttcagttggatctagaaagatgagtagaatctggtgcccatggcaagccccttcaccctcccagcagtgcttgaagatcttttctctcttttaccttaactatagtgtagatttaagagtaaaaagcccccttttttcccaagctctgagcagtcaacctacttacatgtccatcttggagatttgaaggcagaagtacagagtttatccttcactatgggtcgtgtaatcaaataagcctttacaaagcaatcagctgcacattaaatgatttccttaatcatgattgcactgcggggtaataacatacatctggtaaacagtttttataaatcattgtgattggtattgcctttacttggtcaaattgcattttgagagtgctttccctcttgtgttgtctttttggttgtttctccgctctttataactggtaatggtgctgaagggcactagtgtttaatcgcaccaactactgtccagaggtgatgggctccatctgtgtagagtgaaggtgaggcctggagtaaattacatagagtttattctttttttttttttttttttttttttttttttttgagacggagtctcgctttgtcgcccaggctggagtgcagtggcgcgatctcagctcactgcaagctccgcctcccaggttcacgccattctcctgcctcagcctcccgagtagctgggactacaggcgcctgccactacacccggctaattttttgtaatttttagtagagacggggtttcactgtgttagccaggatggtctcgatctcctgacctcatgatccgcccgtctcggcctcccagagtgctgggattacaggcgtgagccaccgcgcccagccatagagtctattcttttaagtacttcggaggaaggccaaaatcaagggcagcccctgtggtgaagaatcactaaatgtcttgatggtttggtgaagtgtgcaagagtggagtcacttgtttgtcttggtgattttggtgtgtgtgtgcatatgttctgaagcagtgcttctcaaactttagcatgagtatgtatcattagagaacttgttaaaaatgcagattctgatccaatagctctgaagtaggtctacatttctaacaagttcccaggcgatgataatgctgcccctccacagaccacactttgactggcaatgtggcagggtcatcgcatgccttagtctcagggcttattttggtactaaatgaccaagctcttcccaccctctactccctcaccaagctgccacttctagtcactggtcaggtgtcattgcaggatgatgggaagcctaattcatttattcattcagcaaatatatgccctagaacaggaaattgaggctcccaatttgccaaatcctagaaactggaatcttcagcacacaaaaactactgttacacaaaaaggccttgtgttagatttcctgcatgtctccaccttttctccatggctccaagcttccctaaacttcccttattctctgccttcaacttgagaagtactggagcagaatgtgtggctgcctgcagaatcttgtgctgggtgttggagtcccagggagctagaggtagcagggactcagggctctgagactggcaacagtgtgcctgaggcattgtctacgctctgcagaagaaaggtgggaataattctaggagcaaagcaaggaaagtgggtgcagagagaaccgatggaatttctttaggcttgaaaacttgagggggttgtgaagagaaaataagttgttggagaaaaaaatccagagtagaggttgtctaacatgtatgaaacatgctgtttttgttagatcatcaaagtgactttagagaccgacagtggcagtacatgccctgttacacaaagaggtgtttccttccataaccactgcttggtttaaaaaaatttaaaaagaagcaaaaaaaaaaaaaaaaaagaagtgtttccttttgattcataggaaggatgtaaagcattgctttatgtccgtgaggatacaagtaacatagcacatgcccattaaagaaaacatgatactatagattacagtagggaagaaaaacaatcacttgtaatattttggtgccatttcctggcagttttttttttttttttttactatgcctgggttgtttctctcatttggcattcacttgaataggaccttgaaaagttatgagatggcaccatgatcattaggctatatatgcagttttaaagcctggttttactgtagcagtgaagcacatgtattttccattttatagcgtggtctttgttagcgtaatttttatagtcacatagtttatttaacagttctcctgttattgaatattgaggatgtttccatttccaataaatgtctttgtgcaggaagttttttccatatgtaggattgcactctgaggacaggatcccagaaatagacttactagattgaaacttgttaatgttttttaaagttcttgattactgttgccaggttgcattcccaaaggttgggcccttcatgctctcaaaagcagttcctgttttgtggcatccctgacagctttggtgtttttgtttttaaataattttatcaatttttagattgttttagtttgtatttcttaattacagtaaatttgacatttttcacgatatacttcttttgtatactttttacatccttttcctgtttattataatacttatttggatttgatgtttttaatcaacttatgtgcatgctttatcatataaaagtattcaagttttcctgccatacttataatagtttttctgtatttatttatttatttatttatttttgttatgacggggtttcaccatgttgcccaggctggtctcaaactcctggactcaagtgatctgcctgcctaggcctcccaaaatgctgggattacaggtgtgagccaccacacccggcctctgatagtttttctgaatctgttcttactgtgaatagatccaacacatttttatatgtggtgtcatcgttttctaaatagtttgacatcacatttttattctctgtagcccagaatattacttctaaaagattgtaaatgatttttatttttgtttgccattataattaatttttcattttttccatgatggttagagaatatggctttataatttctgaggtttccttgtaactaagcatatgatgggtttgtgtaaatctatgaacacttgtgaagaagctgtatgtttttaggatataaaattggatatttattaatcaatccagtcttttcaattatatggtaatttatctccaaccataatattctctgatgggtagagaggagcttagtcctaccaacaccttgatttcagtccagtgaaactgatttcagccttcagacttccagaactgtaagagaataaatgtgtcttgttttaaaccactgagtttttttatggtaatttgttatagcaggcaaagaaaacgaatacggtaagtgtttaatgaaaggaagtgctggtggctttagttagttaacacacaggcttatagtggacattggttcgcacactattctaatcaccttacagatgttaattcagttctccaaccatccaaggaggttggtattatttactgttaaataactcaattgttaaagtctctcagttggtaagtgttgaagttgagattcaaatccatagttgttgatcttattatctggagacacaattcacatatcatacgattcaccaacttaaagtcgacaattcagtggttttagtatattcacaggattgtgtaccaccaccacaatcaattttggaacattttatcaccctgaaaagaaacctcatacctattaatgggcactccccatttcctccctacatggcccccaccgttctgagtcctaggaaaacaccaatctactttctgtccccacagttttgccaattctggacattcatttcatagcatatatcccattgaatgtatataccacattttattcatcagttgatgaatatttggattgtttttactttttgacattatgaataatgctgctgtgagcattcatggacaagtgttggtgtggacttgtttttaatttcttttggttatatacctaggagcaaaattgctgggtcacttgtatgtctatgtttaaccatttgatgaactgccagactgttttccaaagtagctggaccatttacatttccaccagcaatatatggtgattccaatttctccacatccttgccaacactttttattccctatcttttattatagccttcctaatgagtgtgaagtagtatctcattgaggttttgatttgtatttccctgatggctgatggttttgaaaatctattcatgtgtttagtgggcatttgtggatcttttttggaaaaatgcctgttcagatcctttgcccatttttttttttttttttttttgaggtggagttttgctcttgttgcccaggctggagtgtgatggcgtgattttggctcactgcaacctccacctcctgagttcaagcagttctcctgcctcagcctccggagtagctgggattacaggcatgtgccaccacacccggctaattttgtatttttagtagagacgggctttcaccatgttggccaggctggtctcgaactcctgacctcaggtgatccacctgcctcggcctcccaaagtgctgggattacaggcgtgagccaccacgcctggcctctttgcccattttttaaatgggtttacctttttatgattgagttgcaatgattccttatatattcccttttcagatatatgatttccaaaaattttctcccattctgtgggttgtcttttcactttcttgatagtgttgtttgcagcacaaaatttaaaagttttaaattttgatgatattcaatctatagtttctttggttcttatggttttgttgtcctatctaagaaactattgcctaatccaaagtcatgaagatatacatctatattttcttcaaagagctacatagttttagcccttgcatttaggtttttaatccactttgagttagtttttgtatatgttatgaggtaggggccaaacttcatgtttttgtgtgtgaatatctagttgttccagcaccatttgttgaaaagattattattttctccagtgaattgttttggcaccctgttgaaaatcaatttcccataagtgtgagcgtttttttctagactctcagttatattccatttctttatatatctagccctatgtcaattccacatttcttgatactacagcttggtagtaagttttgaaatcaggcagtgtgagtcctccaatttcattttattttttaaatattgtttggggtattatgggtcccattaacttccatatgaattttaagatcaggttgtcaacttctgcaaggaagccagctgagattttgataagattgcatcaactgtaaatctatttagagaatattgccatcttaaaaatattaaatcttctaatccatgaacatatgatgtctttctgtgtatgtaggtcttacttaatttccttaagtaatattttgtagttttcagagtgtaacttttgtatttcttttgttaaatttgttcctaagtatgattttctttttgatgctattataaatataattgttttaaaatttcatttttggtttgttatcatagatttactttttttgttgttgtattaatttttttattttaaaatgacttcaaaattacagaaaagttacaagaacaattcaaagagcatttcacaagtattcaccaatttaaaaaattctgccacatttatcattctctcttcccttttatatctctcccacacacaacagtcacatatagtattgttcctgaaccatttgagaataagttgtatatattatgttcctttacccctaaatatttcagtatgtatttcctaagaacaaagattttctcttatataaccacagtacagtagtcaaactcaggaaatctaacactgatagaatactttcaattgtagtccataatcaaattttgttaattggtcaaacaattgttatcatagatttacttttaacctcaattacgctcaatactatattcctcataagttcttagattctctaacagtgcttcaaataataatgacttcatgctcttaatgcaattaagattcatttaattcaatacaattgtctgttgtctatttacctctactcatattttgtatgtttttgcagttcatattttgataaaatattgaaataactctttttatctacttttttagtcctaaattctgttcccccttctcatttggctgatatattttgtccatctttatttttaatctttctaaatccaatttgattctctgttttaataaaggaatgtaaacagttcacatttattttatctgccttttctcattttattctctttagtgtttaatgtttttttctgttatgctttttgctatacagactctggactttgttatttgtttttatatttccacaaagctgtgaataacggacatcttacttttaattgtacttgtagcaatcttttttttttttttgaggcagggtcttgctctgtcacctaggctggagtgcagtagcataatcatagctcaatgtaaccttgaactcctgggctcaggtgatcctcctgcctcagccttctgagtagctagggctacaggcgtgcaccaccatacccagctgattttttattttttgtagaaacagggtcttgttatgttgcccaggctgtggaaataaaagaaaagcattccatcctggctaacatggtgaaaccccatctctactaaaaatacaaaaaaaattagccgggcgtggtggtgggcgcctatagtcccagctactcgggaggctgaggcaggagaatggtgtgaacctgggaggcagagcttcagtgagccgagatcataccactgcactccagcctgggagacagagcgagactccatctcaaaaaaaaaaaaaaaaaaagaaagaaaaaaggaaagcaaaacattcctgagcttaaatttatcttaatatcaaagtgaaattagtaatttttgaccccattatgagagaaggattaagagtttttgtgtccctgtgtcctcctttttcttattttaaatatttaatttgataatattataaattcaaatagtaaaaattatgttagtcacttatttcacaggattttttctctttatttggatattaataatcaaattcatccatccatgaatttaatgaattttaatatagttcttatctcactatgcctttccccattcttgggaccctaatcttgattcctttcataatgatctagtaagcatattaatttttagaaaggggatcagtgttataaaagagagacaacttctcttaaatatagcaatctttccccctcaagtcattggaaatattcctccattgtcttgagaagtttgatgctgtaaagaagttgctatagtttgaatatgtccccccaaaagcatatgttcaaaacttaatccccagtataacaatgttgggaggcaagacctactggaggtgcttgggtcatgagggctccaccctgatgaatggatcaatgccaataataaaaggacttgaagctgtgagtttgttctcttgctcttatgctctcttgccctttgctttctgccatgggatgacacagcaagaaggcccttgccagatgctggccccttgatctggaacttcccagcctccagaactgtgagccaaataaacttctgttgtttataaatgactcagtctgttgtagcagcacaaaacagactcagaagttgaggacaactgttttttagcctgaatggtttttgttccccatttctgaaatttacaactttcacaataagataactgggtatagacttcctttcaaaaatttttgcctgggatatggtaaaccctcttgatttccaaatttaggacttatttaggagcaagaaagatttcttctgtcacaactttgattaatgctgctgttttgtttgtttgtttttttcttcttcagggacctatttggatctcttatctctaaattgcctgcctgtggcctgcctgcctgcctccttccctctttctttctctttccctctctttcttctttctttcttttcttttttctttctttctctctctctttctttctccttccttctttattcctttcattttcttcatttatttttcattgcattctgagactattttcctaagaatttcctctatatcactgattcaattttccttaactatctcccatataaactttcattcagttacagtgtttttggcttccatgaaatcttttattttagcttgtttatggcaacatcctcttgtacagagttcaaaaaaacaaacgatttccatctattcctgcttcatatctattttagaggcaagcttttccttcattgttctttctattttcttgcaaaatttatttaatctaaggccttatccttgaaagaaaagagattccttttgtatgtatgtatggatgaatgtgtttttcaccttatcctaaaaagtatttaaggatgtattaggggagatttatcccagtctaacgttgatatggatggaatgcatagtctgcccatggctcccttaggttctgttcaggtcttggaaaaatgcaatcaccaaatgctagatccccatctaagtatgagaagacatctaaatcctccaggcagaaaagttcactcagacccaggaaagaaggcaaaagtctcgccatgtacagtagtcatgttccagaagatagagtgactagggctgtcagagttctgtcaatatggttgtccagaggcataaaggcattcaggaaggagcctttgctccttccccactgagagcaaacctctgttgaattagggagtgagctcctgttccactgcttagcagttttcctcagcctttttttggatatcatttctaagatctctttagacttgtggtagcatatggctgctagtgtggctgtttctgtgaagaacattccacgcagaggaaccaacatgtacaaagtcctgaggagaaattaagtgtttaagaaacaacaaagaatccagtgtggttggagtggagaaagcaaggaggtgagagctgagaggtaggtttggcctaaatagaatgtctagcatcctgcaggccactgtatagcctttggcttttacttatagagcaatgggaaaccactgtgagtgttgagcacaggagtgactttatccaattcacgttttaataggatcactctggctgcattgtagagaacagacataaagggatataagcagagagactagtcgggagactactgcagtaatacaggtaaaagatgatggtgtccatttccaggtagtagcagtggacacggtgaaaagtgattggatttgggatctaatagagccaataaaatctcctagttggatttagatgggaaacaagagaggaggaaacttgactccaaggttttgggccttccaagaaactagaaggatggagttgccttgagatgagaagactgtaggaggaatagttttgagtgggaagatcaggatctcggttttgggtgtgttaatgttccgatgcctatttgacatgggtctttcaaatagagcagatggatatacaaatttggagtttggggaagaagactggacttgagatacaaatttaggtcatcagatggtgtttaaactgagtgagacaggatttaaatccaatgagactgggtaagtgagtgtaactagaaaaaaaaaaaaacgacaatgctctaaggactgagccggatgctccaactttaaaggttggggataggaagagaaaccgtccaagaagattgagagagagagagagagtgagtgagtgagtgtgtgtgtgtgtgtgtgtgtgtgtgttggagtgggggaaggaggataaactaggtaggtgagtatggtgtcctgggagccatcggagaaaagtgtttcaactgggtctaactgggtctaatgctgctcatgggtaaaataagatgaaactgagaattgaccctggcatttggcacagtgaatgttgaaagttgttagtaaagatttcacaggtagaggaagtcttttagggatggaaatatttacagagaggtgtgtaacttcctggtgctgatgtccatccagactgcagacattttctgtgaaagaaaagccagaggcctttcagggccaggaagtatggtctttttcaattgtgtttttctcaaaaagcttgctctaagattcacattgtgaagacagcccaaactccaggcccctacctactgttactcttcccagaactgccttatggcttcagagagcagatctgtttgcaaaactaatggaggattagggctggggaggagtagaagatcacatttcaaatgtggtgtaggtatctatgcatttggcattttaaaaagactcagtggattttagtgctagaagagacttaaatatcctcaaatctcttaattaaaatgaaatcaattgcatttgctgttttaattacaaaaataatacaagtttataacaaaatttaaaatatataaagaataaataagaaaataaaaatttgtgtaagtttactactcataactctgtcatatgactttttagtctttctcttgttccctctctttggcttactttttattgttttttagtatttattttctacaaatttggatccatgttatgcataccaattgtaatcctcaattttactttacagtttgtcgtgacaattgaatggcttttaccatatgatcttttaatggctgcatataatattccatcatttgaacatgtaccatatgtctatttaaccatttccttttgggaaacatttgagaaacttccagttactttccaaattatttttcaaaaacatttgcaagttattttccaaatatataattatattataacttctgtggattaatctcatttcacatctttgacagtttctttaggatcaattcctaaaagtagaatttccaaatttctttccaaatttcagcagtgtatgagtgatagaaacattgaagtcctgaggtgggaaggaatgtgctcatgttgcacaactggttggtggctgagtgtgcccagttcccttgcctttttgaaagagcccctctccttttcttcctaccatgctttctatagcatttcagcctccttttagtgatgtcccgtatgactccttggaccttgatgacatttaaccttttcctgaaaactcttggctcccacttatcccaaactagtcccccagtgtatctctgggcatgaactctgaacaattagagatgtcctttttcatgagagaagatgtacacttctcagatacattttctctttaggggtacaaatgttttcccattagtcaagaactgccacccattagatattccttcatgtatccgaaggcttcctggagttttcctgacttctttttagctttactgatcatatattttctctctaaaatcttactcactgtagtacagacatactttaaagttattgcaagttttgttccagaccgctacaaaggaagtaacgtgattaaaagagtagtatgaatttttggtttcccagtgcatataaaagttatgtttacactatactgtatctattaagtgtacaatagcattatgtttaaaaaaatgcaccttaattaaaaatactttattgctaaaaaaatgctaacagtcatctgaaccttcagtgagtggtactctttttgttggtggagagtcttgccttgatgtttatgttgctgacttatcaggagttggttgctgaaggttggagtggctgtggcaatttattaaaagaagacaacaatgatgtttaccacattgaatgactcttcctttcgtgacagatttctctgtagcatgtggtgctgtttgataacattttactaacagtagaacttctttcaaaattggagtcaatcctcctccagcactcctgctgtttcattgagcaagtttacataatattctaaatcctttgctgtcatttcaacaatgttcacagtatcttccccaagagtagattccatctcaagaaaccactttctctgttcatccataagaagcaactccacagctgttcaagtttcatcatgagattgcagccattcattcacatcttcaggctccactactaattctagttctcctgctgtttccatcacttctgtagtcactttctccactgaagtcttgagcccctccaagtcattcatgagggttggagtcaacttcttccaaactcctgttaatattggtattttgacctcctcccatgaatcatgaatgttcttaatggcacctagaatggtaatttttgtccagaaggctttcaatttactttgcccaggtccaacagaaaaatcattatgtatgatagctatagccttattaaatgtatttcttaaatgagacttgaaagtcaaaattactttgttttgtgttgctataaaggaataccagagacagggaaatttataaagaaagaaagtttatttggctcacaattctgatggcttgaaagctcaagattgggcatctggcgagggtttcaggctgcttccactcttggaggaaggtgaaggggagccagagtgtgcagagatcacatggtgggagaggaagcaaagtatagagaggccggtgctagcctctttttaacaaccgctctcatgggaacgaatagagtaagagttcactcacccccaaagaaggtcattgatctatgcatgagggatctgcccccatgaccaaacacctcccatttggccccacctctaacactggggataaaatttcagtatgaggcttggaggagacaaatatccaaaccgtagcactccttgatccatagactgcagaatggatgttgtattagcaggcatgaaaacatttatcttcttgtatatcttcatcagagctcttggatgactaggtgcattgtcaatggacagtaatattttggaaggaattttttttttctgagaagcagacatcaacagtgggcttaaaatattcagtaaaccttactgtaaacagatttatggtcatccagccttttttgttccatttatagagcacaggcagagcagatttaacataattcttaaaggccctaggattttcagaatggtcaattaataatggcttaaacttaaagtcactagcttcattatcctttaacaagagagtcatcctgtcctttgaagctttgaagccatccttttttatggctgcatagtattccgtggtgtatatgtgccacattttcttaatccggtctatcactgatgaacatttgggttggttccaagtctttgctattgtgaatagtgctgcaataaacatacatgtgcatgtgtctttacagtagcatgatttataatcctttgggtagatacccagtaatgggattgctgggtcaaatggtatttctagttctaggtccttgaggagttgccacactgtcttccacaatggttgaactagtttacactcccaccaacagtgtaaaagcgttcctatttctccacatcctctccagcgtctgttgtttcctgactttttaatgattgccattctaactggtgtgagatggtatctcattgtggttttgatttgcatttctctgatgaccagtgatgatgagcattttttaatgtgtctgttggctgcatagatgtcttcttttgagaagtgtctgttcatatcctttgcccacttttcgatggagttgtttttttcttgtaaatttgtttaagttctttgtagattctggatattagccctttgtcaaataggtagattgcaaaaattttctcccattctgtaggttgtctgttcactctgatggtagtttctttagctgtgcagaagctctttagtttaattagatcccatttgtctattttggcttttgttgccattgcttttggtgttttagtcatgaagtctttgcccatacctatgtcctgaatggcattgcctaggttttcttctagggttttcctggttttaggtctaacatttaagtctttaatccttcttgaattaatttttgtataaggtgtaaggaagggatccagtttcagctttctacatatgcctagccagttttcccaggaccatttattaaatagggaatcatttccccatttcttgtttttatcaggtttgtcaaagatcagatggttgtagatgtgtggtgttatttctgaggcctctgttgtgttccactggtctatctctctgttttggtaccagtaccatgctgttttggttactgtagccttgtagtatagtttgaagtcaggtagtgtgatgcttccagctttgttctttttgcttaggattgtcttggcaatgtgggctcttttttggttccataggaactttaaagtagttttttccaattctgtgaagaaagtcattggtagcttgatggagatggcattgaatctacaaattaccttgggcagtatggccattttcatgatattgattcttcctatccatgagcatggaatgttcttccatttgtttgtgtccttttttatttcgttgagcagtggtttgtagttctcctttaaggggtcctttacatcccttgtgagttggattcctaggtattttattctctttgaagcaattctgaatgggagttcactcatcatttggctttctgtttgttattggtgtataagaatgcttgtgattttcgcatattaattttgtatcctgagactttgctgaagttgcttatcagcttaaggagattttgggctgagacaatggggttttctaaatatacaatcaggtcatctgcaaacagggacaatttgacttcctcttttcctaattgaataccctttatttctttctcttgcctgattgccctggccagaacttccaacactatgttgaataggagtggtgagagagagggcatctctgtcttgtgccagttttcaaagggaatgcttccagtttttgcccattcagtatgatattggctgtgggtttgtcataaatagctcttattattttgagatatgttccatcaatacctagtttattgagaatttttagcatgaagggctgttgaattttgtcaaagaccttttctgcctctattgagataatcatgtggtttttgtctttggtatattctgttgatttgggtggagagttctgtagatgtctattaggtttgcttggtgcagagctgagttcaagtactggatatccttgttaaccttctgtctcattgatctgtctaatattgacagtggggtgttaaaatctcccattattattgtgtgggagtctaagtctctttgtaggtctctaaggactcgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctacttttttttgctttccatttgcttgttagatcttcctccatccatttattttgagcctatgtgcgttccttgcacatgagatgggtctcctgaatacagcagactgatgggtcttgactatatccaatttgccagtctgtgtcttttaattggagcatttagcccatttacatttaaggttcatattgttatgtgtgaatttgatcctgtcattatgatgttagctggttattttacccattagtttatgcagtttcttcctagcatcgacagtctttacgatttggcatgtttttgcagtggttgctaccggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattatgggttgaaaattcttttctttaagaatgttgaatattggcccccactctcttctggcttgtagagtttctgccgagagatccactgtgagtctgatgggcttccctttgtgggtaacccgacctttctctctggttgcccttaacattttttccttcaccttggtgaatctgacaattatgtgtcttggggttgctcttctcaaggagtatctttatggtgttctctgtgtttccggaatttgaatattggcctgccttgctaggttgaggaagttctcgtggataacatcctgaagagtgttttccaacttggtcctattctccccatcacttttaggtacaccaatcaaatgtagatttggtcttttcacatagtcccatatttcttggaggctttgttcatttctttttactcttttttctctaaatttctcttctcacttcatttcattcatttgatcttccatcactgataccctttcttccatttgatcgaattggctaatgaagcttgtgcatgggtcacatagttctcatgccatggttttcagcttggtcatttaaggtgttctctacactgtttattctagttagccatttatctaatcgtttttcaaggtttttagcttccttgcgatgggttcgaacatcctcctttagcttggaggaatttgtcattaccaaccttctgaagcctacttctgtcagctcgtcaaagtcattctccatccagctttgtttctttgctggcgaggagctgtgatcctttggaggaaaagaggccctctggtttttagaattttctgcttttctgctctggtttctccccatctttgtggttttaatctacctttggtctttgatgttggtgacctacagatggggttttagtgtggatgtcctttttgttgatgttgatgctattcctttctgtttgttagttttccttctaacagtcaggtcccttaactgcaggtctgttggagtttgctggaggtccactccagaccctgtttttctgggtatcaccagcagaggctgcagaacagcaaatattgcagaacagcaaatattgctgcctgatccttcctctggaagcttcgtcctagaggggtgcccgcctgtatgaagagtcagctggcccctactgggaggtgtctcccagttaggctacatgggggtcagagacccacttgagtaggcagtctgtctgttctctgagctcaaacaccatgctgggagaaccactgctctcttcagagctgttagacagggacgtttacatctgcagaagttgtctgctgccttttgttcagctatgccctgcccccagaggtggagactacagaggcagtaggccttgctgagctgcggtgggctctgcccagttcgatcttccaggacactttgtttacctactcaaacctcggcaatggcggatgcccctccgcctgcctcgcaggttgatctcagactgctgcactagaagtgagcaaggctttgtgggcatgggatccgctgaaccatgtgtgggatataatctcctggtgtgccatttgctgaaactgttggaaaagcacagtattagggcaggagtgtcctgtttttccaggtaccatctgtcatggcttcccttggctaggaaagggaaatcccctgatcccttgcgctttccaggtgaggtgatgtcccgccctgcttcagctcgtcctccatgggctgcacccactgtccaaccagtcccaatgagatgaaccaggtacctcagttggaaatgcaaaaatcacctgtcttctttgtcagtcatgctgggagctgcagactggagctgttcccattcagccatcttggaaccaagatgtttctaatgacagacagggaaaagaaaactgacaagacccaggcagttgacttgactcttgttagagctcaacaggtggtttgtagttgaggaagtgtcaatggctaaaagatatgagaaaatatccaacttcactggtaggcaaacaaagtaaactaaaacagtgaggtactatttttcacatacctaaaagatttttttcttaatatccagtgttgttgaaaatgtggggaaactaatattccctaactgttggctagaatgcaatggataaaatttgacattttgctctactttttaggatatgtcctcaaccttatcttttaacctttttgttaaaatttcttattttggttattactgtttaaatttctaaaatcttgtttttattttctgatagtttatttaaataaaattgtacacttttttggtatcatggatgcaatattttctcctctctctgatgatagtaattaatgttttcttctttgtttcctctgtttttttaactgtgtttttaacttttcatttatgtctttcatgttgaagaccttttcacatattatcttacttaatcttcactcagttctatcaggttaatattattatccttgttttatagttaatgagtcttagagagtgtatcattgttttatttctcttaccatgggcagctgaaaaaattgttggtcatagaccaaaagtactggtcacagaccagccaaatccacagtccagcttcttaatctagctggattctctgttgaatccttaaaatctctcctcaccacctccctaaccccaacacttgtctcattatattagacaactttgttagaattttttccaagttgaattaaagtctttctccttccctttacctttccactgtcattagaactagttctgccctgtagaccatagagatcctctcccatttctacatctccttccataggagatagtccctcaaatatttgaaatgatactgtcatgattcctccacatctgccattccccagcctgaagaggcctggttctgcctactttattctgcacctttgtgaaattctgcttggctaacatttttggaacgctttggaccatgttctctcaaagtctcactttaagggtgtgtctataacttaacatagggtccagatatgctctgaaagacttaacctcaaatgggatactgtcattttattaatgtatgctggagttggcttagtttcaatttgaggaatttcatgtgctgcaacttcttttcctagaaagtaatacttttgatgtttctcacaaattataatttctaggactctgagctgcctacttctacttactcctttttagttagggttgtgtgtgtgtgttgtccttactggttactgcttttacctcctagggtctttttttcaaggccattttcacttaaccttagctattaagcccaagtggaggtgctaaggtgatttgaaaaatggaaatatcttaatttaaattgcacaaacaaacactatcgtgcatatttgagaagtaaaatacaatgtaaatgggggcttttcaggcaccatgttaagcacttggtatatattatttcatttggcttttataacagcattatgaggtgagaactgctgttattctcaatttagatgtgaggaggtgtggctagttcgatacaactaggagggccagaggtgtattgcagacctaaacataccagactcaagactaatactgctgttacccacagaaatgaagctcacatattgtattttatgccaattatagctgatgttgttggaaggaattatataatctgctgaggtgtattgcatacttctcatctttaacagaacataccaaacataaaaacttttatttgataggttgaggtgatgatattgaacatctgtcctcccatgttcattgtagcactattcacaatagctaagatttggaagcaacctaagtgtccgtcaaacattaatttttgtggccctttaagtaagaataaatatgtggccctataaatatgaatcttatgtatatttgtatagacagtgccaagcatattgtaggcaactatgattcaaatcactgcacacatgcgtattgaatgagtacatgaatgaatcaatgaagttataaaacagcaatgacctcaaggtctattaaagtttttagaactatttgccactacactaaatcttttataaactgttttgctttatgagtctatgtgtctgctttttgtaatttttttcccttctccctgtcattgtaaatagaatatctatggacatgaaatgtgcctgaagttctttgcaaatggaagactaaaaggaagttgccccaggcaattcagatcattgtgtccaagagaggaacaaactcatgtttgatccaggtcatgactgtattcaagggctttgatcctaggtgtggggtccagctgtaggggcatcagggaagtacattcttggtctgtgtccaagtccttggtcagggaagtctgtcttagcaccatggagacaggggaaactgaattcagaccttatgtgacaggagtggactaaaaccagtgcatgcatatgatccagcaattccatggctaggtatacacccaaaagaaagaaaatctgtatatagaagagatatctgccctcccatgttcgttgcagcattattcacaatagctaagatttggaagcaacctaagtgtccatcgacagatgaatggataaaatgtggtacatatacacaatggactgctattcagccataaacataataaaatcctgttatttgcaataacatggatagaactggaagtcattatgttaagtgaaataagtcaggcacagaaagacaaacttcacttgttctcactgatttgtgggagctaaaaattaaaataattgaactgagagagagtagaaggatggttactagaggctgggaagggtagtgggggctgggtagaatggaaaaagggatgggtagtgagtacaaaaaatagttagaaagaatgaataagacctagtatttgatagcgcaacagggtgctatcaaacctattgccttggtttgcaatagggtgactatagacaataataatttaattgaacatttaaaaataactaaaagagtataattggattgtaacacaaaagataaatgcttgaggtgatggatacctcatttatcctgatgtgattattacgcattgcatgcctgtaacaaaatatctcaagtaccccataaatatagatacctactgtgtacccataaaaattaaaaataaaaaaataaaaataaaatcagcatagggagccagtctcctactaatttggtcaacagtttatgtcaggttgtagtcttaagggtggaaacgaaaagagggccaggaccttggtagccagaccaaagttcacgactgtgttatatactctgaaatggatttagccaaggaggtttgcccagattctcccataggtgatgttaaattccttccaggacacttgaccccaggcatgggattgatggtgggttttcaggtgctctcccactaaagcaaaaatgtccataatatattccaggaattaggtgagacagagcctcaggaaacaagcctgttatgccttcaccaaggcagggcagagctggataagggtgaacagaaagggacaaattattgatgagagttctgtgagtagaaactcctttctcttctttagaatttctgcctccagtttgttaatgccacttccaaaatacactgctctgagctgaagataatactgcatgcagatagagtgccatgaaggcattggtttgcagtgatctataaaggactaatgtgccaggctctgtgttaagtgcttgactttcaccaccttgtttacccctacaacaacaatttttaaattgccctattaagatatagagcattctatcattctaaaatgtttcctgtgattcagtatatatttatttactttttggttgatttattgagtgaagaactgaaaatcactttatgggtagtatatttccttttttgtatcacatctgaagtgagacattgtcaaactgggtaggtatgtccagaatgaggaaggatgcagagactatgtcatataaggaacatgtgtcaaaggaggtagtaaaaatgaatatgactggggctagtagttccaagaaaaaattggaaacatgctcctggctaatcagaaggtttagctaaaatattttcagagcctatcacgtgaacctggtaaaaacaacccagtattgggcaaaagagttagggcaatttgaggaagtcctggcgcctaggctaggtggtgatgaacagggaagatgtgaaggaaaaaggaagagagaattttcccccttgccttattgatttcatcctgcattagttcatctcagctcttcctgttgttcccccaaccccaacagtttttctattcttttatctatttttgaattgattctctaaaagttctaaggctgcgttttcagctcctggtcatctggataactactggtttcaggattcttggggataatgggatggaggcatgggaggagaatgtctgggttaaaaagatactgagctagaagtagaaggcttggttgaattttacactcagcaacatacaggttgggcaagttgctttgctctttagcttcagcttttgcacacctataaaatggaagcggtgtgtgtgtgtgtttgtgtgtgtgtgtgtagtgtatgtatccgttgtctcctagggagtttctttgaggatcaaaaaagagagtggacaaaaatgaattttgtaaactgtttttgagagcatctaaatgtagttttatgagtagcattgttaccattgtcgctgttctatttgctgaatcttgtttaatttggaagctccctaattcacagtgatttgtatagtggggtcatcactctgtaggagctctaaatggagactttgtccatgatttccaaaaggtcatccaccccagagtcacatgagactggaaagcaaatctttttcattaattggcttcaagtactttcagcttcaaatggaggtctctaagggtccttggctggcacatcaagggggcatttcaaagaaagtggcaaaatcttgactaaacttcagagcaaacacgcactcttttctttgctactctctttctaaaaagaaaaacaaattatactggtctgggttgtgtgagcatgtgtgtatcagcttgttctaattctcttttcccaaccccttctttgcttgtcccattttcaagataggataacacccaggtttttatattaccttctgtgttaggactttcttaggattcctaaaaattttggctaagtagcattaggcctgctctatttcacaggtaggcataaaaaaaaaaaaaacagtgtccacttcttcaagacagtatccaattcttcctggcattttgatggtaggaaaaatatttgaatttatttttagggcaagtcacgtggcaaaaagaataacaagtatttatggttgcctggggaactcagcttctagttactactgattatgggaaagaggaacaaattttaagatgaggcaaaattggtgaccaagaactagaatagcaggtggcctgggaagaggtgggggtgaaagcgggtagaaaatctatgcaaaaatataggttcctagtcattttttttcttttgtctctttcgattactatatcctgccttcctgcaggaggaatgtagtaagatgctttgtataatcaggtgctttgcttgttcttttttttttttttttgattgtagaaaagatcagtgtagcaatttgaccatttgccaaattacccataagatagggtaggcattaaaaacccagggacactgaagtcaggaaatccagcttcttgtatcctggatctttcttggaacagcctgtcacatatgacatctaatgatgtagcaccagctgctcacaaatacaagttccttagagtatatagacattatggggccactaaaaatgtcttatatggcttgctgccagcattttcagcactgtctctcaccagcagccactctctaactgtttgccctagccaagctcagagacatggggactcctatgagctccattgtcttgtgtagagaatggggctaactgtagagtgtgaaggcctggggagaaaaactcaggctgtgtttcctagtcaccccaagaccttgtggacccaggaagtagcagttccagagaccaattgctatatggctttctgcatgcccactgcctttgtcttgctgttgtcgcaggaaacatctggtgtacatccagtgcacccagagccttttggaaaacacctatcggcctcagtactcttttccctcaggctggcagacaatgaggaaggaggagagagagctacccattggaggaggaagtaaagctggaggctggggtagtggcaagatatgagcattcaggtctacaaagcttcaagtctctcattacttcactccatcaggccaggacaatcatgggggtttggcaggagtggcgttgcagggagtttaggcctaagggagtgtatgtgtgaggcacaaagtaataaggactggactttgttacctgaggtgatgagggtgacaggcccacatggataaattaggaaacaggcaacaggttctatagctgcatatcagagactcacagagtggaaatcactttgatgagggcagagcagcagcccaaatgaccggatacccactgtggaagtcatcccctcatcactttttcattcccaagactcagctcttctctgactctgttactttgttggcaactcccgttgcagtgtctgggcaatttctctcagttgttacaacttgcattcaagggcatctcttgttccaggccaactctattgatctctgaaaaaatgggaggtagaacagtgttcaagcattcagataaacctaccttccaatcatagttctgcttcttactagctgtcccaccttaggcaggtaagttaacttatctgaatgtcagttttcccgcttgtaaaatgcagttggtattagtacttaatttaaagctttgttatgaggattaaatgagataatgcaagtccagcctatagttgactttggcttaagcagcagttgttggaacaatctgttgtggccaagatcataaggtctcaggacacaaggttggccacaaaaccaacccagcaacttatgaagcagaaaccatctgtggtaacttttctcagaaggtggctatgtaaactggcctcatttggctgaaggaagttgggaggtggataggtgggggaaataaaagaaaagagaagagttaaatgagtgtcaatgtctcctaataattaagagcttagaatccctggagtcagacaggcttgtcctcaaattccagctctgtgcttaccatttgtgtgaccacgaatatgttatcaaacttttggaccccagttttctcaagtgcaaaataggctaatgatatctatggtgttgtgataatttgatgaacaatgagtataaagtgcttagcacagtgcctgctacccagtaagaacataacaaatggggaagaggatgattgtgaggatggcaagcgtttttcttggcctagcatccagtggtgctgctcttgttatctaaggaggcaggaaggagacaagagtgggcacttggtaaaactggatgcaggtgaaagagaggtgtttatctgagggcctcatatctgagcctcacttctacctcctgaccccttatgtcctcccaccctgctacccagtgcttgggtgctgcttaaagcactttgttccaaactccctagggatggtttgcccctccccttcccataatgactcaaaacttctgttcattctgttcagctttgccacagccaggttttggtgagaaggaccacacagcttcctttgactttaaggccaccagaggtatttctttttaactccaccaaattggaaattagtggagcaataagcaatggaggatggagggtactttgagcacagagacttccatattgccctgaaaaggagcctgaaagacaaggttgaaggagacgcaggttcagtaggggagggagaaggaatgcatatccctagcttccgtattgcactaccgtcctttgcctgagaaagcgaaccctggtgttagaatctgagactaatgttgttccccaaggaggaaggcagctcaggactggttcccaccaagccaagtgcagtcctagattctggctccctgtgcccactgtcagcagagaaagcaccaaatctagtgagaaaaagtttcagcatatcttaaaatgacagaaaccaccttatccaacctagacttttctgccatgggaaaaagatgaaacctggaaatctgggaaacttaaaattttcaacaccatttataaatataaaaagcctctggttacttgagtgttgcacatttagatatttgattttgtatgttgattacaaatggagttgtggccttgcaaaccatcacaatcatcattataatcattgaatttatggttcatatggcagtttcttatacattattcaatttactttaatcctcttaactctgtcaagtaggtattaccattaatcctcattttacagctgaggaaacaaggtagaaaaggtgacttactcaagatcccagagctagtaacctcgaggttttgttttgctctttggttttgttttcaatttaggtaatgagctaccaacattagaatgatgcatagaaaggtgctgggccatggtctttgcatcttccaataaagcataataagatatattaatttccaggaaaagagttgagggagaaaaaagggggaatatgatttattgatacaacttttagggaaatttgatcagcgtagtattccaagctttattttgatcattttcaaaccaaagtttaatctgttaaaatagacatgcttcttttactctgtgtaaacatgaagctccacatattacaagagggcttggaaggatgggcctactaattggtacagagcaacaaagtctattttttatttaaagatataggtgttttaggaaggagaggggatgttaaagatagtatttggctgtatgaaaatatagaagtatgagactggcagctctgtagagggctttgggtgagagaatacaaaggagagaaaatgagaaagacattgttgtatgaatataagataaaccaccccagttaagtgcaggctctggatgaagtatttctattacaaatgacagagctgggacagaagcaatgtagactgttgatgcagtatctcgaggggagtttgcacactggatatgtaaattattattgtttaaagatattcttccatcttggggaagttgcttaacctatattatttgcatttttcttatttgcaaaatgggactaaaacagtacagttcttaccatatgtaatctttgagagtattaacaaaaaaaagtatgtgaagtgcctactacagtgcttgtcataaagaaggctgcagtggatatggcaacactttcctccatcaacccccacccccaaattcctttcagttatgaaaattctgaaacactgtaactttacctatatatttattggatatctacttttcgaaaagtagaacatgtgaagaattcttgatttttccttggagatacctttgcaagttagaggaagatattagtgcctgtcttccttggtttaattttaattcaaaagaaagatatgattgagaaggtaggagaaatgactgactagttcatctaggcattaatagtcctaaaagagggaactgtaaggcaaccagacacatggcctcaattttttaagaaggcagatttaaaaataaatacatgcataaataaaattttaaaacaaaaccagaaaaaatggtagacgaattctcatgatcaaatttactaaaaagaatatggctttaaaagatgagtctaggccaggcatagtggctcacgcctgtaatcccagcactttgggaggctgagttggggaatcatttgaggtcaggagttcgagaccagcctggccaacatggtgaaaccccatctctactaaaaatacaaacattagctgggcgtggtggtgggtgcctgtaatcccagatacgttggaggctgaggcaggagaatcacttgaacatgggaggtggaggttgcagtgagctgagattgcaccactgcactgcagcctgggcgacaaagtgagactctgtccaaaaaaaaagaaaaaaaagaaaaaagcgagtctaaaaaagaaataactaaatgagaaacctgattatacaataataaataatcataatggatgagaaaagcgaaaagcagttaaaacacttatttgatctgaggaactttacgaggaggcgagaaagtatgggtgagtttaattttcttatatattattttctctattttctaaaaatctctatggtaactatggcttttataaaataaacagttttcccccgaggatttgtacaatagagaaatggatgcaagtaattgagaagaatggttagaagctaggagaattcttttaaaagtagcatcacttggactaaatatctgttggcgatgaggcatggaggaaaaaatgctaaagataacaaaagttattttggttacagttcagtggaagaacatgaacaggaagaggaatgcatagtgatcatggatgatgcaaaggaattggaacctctgaacttctattttgcttccatctagaaaaatggagttcaatcagtacaaagtaaaacatacacaattaagaagtaattgaaatggatgagaatttattgagagcccttgacttttctaaatgagtttaaagaattttagagagatatgctctttaaattattggaattggtaatctaaatagtaaaagatgaaagagaatggatccaggaaactcagtatgagttgatacgtggcaaagtcttaaatatggaagatttgttaacacctaaaaaagaaagctccagtcacttgaaactggcatgcatttattgaatcaacttatatcaaattactcttatttgtaaaatatttagaagggctctagggttaaaaaattttggcagtctctcaaattcatagaaacagtgtacatttgacccttgcacaacacaggtttgaattatatgggtccactttgcaacaattggaaaaactcaaagatgaaccatatagcctagaaatactgaaaaaaattaggtaaaaggtatgtcatgaatgcataaaatatatgtagatattaatctatcattactaccatgaaatatacacaaatctattataaaaagttaacatttatcaaagcttacacaattacagaccatgcatgacaccacttacagttgatagaaatttaaacaaatataaagatgcagtattaagtcataactgcataaaattaactgcattacatactatactactgtaataattttgtagccacctcctcttgctattacagtgagctcaggtgttgcatgtatctgcctagaatgccataaattgcatattgcagtaaaaagtgatctctaatggttctcaagtattttgagtatttttcattgtgtttagtacaacactgtaaactttgaataacaacatgggacccattcaaagtaccacgagtgatattggaagtgctctcaagaagcagagaaaagtcatgactcatgacattacaagaaaaagttgaattgcttcatatgaactgtaggttgatgtctgcagcggtggttgcccaccacttcagatagatgattcatctcatagatggggatcttgcaaacttaccatatcgataaatacagtacagggttataaatgtattttcacttctttttgattttcttaataacattttcttttatgtagcttactttattgtaagaatacaccatataatacatgtaaaatagaaaatatgtgtaaattgactatgtgtgttattggtcaacagactattagttaagtttttggggagtcaaaagttacatgcagattttcaactccgtggaggtcagtacccccaacttccatgttgttcaagggctaactgaagtttatttcatcaagagtttaaaatgttttttagttgtagaaaatttcaaacaaatacaagatgaagagagtaatataataaaccactgtatacttattacccatcattacaaactatcaatattctgagttttttttgtttcatctatcactttcctcccaaccatacctttttgctgtttttggaatattttaagcaaatctcaaatattatatcattttacttgtaagtacttcagtatgaaaaaaatgtatagcagagtctttcatgatatgcccaaagatgagttggagaaatagagattggataagaatgaactaaaaggattggtactaacataaaccatggccaaatcatgttgataaatagtttgaaatctaccttgaagaaaggtggtagggaaatatactacaagattctgtccttgttgttgtcttatgtggcacgatttatcaatgatatggccaaaaatttagaaagcatgcttagcagatttgctaacaatacgtagcttttagtgagactgcaatgtattacataaaaggatcaagtatcatcaggctggaaaaatgagctgaaaccataggttgacatttaattgatacacacaaggtgagattcctgacttggaggtagttcatgggaagatctgtaggttttactagacccgtagccctcagtatgagtatctaaaatgatgagtcatatttaaacagtgttaatgtttagtttccaggtgaagggctataataacttcactgtatctgctatattcagttcagagcaatgtattttgagaaggacattacaaactgaagggcatctagtggagggtaattagggtgacataaaatctgaaaatcgtgatatgtaaagaatggtaaatggaactggagctatttagcctggagaataggggacttgaggatggggtttatatactggcaacccatgaggacttgaaaaacaaatttttaatgaagtaaacaaattctaatttgctttgtagcttcgagctgggatcagagagtggaagttagaatgaaacagaacttaggtcaagatagattgctaacagttagacatgtctggcaatggcttagactacctggatatgcacttctgtcccatcagtggagaattttactgcagagggtaaatacccatcttttaaacaggattaccacttggaaggagttggactaagttagaggttcacaagggagaactttggctgtacattagaatcacccggctgggggtagaggtgttaaaagtgaacagtgcctgggccccatgctagaaattctgatgtaattgtcccaggtgagactacagaaagtccccagggaactctggagtgtgtgaactctaaggatcctttcaactttgagatttttttttggtttgaaaaagagaaatcatgttcatggggggtattttagaagtcagcatggtggaaaacctgaagatgacagtgaagtcaggcacaaaactgaactcaggggagtaaagagaattgcttaagagagactaaaagtgccagagtttaccaggagacagagaagcttagaggagagggtgccttgcatagttaaaaaaaaacatcaaaagaagtgagagtgggaatggtattaggagaagagagcgtggctgaagaagatgggagtgtccatcagacaacccaccctgctttgcctgggactgagaggtttcttgggatacagcactttcagtgttaaaaccaggacaatcccaggcaaactgggatggttggtcacccgagtgccccataagaccctgtcaaaagacaaaattacaacaaatttagtttaaagatctcaataggctttattgcaattttagaattaggcaacacttcattccataaaacagagtaagtgttccaatgagttgaccagaggcagcaggctttctagacagagaaagggctgaagaaagcagaaacaaagaacaaaaagtagattggacatttcaaagttactttcattgtgggcatagggagatagaaagatggaaagataactgattggttaacatcgggttactctgttgtaagaattaaaacagagggaactgcatgattgccagttgaagactgaaactggcctgttgggaaattaggctgttgcctctctctcctgatttcatggaagaccagataacaaactcaaggtttggagaagcagaaccttagataagggactctattttggtttttaggctggtctgttggggcctagtgcaggggtttagtccaaaacagtggcctcctataatttttgttgaacacccataaatgaaggcagcacgggaaagcatttgttatcctagtcactcttcctgcagagtaaagatgtgctctgcattcatctgaattcatggctttggtgtgcgtaactgcaaaagctgaaatgtcatgttcactctggccacgtattccactcatagtaccatacttgtgtgtccagcatcttgccagggtgctggtcttgggcttactatgctttctttggggtgccttgggattccttacgtcattgcttcctcccaacaccagctgaaacctcctgaagtgattttgaagcttgtttctttgaatagcttcttagcaatttcctcactgctatttcagttcccctcccaccattgtgtgaaacagtgccaaagaatttcattaaactggctgacttcaaggatggtgaactaggactgcttctaaaaagcaggctgatagtaactgagggaattgcctaataaggaatagacgggaggcatgctgcccctacataatctcttccttataaagagagaagtatggatgggatatgttgagttgtttataaaaaataatgaagggaaaatccccctaaaattatggggaaaaggcccctggttgggctttaagtatagagaataacttgggtagtcttcacccactgtatccctaaaaggcctcacaattgctcttcagtctctttctccccttctcatccgccattaattaggaggttacttatgtgtgttatgaattaaagcagtggttctcaaagtgtagtccctggacctgcagcagagcatcacctagcaacttgttagaaatgcatatgccctggcctcacctcagacttactgaatcagaaactctgaggatggggtcaagcagttgtaataagccttccaggtgattctgatgcaggtttatggttaagaattggattagagaaactatgtttttagaaggttctttaaaggagaagtccagggcctaccctctgacatggggctgaacaggaaagcagcaagcagaagaaaccagaactaaccactgagccacggtgggtggtggtttgacatttatgtgacaagacagttaatgtgacaggaaagaaaaatgaacagagaattgtgaaatcaaataggatcagaatgatgtcacagtggtcaatccaattaattcatatcattacaaaattagaaagtcactaatgactaatttctaatatatatctgcataaaagggcattgtatgatatgaattggatttttaagtatacagtattttgtttcattttggagacatagcttttagtaaaaacatgtccaataggttctagtcaatccttaattgaagctctatgttgacaggaaaatagaaactcattgaattttaaaaagatgatttggctactacagttttattattattattttttagagttctgtagcaaagaatcacagaggccaaaaatgtgaaaaaaaaagtcatatggcttaatgatctttgtaatcataaccctatcaaccataacaaaaacaacaatcataagtacagttgccatttatcgagtgcctactctgtgcagacactgctgagtgctcagcacgggggatgaagtcatggataagcagcagacatggtccttgccctcctacccagtgattcccaaccctggctgcacttggcaccagggagccattaaaaaatgtcagtgccaggaccccagcccccgagggattctgatttaattgctttgagatgggaccccagagttggcatttttacaaaggtctccagtgaacctaatgtatatatccggaattgaggactgctctggtgaaagacttacatatgtaaacaattcattataatagccttaagtgctatgaagaaaaagctcagagtgttgtgaagggtaccagttagtgtggggttcagggtagggttttctgaggcatccttgaggaagtgactttctgttgggatctgaagggtaaataggaaatagctaagcaaagaggatgggaagggaatgttctaggcagagtacataaattgtgctagggctctgggcgaggacagcatagtgaaatgggggctgaaagggggcaaacagtgaaggaaatactgtgattagagaagtggagacccagggaggggccagaacatacaggacatacgggctagataaaggattgtgttctttcttgtaagtaatgggaagctgtggagtattctaagtaactagtggatgatgtgattatatagaccctttgagaagattactctggccgtagttggaaagcagattgatgataggtaagagtggatgcagaggaatcagttaggagtcttctgtgggagggcatgatgatgggactaagaagacattagagtgatggagagggttacatggcattgaatttttgggagattccaagacttggtacaaggcctcagggacatttgctgagttagtgagttgcttggatataaagggtgagggtggggaaggaatacaggatgatgctgctgttcttggtgtcagtaactggatgagtggtgatgttcactgagctgtgaatattgagttatagaaagctacaggagaaacagttttgcagaggaaaggagagcatgaattctgtttgggcacaataggtttaaggtgcctgtgagatatccaagttaaaaggtgaaggaggcagctgaaagttcaataatacatatgtctggaccaaatatatagtatttcccacgtatggacagtaactaagaccatggggtccggtgagatcactctaatcattttttcatacagagctcactgcgtcttcatgtcaacttacctaaataagttacgtctttaaaattttatctagaacatgaaaatttagacaggttaaataacttccccaggtcatgcagctagtaagaggcagggttgagatcccatttcataggagatgcatcagtacctagtcatactgcatttccttaatcagaatgactgattctcagatacaatggagagttaaccatgtttgctaaggaacgaccaatgaccagctgagtgtatattttcttccattataaacatggcatttgagtctactattcttggaaagtcagtgaaaaaatatcccatggagtttatgattaagctctgagatccagattttgggtttactgcccaaacatctgtccccttgcttcctagaaaacatggaaactgaagttgaggttgcctggaagcttactaaaaatagtgagaaccatggaattgagaagttaaaacatgtttgaagtagtcaaatatatacctccacttttttgatggaaaacgttgtgtactaaaagtctaaatccatttcactcattcaactgacatatgtaacactgctataggccaaaccctttgctgggctctggagaggcactccttgttcttaaggtgctctgtctcataggggagactgacacaagttaaaggctattatagcattgtgagaagggtgctatgagaggattgcaaaggagggtatttcgtccatcattagagaaggggaaagcctttctcagaaagacttcctggaagtgataacacataaactaacaatttgagcctcaatttcttcataaggtagagttagttagataaataagagaggaaagaatactgtttcaggtacaagaaagaaacaggaacattttactataaggcaggaggataggaaaaaaagaccccatttagagaccaacaccttaatacacatgggttgtgtggttagatggttagcatggccttaaaattgttgctggagtttggcttttgagggacataaaggcataactgaagaacttcatactagttagggccacatactgaggtttgcatttttaggatgactatgttagcttttaagtagatgatgtgttggaaggggaagtacctagaggtggggaggactctacagaagttattgtaggagtccagggaagaaatacagagagaaatggcctgggcatggtggctcatactggtaatcccaattatttgggaggctatggaaggagggtcacttgaggccaggagtttgagaccagcctgggcaacatattgagaccctgtctctacaaaaaaattagccaggtgcggtggtgcacgcccgtagtccctagctactcaggaggctgagacaggagaatcacttgagtccaggagttcaaggctgtagtgagctataattatgccactgcactccagcctgggttacagagcaagactctatctgaaaaaaacacaaaaacaaaataaggagataaacaaatagatttgagaggtatttagtgggtggaatcaacaaaacttggagattagagggagaagtgggaatatagggggacttagagggaaagtggtgatctttacttagccaattatgcgaaaagattaatttagagtgggtaaaaagttaaattttagacatggtgagtttggccatagaacatccaagcagatatgtccagtaggtgactagcattataaattttgagctcaagagaaaggcctgggctggaaatacagatcagggaatcacggccataaagactggggacttgtcatcatagagattaggaagttatcctcatagagactagggcattgtgttagtctgtttgcattctttaaaggaatgcctgagactgggtaatttataaagaaaagaggtttatttgtcttatggtcctgcaggttcagcctgtaacatggtgcttgtacacaagcagtatagtgccaacatctgcttctggtgagggcctcaggaagcttacaattgtggcagaaggcaatgggcatatcacatggtgatggagcaagagagaaaggaggaggtgccaggctcttttaaacaaccagctcttgtgtgaactaacagaacgagaactcgctcattactatggagaggacaccatgccattcatgagggatccacccctgtgacgcaaaaacttgccactaggcccaccttcaacattgaaggtcacattttaacatgagatttggaggaggaaaacatccagactgtgcatcatcgccatagagagtaggatgtcattcctatagaggttggggagttatcctcatagagattaaggacttgccatcctcatagtgagtagggagttatcaccattcagttggcatatgtagataaaatgagatgaaccaacatcccaagatggaacgctgtggatcattcatatttaaagggtatggtgtaaaagagaagctggcaaagtaggggaagtaggatggttattggaaaaacctggtgtcatgggagccaggaaaggagagtgcttatgtactaagatgtcaaatgtcagattgcacaagaaatgtagatactgagatgtgtccactggatttggcactatgaggttgttggtgatatttgtgtgaacagctttagtggaatgggatcaggagccagatacagtgggttcagcaagtagggaggtggagtttagaaaggcacttattgccaggagaattttaaaaaaaagcaagttagagaaagtcaagtaataagaactagtgtggcatggatcagctctctgggaatgctggagggagagaactgaaggggagagaagtggaataaacactataaaaagctctgagaagagaggatgtggcttcaccccacccaatcctgagagaatgggtggagggtaggcctaatattgtcttgttatccaaatattgtctttaccagctatcctttccctaaagatgggacaagccattcccagaggtcagttccaggcaacatgaccttcccagaaggtggggtaaaattttcctcattaactcatgtgttccccagagtctttgggtttttaggaatttctacaaagaatttcaaatattttacaagtcatttccaagtaccataatatattcttccttcagtttggtatctcaagcttttgttaaggtagagacacattttccttcactcagaacattgttgtaactctgaaggagaaaaggcatgtggaattactattgtctgcattggccttccttctgtggctgcaccactcctacttctgtgaatctgagcaaataagaaaacagaccacctgcatgtgagcaagaagcacacagattttgctgaatatgtggcttcagtggtcttcacgttgcttctgtgttctataggtagcccggttttatacagacagacaatctatttcacctgatggaatgaaaaggataagaatcatgtgaaaccaaacacataagagatggatgtgtaaggcataatacccatttagggattaacaatatcagctcattttttaaacttttaagctcaggggtacatgtgcaggtctgttatataggcaaacttgtgtcatgggagtttattgtacagattatttcatcacccaggtattaagcctagctcccattggttatttttccttatcctctctctcctcccaccttccaccctccaataggccctagtgtgtgttatgccactttatatatccatgtattctcatcatttggctctcacttataagtgagaatatgtggcatttggttttttgttcctgcattaatttactaaggataatggcctccagctccatgcctgttcctgcaaaggacatgatctcattcttttttatggctgtatagtattctgtggtgtatatgtaccacattttctttatctggtctatgattgatgggcatttaagttgattccgtgtctctgctattgtgaatagtgctgcagtgaacatatgtgtctttatgatagaatgatttatattcctttgggtatatatccagtaatgggatttctgggtcaaatgttatttctgtttttaggtctttgaggaatcactgcactgtcttccaaaatggttaaactaatttacactaccaccaattgtgtataagcgttcttttttctccacaaccttgccagcatccgttatttttttactttttaatgatagccattctgactggtgtgagatggtatcttattgtggttttgcattcctctaatgatcagtgatgttgagctttttttatatgattgttggccacatgtatgctttattctgaagagtgtctgttcatgtcctttgcccactttttaatggggttgttttttcttgtacatttgtttaaatttcttatggatgtcagatattagatctttgttggatgcataagttgcaaaaattttctcccattctgtaggttgtctgcttactctgttgatagtttattttgctgtgtatcgggggaaccagcccccaatatttcaacatacgttctttctattttccctaagtgttggccggtctgagaaataaagagaaagagtacaaagagagaaattttacagctggtcttccggggatgtcatcacgtattggtaggactgtgatgacgaccctgagccgcaaaaccagcaagtttttattagggattttgaaaggggagggggtgtatgaacagggagtaagtcacaaagatcacatgcttcaaagagcaataaaggtcacaaggcaaggcaaaattagaattactgatgagggcctatgtcccactgtgcatgcattgtcttgataaacatcttaacaggaaacagggtttgagagcagacaaccagtatgactagaatttaccaggctggaatttcccaatcctagtaagcctgagggtactgcaggagaccagggcgtatttcagtccttatctcaactgcataagacagacattcccagagtggctgtctatagacctatccccaggaatgcattccttccccagggttactccttgctgggaaaagaattcagcgatatttctcctactcacacatctatctataggctttctgcaagaagaaaaatatggctgtattctgcccgaccccacaggcagtcagaccttatggttatctttcctcgttccctgaaaatagctgttattctgttatttttcagggtgcactgattttatattgtttaaacacacatgttttacaaacaatttgtacagttaacacaatcatcacagggtcctgaggtgacatacatcctcagcttaagaagatgacaggattaagagattaaagacaggcataagaaattataagagtattgattggggaagtggtaaatgtccatgaaatcttcacaatttatgttcagagattgcagtaaagacaggcataagaaattataaaagtattaattttgggaactgataaatgtccatgaaatcttcacaatttattttcttctgccttggctccagctggtccctctgtttggggtccctgacttcctgcaacagctgtgccgaagctttttagttccattagataccatttgtcaatttttgcttttgttgctattgcttttggtgtcttcctcatgaaatctttgcccattcctatgtctggaatggtattgtctaggttgtcttccaggatttttatggttttgggttttacatttaggtctttaatccatcctgagttaacttttgtatatggtataaggaaggagtccagcttcagtcttatgcatatgtctagccagttatcccagcaccatttattgaatagggaatcctttccccattgtttgtttttgtcaggtttatccaagatcaggtggttgtagatgtgtggccttatttctgggtcctctattctttttatttttatttattttttatttttatttatttatttttgaggcagagatttgcttttgttgcccaggctggagtgcaatggcgtgatctctgcttattgtaacctctgcctctgggttctctattctgttccattggtctatgtgtctgattttgtaccagaaccaagctgttttggttactgtaaccctgtagtatagtttgaggtcagatagcgtgatgcctccagctttgttctttttgcttaggattgccttggttatttgggctctttcttggttccatatgaattttaaaatagtttgttctagttctgtgaagaatctcaatggtagtttaataggaatagcattgaatctataaattgctttgggcggtatggccattttaatgatatggattcttcctatccatgagcatagaatgtttttccatttgtttgtgtcatctctgactttttagatttattctgatccaaatgtgagtgaccatggcctgtcagccctcgggaggtcctgagaacatgtgcccaaggtgatcggggtacagcttggttttatatattttagagaggcatgagacattaatcaaatacatttaagaaatacattggtttgtttcagaaaggtaggagaactccaagtgagggctaccaggctataggtaaatttaaatgttttctgtttgacaattgcttgagtttgtcaaaagacctgagatctataaaaaggaatgttcaggttaaagataaatgattgtggagaccaagttttattttgcagaggaagctctcagatagcacacctcagagagagagagcaggttgtaaaatgtttcttttcttttcttttttcagggtaattagcatatccatgaattttttttttctgttttgaatgatttatttcccaccttctttttttaaaattatgcgttaagttctagggtacatgtgcagaacatgcaggtttgatacataggtatacatgtgccatgttggtttgctgcacccatcaactcatcattcacattaggtatttctcctaatgctatccctctccaaaccccccacaccatgacaggccccggtgtgtgatgttccccgccctgtgtccaagtgatctcattgttcaattcccacctatgagtgagaacatgtggtgtttggttttttgtccttgtgatagtttgctgaggatgatggtttccatcttcatccatgtctccgcaaaggacatgaactcatccttttttatggctgcatagtattccatggtgtatatgtgccacatttttttaatccatcactgatggacatttgggttggttccaagtctttgctattgtgaatagtgccgcaataaacatacgtatgcatacgtctttatagtagcatgctttataatcctttgggtattgctggtatagtttgaggtcagatagcatgatgcctccagctttgttctttttgcttaggattgccttggttatctgggctctttcttggttccatatgaattttaaaatagtttgttctagttctgtgaagaatctcaatggtagcttaataggaatagcattgaatctataaattgctttgggcggtatggccattttaacgatatggaatcttcctgtccatgagcatggaatgtttttccatttgtttgtgtcatctttggctttttagattgctgggtcaaatggtatttctagttctagatccttggatcaccacactgtcttccacaatggttgagctagtttacactcccaccaacagtgtaaaagcattcctgtttctccacagcctcgtcagcatctgtcgtttcctgactttttaataattgccattctaactgatgtgaggtgatatctcattgtggttttgatttgcatttctctgatgaccagtgatgatgagcattttttaatgtgtctgttggctgcatagatgtcctcttttgagaagtgtctgttcatatcctttgcccactttttgatggggttgtttttttcttgtaaatttgtttaagttctttgtagattctgaatattagctctttgtcagatgggtagatcgcaaaaatttcctcccattctgtaggttgcctgttcactctgatggtagtttcttttgctgtgcaaactttttagtttaattagatcccatttgtccattttggcttttgttgccattgcttttggtgttttagtcatgaagtccttgcccatacctatgtcctgaatggcattgcctaggttttcttctagggtttttaaggttttaggtctaacatttaagtctttaatccttcttgaattaatttttgtataaggtgtaaggaagggatccagtttcagctttctacatatggctagccagttttcccaggaccattcattaaatagggaatcctttcctcatttcttgtttttgtcaggtttgtcaaagatcaggtgattgtagatgtgtggtgttatttctgaggccactgttctgttccattggtctgtctctctgttttggtaccagtaccatgctgttttggttactgtagccttgtagtatagtttgaagtcaggtagcgtgatgcctccagctttgttcttcttgcttaggattgtcttggcaatgtgggctctcttttggttccataggagctttaaagtagttttcttccaattctgtgaagaaagtcattggtagcttggtggggatggctttgaatctacaaattaccttgggcagcattgattcttcctatccatgagcatggaatgctcttccatttgtttgtgtcctcttttatttcattgagcagtggattgtagttctcttgaagaggtccttcacatcccttgtaagttggattcctaggtattttattctctttgaagcaattgtgaataggagttcactcatgatttggctctctgtttgtctgttactggtgtataagaatgcttatgatttttgcacattaaatttgtttcctgtgactttgctgaagttgcttatcagcttaaggagattttgggctgagacaatggggttttctaaatatacaatcatgtcatctgcaaacagggacaatttgactttgtcttttcctaattgatacttctttctctggcctgattgccctgtccagaacttccaacactatgttgaataggagtggtgagagagggcatccctgtcttgtgccagttttcaaagggaatgcttccagtttttgcacattcagtatgatattggctgtgggtttgtcataaatagctcttattattttgagatatgttccatcaatacctagtttattgagagttttcagcatgaaggtctgttgaattttgtcaaaggctttttctgcatctattgagataatcgtgtggtttttgtctttggtatagtctgttgatttgggatggagagttctgtagatgtctattaggtctgcttggtgcagagctgagttcaagtcctggatatccttgttaaccttctgtctcgttgatctgtctaatattgacagtggggtgtaaaagtctcccattatcattgtgtgggagtctaagtctctttgtaggtctctaaggacttgctttatgaatctgggtgctcctgtattgggtgcatatatacttaggatagttagctcttcttgttgaattgatccctttatcattatgtaatggccttctttgtctcttttgatctttgttggtttaaagtctgttttacaagagactaggattgcaacccctccttttttttgctttccatttgcttgttagatcttcctccatccatttattttgagcctatgtgcattcgtttcacatgagatgggtctcctgaatatagcacactgatgggtcttgactctttatccaatttgccagtctatgtcttttaattgggacatttagcccatttatttttaaggttaatattgttatgtgtgaatttgatcctgtcattatgatgttagctggttattttgcccgctagctgatgcagtttctttctcgtatcgatggtctttacaatttggcatgtttttgcagtggctggtactggttgttcctttccatgtttagtgcttccttcaggagctcttgtaaggcaagccttgtggtgacaaaatctctcagtgtttgcttgtctgtaaaggattttatttctccttcacttatgaagcttagtttggctggataggaaattctaggtcgaaaattcttttctttaagaatgttgaatattggcccccattctcttctggcttgtagagtttctgcccagagatccgctgtaagactgatgggcttccctttgtgggtaacccgaactttctctctggctgcccttaacattttttccttcatttcaaccttggtgaatctgacaattatgtatcttggggttgctcttctcgaggaatatctttgtggtgttctctgtatttcctgaatttgaatgttggcctgccttgctaggttggggaagttctcctggataatatcctgaagagtgttttccaacttggttccattctccctgtcactttcaggtacaccaatcagacatagatttggtcttttcacatagtcccacatttcttggaggctttgttcatttctttttactcttttttctttaaacttctcttctcactttatttcattaatttgatcttcaatcattgataccctttcttccacttgatcgaatcggctaatgaaggttgtgcatgtgtcacatagttcttgtgccatggttttcagctccatcaggtcatttaaggtcttttctacactgtttattctagttagccatttatctaacctaaggtttttagctttcttgtgatgggtttgaacatgctcctttagttcagagaagtttgttattactaaccttctgaagcctacttctgtcaactcgtcaaagtcattctccatccagctttgttccattgctggcaaggagctgcaatcctttggaggagaagaggtgctctggtttttagaattttcagctttcctgctctggtttcaccccatctttgtggttttatctacttttggtctttgatattggtgacctacagatggggttctggtgtaggtgtcctttttgttgatgttgatgctatttccttctgtttgttagttttccttctaacagtcaggcccctctgctgcaggtctgttggagtttgctggaggtccactccagaccctgtttgtctgggtatcaccagcggaggctgcagaacagcaaatattgcacaacagcaaatattgctgcctgatccttcctctggaagcttcgtcccaaaaggggacccgcctatatgaggtgtctgctggcccctactgggaggtgtctcccagttaggctacatgggggtcagggacccacttgagggggcaatctgtccgttttcagagctcaaacaccatgctgggagaaccactgctctcttcagagctgtcagacagggatgtttaagtctgccgaagttgtctgctgccttttgttcagctaagtcctgcccacagagatggagtgtagaggtagtagggcttgctgagctgcggtgggctctgcccagttcgcacttccaggccactttgtttacctactcaagcctcagcaatagtggatgcccctcccccagccaggcttccaccttgcggttcaatctcagactgctgcactttcagtgaacaaggctccgtgggtgtgtgacccgccaagccaggcacgggagagaatctccttgtctgccagttgccaagaccttgagaaaagcacagtatttgggtgggagtgtcccgttttccaggtgtaatatgtcacagcttcccttggctaggaaagggaaatcccccaaccccttgtgcttcccaggtgaggcgatgccccgccctgcttcagctcaccctctgtgggctgcacccgttgtccaaccagttccaatgagttgaaccaggtacctcaattggaaatgcagaaatcacccatcttctgggtcaatcacactgggagctgcagactggagctgttcctattcagccatcttggaatggatccttctctgacttttttgagcagtgttttgtagttctccttggagagctcttcctgctttggctctcagcttgactgatgttggtgtatggagtgttagggagctttgcacattgattttgtattctgagactttgttgaagttgttaatcagcttaaggagctttggggctgagaccatggggttttctaggtataggatcatgttgtctgcaaacagggatagtttgacttcttctcttcctatttggatgccctttatttccttctcttgcctgattgccctaaccaggacatccaatactatgttaaataggagtggtgacagaggacatccttgccttgtgccagttttcaaggggaatgcttccaggtcttgccatttagtatgatgttggctgtgggtttgtcatagatggctcttattattttgagggatgttccctcaatacctaatttacagggagtttttaacatgaagaggcgttgaattttatagaaatccttttctgtgtctattgagataaccatgtggtttttgtctttaattctgtttgcaggatgaatcacatttattgatttgcttatgttgaaccaaccttacatcgcagggataaaggctacttgattgtggtggataagctttttgatgtgctcctggatttggtttgccagtattttgttgaggatatttgcatccatgtttatcaaggatattggcctgaagttttcattttttgttgcatctctgccaggttttggtatcaggatgatgctcatatgcctcgtagaatgagttagggtgaagtccctcttccctattctgggaatagtttcagcaggaatgataccaggtcttcattttttaccttgtagaaaaattgacatggcaagacagcttggtagacatgaaatcagaagtgggggagttagtttgattatcttagaggaggcattcttcatcactgtaggggaaaaaactttcaaggaaatggtgtacttgagtccacatgccaaggcaccttctttccccagaccatgctagagatactttgacagattattttagttgctttttttttttttaataattttgttgatcattcttgggtgtttctcggagagggggatgtggcagggtaataggacaatagtggagagaaggtcagcagataaacacgtgaacaaaggtctctggttttcctaggcagaggaccctgcagccttccgcagtgtttgtgtccttgggtacttgagattagggagtggtgatgactcttaactagcatgctgccttcaagcatctgtttaacaaagcacatcttgcaccacccttaatccatttaaccctgagttgacacagcacatgtttcagagagcacggggttgggggtaaggttatagattaacagcatcccaaggcagaagaatttttcttagtacagaacaaaatggagtctcctatgcctacttctttctacacagacacagtaacaatctgatctctctttcttttccccacatttcccccttttcttttcgacaaaaccaccatcgtcatcatggcccgttctcaatgagttattgggtacacctcccagacagggtggcagccgggcagaggcaccccccacatcccagacagggtggccaggcagaggcgccccccacatcccagatggggtggccgggcagaggcgccccccacccccaagacggggcggccgggcagaggcgccccccaccccccagacggggaggccgggcagaggcgtcccccacctcccagacggggcggccgggcagaggcgccccccacctcccagacggggcggccgggcagaggcaccccccacctcccagacggggcagatgctgggcagaggcgccccccacctcccagatggggcggatgctgggcagaggcgcccccccacctcccagacggggcggatgccaggcagaggcgctccccacctcccagacggggcggatgccgggcagaggtgctccccacctcccagacggggtggccgccgggcagaggcgctccccaccccccagacggggtggccgccgggcagaggcgctccccacctcccagatggggcggctgggcagaggcactccccacctcccagacggggcggcggggcagaagtgctccccacttcccagacggggcagcggccgggctgagatgctcctcacttcccagatggggcagtggccaggcagaggtgctcctcacttcccagacggggcagctgccgggcagaggtgctcctcacttctcagacggggcggccgggcagaggcgctcctcacctcccagaaagggcggccgggcagaggcgcttctcacttcccagacagggtcgcagtcgggcagaggcactcctcacttcccagacagggtcgcggtcgggcagaggcactcctcacctcccggacagggcggccgggcagaggcgctcctcacctcccggacggggcggccgggcagaggcgctcctcacctcccggacgggttggccgggcagaggcgctcctcacatcccagacggggtggtggccaggcagaggcactcctcacctcccagacggggtggcggccaggcagagacgctcctcacctcccagatggggcggtggctgggcagaggtgctcctcagttcccagatggggcggctgggcagaggcactcctcacctcccagacagggcggccgggcagaggtgctcctcacttcctggacagggcggctgggcagaggcgctcctcacttcccggatagggcagccgggcagaggcgctcctcacttcccggacagggcggccaggcagagacgctcctcacatcccagatggggtggtggccgggcagaggcgctcctcacttcccagacagggtttagttgccttttttattctatgtagatgaccccatccccaccatattcacatattccttcttcactcaggtacaaaattcagtaggacacgactttctgagtcatatgctggatttgaggagatactgaagccacaagactgaaataacttttaaactgtgggtgatttggctaaaagctactctcatctattatatattcatcttactagttttgctctcagaggaagttcctgtttccaaggtaaaggaacctttctctaactccacctaccttcctcctcactaaatgggtacagaaaatatgcttagaaaaaaacgcagaggaccctgatattgtcattctgaaatatcagtagtatctgtcacattttgacaggaactagatactaatcaatttataagattgagttttcatgtttctaaagtgcagatactctgtgttgatggttaaagagaaagccagctggttaggtgtcagatgatctctgacagtgttaccatagacatttaattgcatgaccatatcttatccagatggcatttctcgcttacacagatacataaccccagaggggcagagggagagatgtcaaatttccctcaaaatagaactttgagtccacccaaagtctaccaagtgagactttacaattctgcccaaagagtacagaaattacattgatctggcaagaaagaatgaatgggaacccaaaggtagctgcttgagttaatcaggttggtgagtggctgacagggtgctagagtgggcaaagtcaacattaaaccaccagcgcacaacttcctatgtacccaatgttcaccttcccagctcctatcatctttgccactttactctgaactggaaaccctctgtacattttttcctctttaactcaaagcctttagaactctcgagctcaagcagtcccctcctgcctcagcctcctgagtagctgggaccacaagcacacgccaccatacctggataatttttaaattttttgtagagatagggtctctccctatgttgcccagattagtctcgaactcctgggctcaagtgattattctgcctcggcctcccaaagcactggggttatgacccaccacgcctggccccacatcttgtttttcacataatgaaatgttttgaagacagtttgtgtcaacattcatagatctagctcagtctttttcatgtctgcatagaattatgtattatgaatgtggtagaatttatatatccagacatcagttgatggacttttagtcatttttagtcttttgccattacaaacaatgctgcactgaatgtcgctgtctatgcaccattttttcacatattcataagtatatcagcaggttaaatttctagaattagaattcttcagtcaaaggatatatgtgctttaccctttgatagatgttactcaattgcctccccatcaaagaggttctacaaatttttactcctacaaacatacaagaagtatctgttttcccacatctttgtcaacatatataatttctttactgaatttacagtaaaattcactttttaaggtgtaaagttctatgaattttgacaaacatataaagtcatttaaccaccatcacaatcaaaatctagaatatttctattatttccaaaagctcctttgtggccctttgtagtcaatcctctgtgcccatcctgagcctttgcctactgatctaatttctgttcttagttttgccttttccaaaatatcatatcaatgaaagcacaaagtaaatagcctgtttgagtctggtttcttttacttagcataatgcttttgagattcatacatattgttacatttatcagtagtttattccttttccttattgctgagtagaatttcattgtatgattgttcccaatttgtatacatttgccagttgctagcatttggattgttttgaggttttggcaattatgaataaagcagttggaaatatctaggtacatgtctttgtgtggacataggtctttgcttttctcaggtaaatacctcagtgtgggattgctcaattttatggtgagtttttatttaactttataagaaactgccaaacactttctcaaagtggctttgttatttcccatccctagcagcaaggcacaagtgtttcagttgctctgcattcttaccaacatttcatattgtcaatatttaaaaaattttggccattctaataagtgtatagtgaatattatgtatttatcaaactttaaaaatgttgctattctgaaaattatttttttcatttacatttctttaattaagggtagttagaatacatttaatatgttgataacacatatttctttttctttgaattgcctattcatcttctttgccatttttctattaggtgagctgatcattttcttaatgattttaaaatgacgcttatatattagtgaatccaactatttcataattgttgcaaacttttgtcattttttactttgatttgttaacttacagaaatacaatttacaaattttgaagagaagaggagactttatttcttataaaaggttacagcctgcaggatggccattttgacaggttgggaagtatagcctccagtcagaagccagaaacatatctggagggaggggcaaagggaacaggaatttacacagagctggtggccaaatatacatattcaataagctatagaaggagtcatgaatatttatgaagggagaaccatctgcatgtgtaattgagccttctgcttctccatgttcaaaaaatggtggtgaccttaggtggagtttttggccctctgacatcaaaacatgaagcagaggatgtgaaaacactagctgcctattcttcatagactggccagaaccaccccatagttagtggtctcttatcaggcagaaaagatggggcagcatcagggagtcggttgatatcagtggtggagccttttgaaagggctggtttctgttaggcccttgagaaggaaagcctactcctggttagcaagggagagggtctgagcccctcccaccctccattccatcttggccgagaacgcagttttcaaggtttctctggggtccccttggccaaaagatggtctggtcagttggggggcttagaattttattttgtatagcttatagcacatttttctatagtaatatttgtatgtaacctctaaattttgtacctcattggtgcaaaaataaggcggtataaatgagagagtttataaaggcaaggtatacaagacaagactataaggctaggcaccctggttgagtcagttcaccctgcttccactattatccagcactagagatgcatggccaatacagattttcttgcttattctcaccatctgcaaataaccaaggcttgttgacaaatgcagctgctttgagaaagggtagagtccccagggcacaatttttcaatttcagatgtggaagaagactcgtttagtggaagcaatgcgcttattgctgaggccatcaatataccagattgttacgccttttggctgggacacagggaattcctgtctgcagagtcagtgacatcactttgccggaaacagccttcctccctgccaaccctacacttaaacatgggattccacactgaccacaaaggcctattattctcaatgcaatctatgggcaaaagaatttgagggaggctagaaggggtgggggcaagagagaatggatggtttggttggaggaagtgagaagaatcagggaagaggactcttttgcttcctcatttcccatacatagagcctctgtcaccatttgatttttgcgatcattaacatttttagagtcaggtataaccaagtgcaaaccagttatgttagttacatgctgctaatctgagaagagtgtgttgcccaagaactgtgggtggggagcctcaggttggctgaatctgatttgcaggaagagcttgttctgcacccccacccacatctacactatctggatgtcaccaaataggctctccccacccaaagctgagtctcaaggggtccactcagtatcagccaggctacgttgttaagataaatgcaattgttttctaactaagaagctgtgaaccgagaataattggctaattaaaagttcaaagagtggaaataaaatagcattaaaaagagccagtaacttcctctgacgtctgtggttcaagagatcagtggaacaggacatgggttatttactcaattaccttgtctttctacctttcttttcattctcacccccaccccttcccttccttcttatttcctggctctattttcttacctgtgtctcccaacccaatgtccatctcatttttcctccttcttttttgccttttgccctttaactaactggttatcattgagatctttaggatcaaagtttgtctttagcagttgtgtttctattgatgtttgtgctgacttctttaagtaaaatataggcaggaaaaaacccgctaaattaaactgctttatccttgaatgtgactctggattggttaattggagaaatatggggttggggtagaataagacctttccatttagatagaattttggactagtgcttttgcattgggtcagctgagaaagaataaaactgaaaaatttctacgcatctctaatgcaggacaatgatttaaggcattgaagtggaactgagacacttggatcaaatccctgttctgccacgtgcaaggtgcatgacttgggcaagtcccttaagcttcctgagaaacacagtctcagccttttgtcacttaactgtaagcttctgactgtcagggatgagattcatgatttcaaaaggtaggacattggtatcctcagtgagaacagtccagacaacccttccagccaaatcctcaatgttggtcactttttatttctggataatgagattggctaccacataacagtactggtagcacagcccagacactgtatgagcctcagtcatgtattgtagggtagggtgctggttaaaagcctggaccttgaagccagaatgcccgtgtttaattcctggccctgttaccggtggcagctatctgagttactggcagtgtatccatacgggtctgcagtaacctcaattcttgcctcatcagaagaaagaatgtgagggatataaagtagaaaaagagactgagtcaagtttcagagcaggactggaagtttattgaaaaggctttagaacaggaaagaaaggagagaacccttggaagagatccaagtgggcaacttggagaacaaacaacgtgtttagctgtgatcctaggactttataggcggccatcttgagcccttttcccgtgattcttcccttagggtgggctgcctgcacgcacagtgccctccttacctccttgagcacacagtgtgtttaggaagttgtgtgcatgctcatctgaggctttctttccttttccggtggagtgctcccggcaagtcatcttccaccttttgtctcttaatgtgcatgcccaggaagttgcttctccctggtgcttgaattcaattaacactttaatgttacagctgtggatcagcagattttctctccctggctccagctgccaaattatcatttttagagaggcaatgtgataactgtcaaaccatcacctgatatttctagttggtgggggagaagagccctttcctgccatgtctgtctaactacatgtaacagcgcaacatttacatcagtgtaactttgggaagttacttaatctctctgtgactcagtttcctcatctgtaaactaacaataatgataattataatagtgactgtgagtgtgactttatttggaaatatagtagggtgttcagagatgtaattaagctaaggatcttgagatgaaatcatcttgaatttagggtgggccctaaatctgatgactggtgtccttatgagagaaaggagaaggaaacgtgacacaaagagcaacagggggaaaggccatgtgaagacagaggtggagattggagtgatgcagccacaagccaaggaatgctaagaagctgaaaaagacaagaaagacatctcctccagaaccttcaaagggagcatgcccctgctgataccttaacttttggacttctggcctccagatttatgaaagaatacatttctgtttgaagccagcaagttcatggtaacttgttgtggcagccctaaaaaactaatacagattttatagagaagatgatagtattacgtgcaccttataggattgtagtgaaggctaaattgatggctgcatttaaagtgctaagagtagaatctggaatatagtaagaactctttagtataggctattacgtgttgttagctcattgaaccttacatagcaaccctatgaagcagatactattgtgactcccattctgcccatgaggaaatggaggcttacagagactaagcaaaggtaagcttatctgaactctgctctagcttgaaccatcccccagaagtctgtggagtttgactaactgctgatggatcctgatgattgttggctcggtgacccttcctgatgatggtctctcagaaaagactctccagtgctgagccatcaagaagtctagaaggcattgagaaggctgtcacatgtgattatgtttactcctcctggatgcgtctgcccagacctggttttggcacaagctctgctctgatggagccaggctctgtccacacttggctgtgtggcctgacctcatttgagtagcctcagcacatcattaccacaagaggcagggatgtgccaccctaaaaggccacaccctctctctccagtgacttcaacagcccccaatggttccttgttcacccctaagttgctaagcatagattatatgaatgactttagaagtaagtcacatcactcagaataaggcaaagccctcactagtgccctcaaggccttatgagcaggggaccccattgatcctctgaccagttcctactactctcccctcagggcctttctgtgtacagttccagatgctgtaaagctcttgcctcagaggtatgcaggctttctccctgtgatagaaatcaccttctcaggccagtcctaatcactgcatccttcctttttaccttccttgctttttcttcctcctcagcacttaaaattatgtaatacactgtaaattttgtttatcttgcttattgtatttttctcccaactagaatataagcaccatgaggatagggacatttctcactttgggttattgctgtagctcagagcctagggcaggtctagttcatagtaataatgtgttcaataagtaattattgagtgaccaactgaaaaaatgaatgaggcatagtcccctctccaacaactatagaactcccaaactgaaatggttcaagctatatctagaggtagcacatgaagagaggactactgacataactgagctttgtagagtatagggggagcatagcttccaactgagcttgattttgaaggagacaaaaagacttggagaatgaggggaatggaattacaaatgaaggcgtcccacactgagaaaagttcagagaatccaaaattcattcattcattcattcattcatacaacatgggatataccaatgaacaagccagaaaaaagtccctgccctaaggagcttacattctagtagtcataatgtcaggaattctcatcttggacccaaacagatctgttggttggaatggtaaaatgggaagggctgaaatttctgaagggcttggaggtctaggtagaccagtgtagctttcatctggcacacagcaggacataggttcttgataaggtagagtcttaggaacgtcaattgtggaagatttctatagccacatgaaggagggattctgatagagaagataattaggaagtgtgggagtcaccagaaagggccattgtagaagatcagatatgaggtaagggtgactggaatcaggggatgtggatatcactatagaagaaggtgggtctaaggggcttgggatgaaataactgagagaggatcttcaagcccctgagtgtgagaacaacctacatatgtgtcctcaagaagagttccctgatggagaagaaggaaggtagcaggggtggtgtggagactttgactctgtgagttggaggaacgacaacgccagattaggaccagtcttctgagcttcagtgattgttccatcattaggctatgtaaacacaggaaggaccacaacattccttgaatgtttgctcaccaatgcttgtccacatttgctgttttgttctctatatgacaagaaaagtttagtccagatgtgactcataacaaattggaaacaatttgaatctagtcagtcacattggatctgcaaagcaaaacttttttttgcctgaaatccaccacatctgtcaacaccccaaatctgtttattaatggagtaaaattttaagctgttatatttttgttatcacagagtagcaatgctgggatttctctatacaacagaattttgactatggacaaaattaaataatttgtttgtttgttttggagacagggtctcactctgttgcccaggctagagtgcagtggtgtgatcttggctcactacaacctcggtgtcctgggctcaagcgatcctctcacctcagcctcccaaatagctgggactacaggcatatgccaccacgcctggctaatttttgtattttttttgtagagacagattttcaccatgttaccccccagtctcaaactcctggactcaagtgatccgcccacctttgcctcccaaagtgctgagattacaggtgtgagccactgcaccctgccgagattaaataattttgattttcaccttagtatgattataactggacatcatgatggctgtttctataagaatcaaaagaacctttgcttcctttgattcttataaaagtcttgaaggtatttttcctctgacacagctaattggcttgaaatcagcctgtgttttttcaaagcttgggtttccttcagttttatctctctgtcaggtgaagagttgaagttaatattaccttgctctctcactttaagctgaaaattcccctcccttgtcacatcacatgaaaagaaaaaaatgcaaaggaagtggccgtcttaaattctccagtacagtaagccaattcaaagggaaaacaatgacaacactttgccattggatattttggtaaaatcatttgttgaaattctgtttcgaaataccatttcacattgtatgacagaaaccacatttctgttatccacaaggcaaattaagggcttttcagggggaagacaatcaatgtgaattttccataatagagcttgactgtggcagtcatgggatctgaaagcactctgggggtctaagaagaaggggcagttacctaagtaattctctttttatgaacacatccaagatatgtcaacctgcaccccacctctagcacctcttctttggcaccacttctgagatgactctcctgcttcctggatgtgatcagggcttttgaaaactggctgacatatagtccatggaagatagcattttaattactgctctctgggtaatgtagtcagttacatgaaaaacaaacttaaccattgtgggttcttttggtaataaaaacatttgaaaaatcatgtatgaaaaattcctaaattttctctctgacctaaaaatctttttcttattatatctttaataagaaataagagtaggatgaaaggcttgcatatattctggtaacctggatatcattgcaaaagctgggaaaatgtggaaaagtgtacatctaactcctcaatgacaagaagaagttagtaaattttctcgttaggaaaaggaagaaataattatagtcacatcaagttggttcccacctctgggttcttgcagtttctgttccttcttcctcttatgttcttactccctctccaggctggtgttttctcctcaaatgtcaccttcaaggtctcggctcaaatgtcatcttctgagagaggctttcttgaccctcaatctgatacctttcccttcattcccaattctaccgcaagtcactctatcaagttccttggtttgaatttcttcttagcacatattgtgacctgaaatcacctatttatgtgcttcttttctggtttatctgtcttgctaactagattgtaaattccaaagagcaggggccttatcagtttttctttttttattgtagtaacttggatgctaagaatagtgcctgaaatggccatggaaggaaaatgagattgcaagattgtcatatttacaaaaacaaaagaagttaacaagtagaccttgttgaatagcttgagggagtaaaacattcaaaattttattatggtagaaacattgctacagtttgtttgttgttatatttataattggttgttttatttataattgcttatctaaaggacatgctgcttagggctgtgtttgtcaacatcacaacgttgggaaccaaagtggggtgcccttagagggttcttttccagattccagaacactggcatcaaagaggacatctctcccataccagttttatccagatgttttagcttcaagtagttaaaatcctgactctaattgggtcaaagcataagttttatggaaggatgggctcagcatttgttgatttagcagcttaaaatgccatcaaggactcacgttctctacatctctctgctctgccatcattgaatgccatcccttccaggcaggacaatgtttgaggatgaagagagaatgttttcttttttccctagacttgccccagaagacttcctccacggtcacatgggccataattaggtggcatacccattattaaaccagtcactggtgagggaatgaaattacacagacaagtccatccctgagcttgggggaaaggcaagcatctgaacaaaatggagtttcttttgggaagggagaagcagggaagtgctgtgtatttcacctgctcttccttgtttggaagcaatagataatgatgttgctaaaactttttctcctaaattttgtattgtttggtctgatgggtaaagactgcctcaagattctggggattgaggtggattggagacccataccttaatccaagcttagacttggattaagttcaagcttctgctcaagagcttcagagagagctcccatttcagtgcccagccagcttctacgtttgggaatagtttggggagttgagagaggaggaggttgagttgtcaaaatggagggaatggtgcaaccatttcatttcctgttcacttcctctatgcaatctgtttacatctgaccaaagtagcttttgccttttttttttttttttttttttgagagggagtttcactctgtctccaggctagagcacagtggtgcaatcttggctcacagcaacctctgcctcctgggttcaagtgattctcctgcctcagcctcctgagtagctgggatggcaggtgcacgccaccatgcccatctaatttttgtattttcagtagagacggggtttcaccatgttggccaggatagtcttgatctgttgacctcgtgatccacctgcctcagcctcccaaagtgctgggattacaagcgtgagccacggcacccgtttttggttattatttttttgagatggagtcttgttctgtcgcccagcctggagtgcagtggtgcgatcttggctcaccgaaacctctgcctccggggttcaagcgattctcctgcctcagcctcccgagtagctgggattacaggtgcccaccaccatgcctggctaatttttgtatttttagtagagatggggtttcaccatattgacctggctggtcttgaactgctggccttgagatccacctgcctcagcctcccaaagtgctgggactacaggtgtgagctgccgtgtccggccacttttgccttttatataattctactattggagcttttctaatgtcccatgacagaatgagactaaagacaaaataaataagataatatgaattatgatccaaaatgttcaagactcctcagcctctatgccattaccaattgcttactatgtaagggtggtttaaatgcaaggggtatgtatgtcaagccaggaaatgtcatggaatagtgggatttgttgtttgatgatacattcttaatactttttaacatcataaacattttgtggtagatttcaaaaatgaggaggggtattcttgttttttgttatttgttacttctaccttgatagatctgtgtgaactgttaaacagccaatttggggctcttctcactcctcattccatatctgatcactgacctagttttgtccttgccacagccactaactcagtcttggcctttgtcaaagtacaaacaaatccttttgttcttgaattatttcccaattactctgtaagtacctcattgataaaaaagattggcttttaatctgtctctgatgtctccaggtagccattacaagaccagacagaaaggggaggaaaatcagtgtttttgatttcttgttggtatttttttcttctgcttttggttttagagtctaacgtgaagacattttgctccaagaatatcctagccatccttggcttctcctctatcatagctgtgatagctttgcttgctgtggggttgacccagaacaaagcattgccagaaaacgttaaggtaagtcaaatatatctgtgtgtttgtgtgtatgtaagaggagatctgggtgggacagggggaggagggataaggtatgtagagcataggggacgagttgaggttctaacagcccaggaacaagtcaatttccactggattaggggagtaaaatggaaataggtgctcattctagaagagtaaatgccttgaatcattagtggtgggaagttaactgcctttatgattgtttagtaaactcattaaattgatactctagcagagatgaatgctttattcaccttatccagatctgtgtaatactatgccaagattctatattctagtatatttccacttcttcatcatgggtgaatcacaatactgcactctgttctttttacttcattattatcactatcaccaaaacaataacgtttattatacaactctgtataaagtactttggaagtcagagattgaggagaagacatgtttcttatctccagatatagtaaagaatcaaaatcaataaaagcaaatcagaaaacatatacgtgtatcaggtatagtcatttgaaatgaattcatggataggcagatttcttgtgacatttctacatttgaacaactagttaatatcattaaagatcattaggatcattaactttaatgtatttatgttttctttccagttcatcaaagtaaaatttcagacatgaatatctcacaagtactttgtaatatggtcattatattttttaatctgttaattaaaaagcatgtggtaaataaaaatttatactataaatacaccattttaaactttcactgaaattatagtaaacaaatatataagggcccagatgataccaatatgctaatatgcatgtatgtacacatgggcagtaatatatctagaagttaacttgaccatggaggcctgggaatacatgtgtagaagtatattctcttgtatttgaagatgttgaactgggagcctggaaggatggttgtgtatgccaggcctctgaaacttttgccatccacccaaatcactgtatagcagaggcgtgggtgtcacactggcatctttttgtcaagttcaacccagtggtgctgtgtacagcagtccctttgtcaagacagaaggctgatactatctcattgttaagggtcgcttgccttttaatgttgactgatgttgtttccttggcaaaacttcactcacagttgaagcctcatgacatcttggttccattatttgtttaccagctccaaaaatacatggttgccttcttaatttgacctttttacatgttcagtattgcatcattggagagggggatgcctaggaggcaaaatccatgacaaacttgagttatgttcccaagaatatgtgtggtcatggacgaccttccctcattcacagtggtctcctttaagtctcttgtgcttctgcattgttatatgggcctggcaaaatggaacaaggtctttggcattctttaaataaaaggtaggagtattgaagagcagtcattggcatctgaagtgaatctttttaataacatcactgatttattttatacaaagatagttttatatatgcaaactagccatttgttgaggttatataataattttagtaagattcctggcatatattgggggcaaaatatttcaggaacttgtattctggtgatggctttaaaccagatgtgctgtccaatttgatagccactagccacatgcagctctttaagcttgtcaattaaaattaaataaaattaaaaattctgtccctctgttgcactagccacatttcaagtgctcaatagccatacatggctggtggctactgtattggacaacacagatatagaatattgccttgctgtagaaagttctattggacattgccactttaaagcatactcttgaatgataactctgaagtcattcaaaactaagtttaatgaatagggtgtatgataaaacattttataaaatctagaataagaaacaaaaaaactttttttcttgcatggtttgtaaactagtaccaggatcatcccaaatatcatgggctactaaactggtttgagtagtttattgaaataaatgtatttgcttccaaaaatgaccatttaaaagataacacttatttggatatttgtactgatacatgttttttgtttgtttgtttgttttttgtttctttgtttggggtttttgtttgtttctttttcaagatggagtctcgctctgtcgcccaggctggagtgcagtggcacgatctcggctcactgaaagctccacctcctgggttcacgtcgttctcctgcctcagcctcccaagtagctgggactacaggtgcccgccatcacgcccggctaatttttttgtatttttagtagagacggggtttcaccatgttagccaggatggtcttgatctcctgaccttgtgatctgcctgcctcagcctcccaaaatgctgggattacaggcgtgagccaccgtgcccggctgatacatgtgttttgagagcacacaatgacatgactttatgaccatacttcattcagcagttcttcattcattttttataaatttatgcatcgacaattatttattacactccagtctggctgacagagtaagactctgtctcaaaaaaagtaaaataaaaaatattcattgtctgtgttaggcactgggctacacaatagggaaggcagtatatagatatgactgagcttaccatctggggaagcaaacatatttaataacacaaattattaattgtaattatgataaattgccaccaaatgaaagttttggggccaggcaagtcttccctgaaaaaatgatactaaaataatatctgaagaatgattggaagttagctgggaaagacataggtaaagggtagtccaggcagggccgagcacggtggctcatgcctgtaatcgaagcagtttgggaggccgaggtgggcagattgcctgagctcaggagcttgagaccaccctgggcaacatggtgaaacccaatctctactaaaatacaaaaaattagcttggtatggtggcgcgtacttgtaatcctagctactcaggaagctgaggtgcgagaatcacttgggccccagaggcggaggttgcagtgagccaagatctgccactgcactctagcttgggctacagagtgagacgccaactcaaaaaaaaaaaaaaaaaaaaaattccaggcagaaggaaagcaggtgcaagagtcctgaaacaagaaggagttggatatctcctaggaactagttggagagcaggagtgggccacgtgttatataaagatggggaggtacgtggtgcaggccctgcaagacaggttgaggatttcagttttaatcctaagagtagtgggaagctagtggtatgatcagatttgtttttgcaaagatcactctgatttcaatgaattagaggaggatgagatataggaggataccaggaagaggctacaagaaaaatgtggaaggagggggagcctttgggttcaatttttgaagaattgttttgagtgttggaaagccaatgggaaatgtcaagaaagcagttggataatcagatttggacctttcttttctaagcagatatctactgctgtgctcaataaaaatataaaacaagccaaattttaaattttcaaagagctacattttagaaagtagaagaaaagaggtgaaattaattttaataatataatttatgtggcccaatgcatccaaaatattacctcaacatttcatcaaaataaataattgttggctgggcgcggtggctcacacttgtaatcccagcactttgggaggctgaggtgggtggatcacgaggtcaggagttcaagaccagcctggccaacatagtgaaatcccgtctctactaaaaatacaaaaaaaattagccgggcgtggtggtaggcacctatagtcccaactacttgggaggctgaggcaggagaatcccttgaacctgggaggtgaaggttgcagtgagccaagatcacgccactacactctagcctgggtgacagagcaagactctgtctcaaaaaaaaaaaaatttcgtttttgttttgttttgttttgtttgttttttgagacggagtttcgctctgtagcacaggctggagtgcagtggtgcgatctcagctcactacaacctctgcctctcgggttcaagcaattctcctgcctcagcctcctgagtagctgggactacaggcacgtgccaccatgcccagctaatttttgtatttagtagagacggggtttcaccttgttggccaggatggtctccatctcttgacctcatgatctgcccaccttggcctcccaaagtgttgggattacaggcatgagccaccaccatgcccggccaaaaaaaaattgttaatgagatatgttacattcttttttcatactatcttcaaattttaacttatggcatatctcaattccaactagtcacatttcaagtgctcaattgccagctatttgttaccctggttaaatagcacaggcctagattaaagctatgtctctgatggcattgattgactgaagccttagaaatggatgaggtcatctaggatggggttataaaatgagaagagagtcaaggtccaagtcctgagaagctctatcatttaaagcaggggtccccaacccccaggccatggaccagtacagcaggaggtgaggaacacgcgagcgagcaaagcttcatctgtatttacagttgctccccatcgcccacattactgcctgagctccatctcctgtcagatcagtggcagcattagattcttataggaccgcgaaccctattgtgaactgcacatatgtaggatcgggattgcgtgctccttgtgagaatctaatgccggatgatctgtcactgtctcccgttacccccgtatgggactgtctagttgcaggaaaacaagctcaggcctcctattgattctacattatggtgagttgtgtaattatttcattatgtattacaatgtaataaaaatagaaataaggtagttcacaataagtgtaatgcacttgaatcatcccaaaaccatttccccctcctcaccacctctgggtctgtggaaaaattgtcctccaagaaactggtccctggtgtcaaaaaggttggagaccactgatttaaagggtgaatagggaaagaattcctcctaaggcataatgataacattatttagtgctttgcagttataaatcatttccacatgcatttccattttttcttcccgtgaatactgtgaagaatagaaggttatccccattttttttttttttttttgagacggagttttgctcttgttgcccaggctggagcgcagtggcatgatctcggctcaccgcaatctctgcctcccaggttcaagcaattctcctgcctcagcctgctgagtagctaggattataggcacacgccaccacacccggctaatttttgtatttttactagagacggggtttctccatgttggtcaggctggtcttgaactcccgacctcagttgatctgcccgcctcggcctcccaaagtgctgggattacaggcatgagccatcgcacctggccatgcccattttatagataacaaaatcaaagccttagatgttctctcacccaaggcagagggggagctaaaactagaatccagttttctgatccaaagactaatgttctttccatttgtcttagtgagtttttccaaacagcacatcctattaacagaaattgcatgcaggatgtttattttgggaagtgattccaaggaaacaaggaagaagggaaagagagagttaggagcaaattaccacattgggccactgaggcttgatcctcccagggaccctctcaagagctgtggagagtgaactttagaattgtctgccctggggatttatcccctggttctcattatctgttggtcaagggttgctcccatctggtgttaagtccctgtcacttccaggtttgcacgtgtgtcagaggggtcatgtgggtaccacaggtgacaacttaggcagcaggagagaagctgctgggcagaaatagagagataaggagatactgctggggctggagtaaaaagttggccaagatgtaaaatggtcacaagaggtatctgaagtatcattgcacctcctgatttttgtggaggtgagggttcttcgtacaaataatttcaatataatagagatatattcatgcagagacagtgctatggaagcccagagaaagaagctgctaattgtgcctgtttacatggaggcttcacagagaaggtagccttggagctgagtcttaagtgctatggcttgaatgtttgatccctccaaaactcatgttgaaacttaatccccagtataatagtattaagaggcagggcctttaagaggtggtgggtcatgagggctctgacctcatgaatggattaatccattcatggataaatggattgagttatcacagggtgggttagttattattagagtaggtctgtattaaaagctagtttggctctcagtatgccccctttgccatgtgatgccctgtgccacctcgggactctgcagagagtccccaccagcaagaaggccctcctgagatgttgcctcttgaccttggacttcatagcttctagaactgtaagaaatacatttattttttaaataaattacccagtatcaagtattcagtgatagcaacagagaatggactaagacaaatggtaaggagttttctagaaagtgggataggacatgttccagacaaagattatatcatgtgttgaagagtgacagcttgaaatcatatgcaatccctggggaatcagcagctcagtatggttagattgttgaatatgggggcaggaaggagaggtggaagaggaggtccaagtctgagcttagtatttttggcttaaaagtgggcatctcatccattaaactgcagtggtgttcaagcttggatccatgttagaagcacctgaggagcttttcaaaaatatggctgggccccatctcaggtcaattaaatcatctttggaggttacagttaaataaaaatggttcaaaatattgtagatcaccgggcgtggtggctcactcctgtaatcccagcattttgggaggctgaggccggcagatcacttgaggtcaggagttcgacaccagcctggccaacatggtgaactgtctctactaaaaatacaaaaattagctgggcatgttgtcaggtacctgtaatcccagctactcgggaggctgaggcaggagaattgcttgaacccaggaggcagaggttgcagtgagctgagatcacgccactgtactccagcctgggcaacagagcgagactctgtctcaaaaaaaagaaaaaaaagcccagggactgatacgttctaaaatcttccatgtgattctaatgagtagttttgattgaagaccactgctttgaagggtttcatacaaggaagtgatgcccagatttgtgttcccaagattccttttggctggagagcagattagaggagagaccagttagcatgctcctgccatggtctaggcaaggcaggcgaggccagaattaaggcattgtctgtggggtaaggggaggggataatgtgaaagacacttgggttgaccagatctttgtgacaaaattcctttgaggaccttttaagattaagatggaacaggtaccttgggacggttaatgctgagagaaaactccgaatgcttctgtttaaagagggtggtggccacaagcctctgttggtgcaacttcatacatggaaagactttcagctgtcctgtactcacttcctctgatttgtcatccctgtcctcttgcagggatcattattctgcctgcctagagtacaacacaacatgggccatggactcacattgccttgggtttgaatcttcgctgtgctcttagggtcacaggagttaacctctctaagccttagtttctccacttgtatgatggaactgatgcttcttctcttgtaagattactgtgagaattcagtgggataaagtacatgcaaatatgagtccagagcagaaggcctggcccactgcagacactcagtgattgataactcatgtcttatcatttttgcagcttacctgccttagtgacaaattgacagttatctttattttattcccactgttccccatctgacttgcccttgtctagcccatttcaggtcagcccacccatgctgatgatccagtcttgtcatcttcctgcctgacctagtttgggttcagccctgctggggagatagtgccctcatgcctgggccacatgtggcataacacagcaagaactctttattgttctgaaatgtttacttgcccagctacctaaaaggttataagcacattgaggacagggaatggatttcatttgtctttgtttgcattttatttattcattgactccattcattcatttaacaaatagccattgaatatcaactctattgtaggccctggcatatattagtgagcaagatgggcaaatttattatacccttgttttgaacttatagtataatgagggagataatcattaatcaaataatcataaaataaatgttaaattacagccagcacaacatctgatttgggtagttgctccagagaagtttgctgactctgaatagagaaagcaccttgaacagataaaaccgttccctccttgtatgtgaagaacccaggaccaacctggtagccaggcagtgtcagtgagggaagcagacctctgcctcagagttctctagagatcctagttccccactcttaccctcagagccttctcagtttgaacctccagagtgcagggcctcagaagctacatgtgttagcaggcatcctggggtgttctcatgccactgaagtctgtgaaccactgcctgtgagacacaatgagaacttaaaaaaaaatagccttaatgaactgaagagtcattagctgtacccaagactccccctgggaaagtacctttgttctggtggacctaggtggggcggtagctttgacgtctgcttggttccccacttccttgtctactcgtaactgaacactggcagttagtggttgtcagatattcttttagcacaaacattccacattttggcacacactgagtctctgtcacacaagcaccagactgacccaatgccaaacaactagccttcattaaacgctgcctcttctgtgaatgcaggctcagggaccagaccactttgattttaatcccagatatgctactttctagccgagactttgggcaagaaattctctctatgcctccccttatatgtaaaatcaagatagtaacagtacctacttagaatatggttgtgagaattaaatggaataatacaagtgacttaattgtcagagcgatgagcacatcagaggtcctcaatggagactacctgctttaatgaagatatgtcctatggaaggcccttagctattagtgtattatggtcactgaaccagtactctgcaggatttccagcttctgttaaagggtaatgacctttcctcatgcatctgctttttcaaaatgaacaaaagtgctgttcttagataagcatttgtgattttatctttttatggagactttggaaagatttgctctgatttccaacctcgaatactcttggaaaatatctgtattatttttactctattggattttaatgtgtgttttagaaaacaacatctgcagatagatggtgttgcacaacaatgtgaatatccttaataccacaaaactgcacttaaaaatggttacaatggtaacttttatgttatgtgtgttttacagcaattaaaaaataagacaataacagaactgtggtttgtattaaagatctagtaactctaattaaagaaaaaggaaaggaagaaaatggtctctaaatgtttataggccctactagcatctctgtagctaatctggtttgtttatagagtactagagtcttactcaaaattataagctttgtttataaacccaagctcactgagacagactgatgaggctgctgaagttaccattaaagctacaggaacttttaagaaagtttttgaagacacactgtgtctgaagggaccatgaaaagttaatgatcatacttgcctgtgttaccagatgtcttagtctgttttgtgtggctgtaacagaatgtgacaaacttggtaatttataatataaagaacagaaattacttttctcacagttctggaggccaagaagcccaagatcaaggtgctggcaggcttggtgtctggtaagggcctggtctctgcttccaagatgatgccttgaactctgcatcctctggagggaggaatgctgttcctcacaatggcaaaagagtaggagatagcaaactcactccccaaaccccatttaattgtggcattaatccatttaagagggcagagtacttgaatacctaaatacctcccactagggctcacctcctgatgctgatgcattggtgatgaagttttcaacacatgagttttggaggggaaaacagtcaaaccacagcatctgtcttatgagctttttggggatggtgtaggacaactccagtggtactactttatattagacaatgaatattaacctcttttagggctggaaggaatttaggaaccatccagttccaaccccctcatttatccatttgattcaataatgatctgttgaattctttctctgtgcctaatgtatagtaggatataccatcgtggatgctgtatatactgtggtaaacaaagtagacctgccctcatgtagcttacaatctaataataaagatagatattaatcaaatagctgcataaatatgtaattacaccatgtggccagtaccgtctttagagggaaaatacaggcattctgatcaggagggtaggatctaaactcaggaggtcagagaaggctgagatgtcaagtgaagggctttctcggtaaaggccctggagcagaaaccatgagacctatgggcaactgcaagcaggccagttccaccagaggtgttttctgaatgagaagagggtgaaatattctacttctgtggagccaggaagcaggctgtctgatgctctagtttctctttctttctgcttctaaatagacttacccagaagcctggtactatgacatttgtgtaggtagaattgtttccatcctaaggagatatctgccccatatctatacggcctccagtctcagtgagcttagggtctgttgcgcctacatttccaggtcttcaccaaggcccctgcattggtgtttccatgaaccaagcaaggtcacttctactgttcctctttctggaccagcacttctatccatgcaacctagctcatgaagatcggttatgatcttcatgtgatcactgcactccagcctgggtgacagagcgagactccgtctcaaaaaaaaaaaaatttaaaaatttaatttatttttagactcatggggcacatgtgcatatttgtttcatgggtatattgcatgatgctgaggtttgggcttctaatgatcctgtcacccaagtagtgaacatagaacctgacaggtagtttttcaacctttgacctcctccccacctcccctcttttggaatccctagtgtttattgttcccgtctttgtgttcatgtgtacccaacgtttagcttccacttataagaatatgcagtatttggttttctgttcctgtgttaattcgcttagggtagtggcctccagctgcattcatgttgctgcaaaggacatgatttcattcttttttatggctgcatagtattccatggtgcatatgtaccacattttctttatacaattcatcattgatggacacctgggttgattctatgtctttgctattatgaatagtgctgtgataaatatacaagtgcaggtgtctttttggtggaataatttgttttcctttgggtatatacctagtaatgggattgctgggtcaaatggcaattctatttttagttctttgagaaatctctaaccttcttttcacagggctgaataaatttgcattcccaccaacagtgtgtaagcattctcttgtatgcacaatcttgccagcatctgttattttctgacttcttaatagccattctgactggtataagatggtatctcattgtggttttaacattcatctctctgatgaccagtgatgatgagcattttttcaaaagtgtattggccacttgtatgtcttctcttgagaagtgtctatttatgtctttgacccactttttgtgtgtttactctgtcactggttttttttgctgtgcagaagctctttagtttaattaggtcccaattgtcactttttgttttaactgcatttgcttttgaggacttagtcataaattctttcctgaggccaatgtctggaagggtatttcctaggtttcttttatgacttttatagtttgagggtcttacagttatgtgtttattctaccttgagttaatttttgtatattgtgagaggtaggggtgtagtttcatacttctacatatggttagccagttttccaaccaccatttattaaataggaagtccttttcccattgtttatttttgtcagctttgtcaaagatcagttggctgtaagtgtatggctttatttcagggtctctattctgttccattgatctatgtatctatttctgtaccagtaccatgctgttttagttatcatagctttgtggtttaaagttaggttatgtgatgcctctggctttatcctttttgcttaggattgccttggctatttgggctcttttttggtctgtatgaattttagagtagatttttttctaattctttgatttctttgggcaatacgacgcattcaaaaaagacttggaaggaaataaataaaaataaaagtgatatctaattagtagaatcttaaacatctttttttacttcattttataagtgatatttaagaaacttttagtactcttaaaatagaaaataatattgaaatgatcccgagggagtgtcagatctcttccttaccacctaaatcttactgctttctttaaaggatatactcatagggacttttggaaatatttaaatataagctacagagaaatgttgggtttctccactgccagactttgaggcattcactagctaatggacttttgagcccaggaggcagagagaacatgaacattctccagacttctgggaagctttatttactgaagcccctgtaggcctcgtactctctggaacatgcattggaaaatgctggtgtggtggaaagagaacaaaacgttgtggctacctgggctctgatggatgttgtaacaaagaaaggcaagctccccaaatgctcaaattgaactttcagtcaagctttatctgtctctcaagcagcaaacaatgccagttttttattctgcaagccattttagaagacaaaatgtttggcacagttgcacaggttagcatgctagtgtactgtgtacacaagatgaaatgtcttcaatttgtgttaaaatatgctttacccccttctcaaacacttgtcaaatgaaacgtagtaaaagtttttgtttctcaactacctcactgtgtaagtaaggccttagagaaaacaagctgacagaagcaagcctggttctttggctctatgggaagaatgactttcgtatcaacaatgttagaataaaatctgatcccagataaatgctgcttgctgcttctacctcaccagtttctgtcgtatgctgctgtggttggaacattttctggcaggaagaaatcaggggctctgttaggaaacaacagaattttctgccatgtgtaattcctgagcctctttctccactctgggaggtttctcaagggtccagtggccccagaccttagtcagtgttcctctctgcccacaatggccaccacctaagccatttcttggattcctttcactgcaagcctagctgcagaggagtctgtccagcttgcttccttgctgtgcccaaagccagcatacaggcccttttctttctaaaggcataatgctaattactggagggaatccccactgtgtgtaactaggaagagaacactgtggaggttatggcaggtcaagggtccttgcaaggtctgcacggtggtactccctggtctagtgaaatggagtagagtttgacactcaataggctctacttttagcttttcctagtggtccagggaggtctcttaaatcctatttcttgtcttcttttctccctggagtctcttagattcatagcagatgatatatatacccattgccacctacattttcaggtcttcactggggcccctacattggtgtctccatgaaccaaacaaggtcatttctactgttcctctttccagaccactgcttctgttcatgcaacctagcttatatatgtagggagattcacacacacacacacacacacacacaccacacacccacacacacccacacacacagctaaattaagcatttttaaagtggcagaccatactttgaggtctgcagcttaaataagcagccacgtgacaagcgtctccttcttctcttcctttcgcttccccatttacttccctctatgtttcttctctaaggaagatttaaaagcacatgtgccatcatgctcttctcccaagttcatatcagatgtcattaatcaatcatggaattttttaatcctgagtaagcccagagatataaccaaagatgactatcagttgatcaaaatgggcattgagcagtttactcctggatagatacccccaaagaaatgagagcttatttcaacaaaatgaaatgcatatgaatgtttctggcagctatatttccagtagccccaaactggaaataacccgaatgtccatcaacagttgaatggataaaaatatagtatatccatataatgaaatactttgcagtgatggaaaaagatgaactactgatacacacagtttgagttcatcttacatagtgtaaagtgaaagaagttagacataaaggaggcatactatgtgagttcatacattgcagttcaaaaacaggcagaactcatacatggtggtagaagttaagacagtggtaactgactgagaggggcactgggaagccttatgagggctagaatgtgttctgtatcttgatctgggtggtggttatatggatgtgcacatatgcaaaaatttattgaggtgtatgcctagtatttgcacactttactgtagctacccctcatttaatgtccttaaaagggggcaccaatttgaaaattattgcccagcccttgcttctatgtttctgtgtatagtttctgtttctagttctttctcctgctgtcatctgtccttcttctcctctgctgactttctttcctcctttttttcttcttttcatctccccctactcgtaaagctaaaaacatgaagtttaagtacatatattgtaaaatatattaaatacaattttacagttatattcataatttaaaagtgagtgtatttagtgtttttacacctctccttaaaacaaactctgcatttattgaactaaaattagatgaacatatttattacgtcttactggcattcaatggagtaactcagtggttcccaaacttatctgcacattagaatcatgtgggaccttataaaaattccaaagcccaggacacaataccacatcaattagatcacaatacctgggtctaggacacaagcatcagtagccattgaagctttccaggtgattcccgtatgattccaatgtgtagacaagtttggggactatagattaatggctttctattccttccatagtgtctcagctacttcagcatgtggttctgaatcttggctgcacattagaatcacctaagaagcttctaaacaatactgcttcttgggccctgttctgcataaggtctgaatatttctaacatgcaaacagcatgaagagccccgttctagcagggttgttgtcctggtagatcttgtgatcggagtgactccagtgccatcccctcaatgttcctctcaaatactttctcctcatgtttttgaaaattccagtcctttcttttgcaagcctaatatggagatgagtgatgtgatactgataagtttttggtctgtgttgctttcagtatgggattgtgctggatgcgggttcttctcacacaagtttatacatctataagtggccagcagaaaaggagaatgacacaggcgtggtgcatcaagtagaagaatgcagggttaaaggtaagatgaagaccaagggaaggggaggccaacagtggggcatgagaacatgagaggtgtatgaccagtagaacacaagagaaaaaggagtcccacgcataggaagccaagtgaagaaaacagtgcagctgctgttgttatgttatcgttacagaaaacatattgaaatcagtcgttaatgatcaaaacctaagaataaacacacataaatataattaatagtagctcccatcaacagaacacttctgcatgctatgtacttagtactgaacatgtgttacttcagtataccctcataatctccctttgaggtatgcattattatactaattttttaaaaatgagggcactgaggttgagagaggttataccacttgtttgttactcaagctagtaagtgatggagctgcggttcaaaccaagttctgcccgacttcaagtctgcatcttagccagtgcttctcaaacttgcatgagcttgttaaaaacacagatgatgggtcccatcccctagagtttctgagtcagcagatctggaatgaagcctgataatctgtatttctaagaagttcctaggtgatgctaatctgtctggttcagagatttattgctctcttaatctttgtaccctgatctacagcttggaagacatttttcaaagctttcagcttctgtgtaggcaggaaagaccaaattataggctcttagggctgggaaaaggaacttacagatcgtttaaattttgtttcacagagaaggaaacaaaaacctggaggattagtgccttgaaagtagcaacagaatagagacaagaatctaggtctcctaattacactctaggtttcctgctactctgagctgctgcattatatatcaataatttttttcttttaaggtcataatatgttagagtggttgacattcagctttcaatccctttacccagtaccctaccatgcaccattataccacagtctctctgacttttatctctcttagccttttgagctgggaacccactgtttatttttagtcagactgatagcctagatcctagaagataattgattttcagtttgacagcctgtggaatccactaattttcacaggtcgtcaagaaagtagtagagaggagatatttccaagagagcaagtcattctacccagtagccccatcaatactgacactttggccccatctgagacagtacttctggcctttcttaaagcccaaatccctcattttattggcttttatttgacacactgccttccatttttaaaagttattttaatggccaagcacggtggctcatgcctgtaatcccagcactttgggaggctgaggtgggcggatcacaaggtcaggagatggagaccatcctggctaacacggtgaaaccctgtatctactaaaaatacaaaaaaattagctaggcatggtggtgcgtgcctgtagtcccagctactagggtggctgaggcaggagaatcacttgaacccgggaggcggaggttgcagttagccgagatcgcgccactacactccagcctgggcgacagagcaagactccgtctcaaaaaaaaaaatctagcagatgtccttcttctgagacttatcccatgagcgtttggcctaacaatgaaggattcttccctctcaaaagagagagttctctagttaatcaaatatttaacaccaaattttctgaatcaaaacaattagctggtaacttagagctgattttctcatggttattaggctgtttgaaaacctgtgaatgatctggataacttatttgaataattatccttaaagcaattactctgctatgaagcactgatagtgtagatatttatcttaatgtgagatgaaagtgttgttataacttcaaaaagcttaaggaatcttggctctaatcctccatagcaacagtcggttttgctctaaaactggaaaaacagttttgctagggaggcaggatatcggagtggaaaagtcactgaagagacatagattctgttcctctttcttgtaacaggaagcaactccacctcagaaactttaaggtgctggccaggatcagataactagttagtggcagcttccatctttttagtaaaagccaatttgtctgacgcttaatttttattccaagtgttatctttaggtcttttaggaactagtgtcattaattacagtgttctggaggaaatatcaaaaagcagctaacagagtagctatctataatatccccattaaagtctgagaatgttatgcaattgaatatgaaattgcgccatccagtggcagaattattgaacactgaacagacccaacttaaagtctggaaattaaatcctctcaaggctaggtccagtgaattaccctctaagtacaataacctaatgtatagtacatcaggaaattgttttcttgtatttttttcaaaacaccatattttgatctactattgtcaaggtatgttttataatttttttttaaaagattgttatcttctacattttttcctaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggtatagcagcatgtagggaccaagagtatctgggagttaggcttggcagtgaaagagcctctgaagttatgggaaagggccacactccctaataccccaagttctacacacccaagtccatacttaagaaaggatattttagtaagtgaataaaatgttcaaactcttagtatatataggggtaggattttatgtatgttaaaaaaaaaagcccccttgtgcatctccctatgggggattcaaaggggaaggggcacagggagagaaagactgggcccgtatactctggggtttggggctacagatttaactattcaatatctgggaggaagaggataagaggagactcatagacatcccaggtcataaatattcacaactagcacatctttatatcacttgatacctgtgtgaattatttgttcacttgttcattcattcagcatatagtgcctgctctatccagaatatgaaaactcaaccctcaaggaaatcagtttcaatgcagggtgatcagtgttttaatagaggagtgctcagagctgctatgggagcacatttggccctgcccagggtgagaggaggtcaggaagacttagaggaagggatgcctgaactgaatcatgaaaaatgagttggaggatcggggaacagctttatcagcagaacagacagcatgcattcagtaactgatgtttattcagcacctattatatgtcaggcactgttctaagtactgaggatacaacagtgaacaggacaaagtctctgacttcatggagcttgtgttctaccggatgtgcaaaggtagggaagtgtgagaggcatattcagaggactgtaagtagttctgcatagatagaagataggtaagtagtgtaaaataataatgataataatagtagcagctcgtatttattgagcccgtcctatgttcttagcactacgctaagcacttaattgcactgtcataacaactctatgaaattaacaattattaacaagataaggaagctgtggcttacaaatgttaagtaactcacccaaggtcacacacctgggaagtggtggagccaggattctgagtgggattctgaaaaggaagggtccaggtcacaaagtgccctatggggccatgctaggaagtttggagtttatcttagagatagtaggaagccattaaaggatgctacacaactggtgacactggtagagaagatggattggaggggagaaaagctggggataaaaggaaggcagttagtaggtgtggacgccatttagatgagagatgacaggggcctaatgccagctggaaggtagcatcctctcgctcagagactcccagtgttgggtagcctagatcttggaagcaattgcatcccatcttcattaagacaaccctggaagattccttctttaggtctcaaggtctcaaacagacccaagaactgagctgtaatatgaggaagatttttcccagtctggcagcagaggagattggatatctattccaggtcatttgccacctggtttctactagaaccctaattaaaaacctggagcagagtctggccatgtaaccagctaggagccacccacagtggttaatatagcacacatcagcttcaggtatggtcatcaaaccatacccagctatcaccaccacagtaattttaagagcctttgataactttttgagccagggaacttcagaacaaaagtggtattttaaggaaaaccaacctatgaaaggattggaaggatgtggatttggagagagatgaacaaaatattaattctgcctcatccaaaaaaggggtttcttggacagctatgtgcgaagatccccatctcttcatttattccagggcattatggttcacttcttagtagcactgtgtggatgctgtagctgaaatgggtaatgtaatataattattaaaacaaaaatgataacctcagctcttcctttgtacaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcaggtgaatatctcacagcatccatggaggtggctctctggaggccaatgccattgctatctcaggcagtacttgggtcgctagccagaatgaatgaatgaatgatagatggatggatggatggatgactggatgaatgaatttactctcacatttgtaagggtcaccagaggtataattctcttacaagaccttctactattgggagaataaggacatgtctttaccttagggaggcataaaggaaattaaaaatttatcattaaaaattagaatagctaacatttgccttctgctatgtgtctcccgctgtgctcagcacttttcatgttttctctgattttatccttagaacaacactatgaggtactacatcatccccattttagagccccatatcgatgcctagagagggtaattagtctgcccatggctgtacagctaacaagcgactgagtgagaatttgaacttgaatgtgtctggcctcagacctcttgtttttaaacaccagttacactgcttctatgtccggcagtctgagctatgtctttgaagcccctcttttcttgctgataatctgttgtagatcaggagcctctagtgagctttgcctcacctttatgcccctgtttctttgccttaggaaatccctgactccaatagatactatgaaaagcagggtgtccagagacttctagcactggtaactgtactgtctttcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggcaagtataactcaatccagacctgcccccttcacatctgcacctccagcccccacatcctgttgttttctgtttcaaattcagtagtttgtctgaacttggttattgtactttccaaacctttttaggcaggatattgaactacatctggttgacccctataaattgtttcagtcagacatcccctcccatgtttgtttactgcgttatctccacagacacaactgagatcttctctcaggaaataatttctccccctcgtggggttgataatgaaaattatgtggtagaatattgtttgttggagggggaattgcaatttataagctcttttagaccactttttaaagctccctttcctacaaactacaaaaaaacagagttgttagaaatgacctggagaggagaaggaaaaaaaaaaaaacacttcaggagaaacacaaaatgtatcaattgacacttcaaatcttgtcatcttgtccccagatgccttctgcattttgaagacaagaaaagttaaacacactttgggaggctgaggtgggtggatcacttgaggtcaggagttggagaccagcctggccaacatggtgaaaccccatctctactaaaaatacaaaaaaagaaaaaaaattagctgggcatggtggcacatacctgtaatcccagctacttgggaggctgagaaaggagaatcacttgaactgggaggtggaggttgcagtgagccgagattgtgccactacactccagcctgggccacagagcgagactccatctcaaaaagaaaaaaaagaaaagaaaaagaaaaagaaaacaaaagttaaacatactcaacatcatgtgagtaccaggcacaccctgacaagcaaacacaaagccaggatgtcatatccagctgttccctgtctccactgaaaggataacaagttctctgctctcctccaaagcattctctctggttttcaaaaccactaccaataagatggtcctgggagtagggggcgctgagagacatccactgagcctcaaagctccactaaccttcttatccacagcagcctcctttcttccctagtaggttgtgggttagaaattacttttttttgggccaggcgtggtggctcacacctgtaatcccagcactttgggaggccgaggcgggtggatcacttgaggtccggagttcgagaccagcctgaccaacatggcgacaccccgtctctactaaaaatacaaaaaattagccgggtgtggtggcacacacctgtaattccagctactaaggagtctgaggcaggagaatcgcttgaacctgggaggctgaggttgcagtgagctgagattgcgccattttactccagcctgggcgacagagcaagactccatctcaaaaaaaaaaattatttttcttggataggagaatgcttgaagaagaaaaaaaatttttttaataatttttaaattatgtaggctcctggagaactactcccaggcccaaatttttgacaaccttgagagtttccttgtgaatttgctcctgacctagatgattaggactaagcactcagggacatttcaaactaatggcatttctgggcccagttttaactacatcagcattctttgactagccaaatacatttatatctgataccacttctggtgcctgttacacaaatccatttttcatatttattcctaagggtaaaaaggcagggcaggacatattgattccaataccaagtggtgggatgttgtacagtgcctacatattgattaagtcagactgtaccttttgtatccaaagcgttcacacatgatgctttcaagtgatttttccattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggtaagtttgtgaaatgatgaggtataggatgtcttgtttacaagttatagaatatgtgcctacaaaagatttaaataataggatgcatttttctcttacataatgtcttgaggtagatgattaggggttggttcttcagctcaactatgtcagaacttgggatcagttttttccactatcgttgtgatctttttgtgctaaggtatgttactgctccaagcaccatatcactaggtcactgcctcctttttggctctaggcagcaccttaagcccaggttcatctcctttctagtcaacaataagagtactgcctttccggaatgggggaggtcccaaagaggttagccccagcagtgtgggaaaactgactagggggttgtgcccaggggaccttgtgggacagacctcctacagccatagaacagccactctgatttggcatctcctttggccaagtgacagagcagacttcccagggctggggatgctaaatctgcctcttccttgtctctgcctgtccccagggatatctcccttcaggatgtcacgatgcttactgtgggttaagacaaagacaggtttcctgctagggaacccaggatgatggggaagctgattgtccaccttgatctcactttttccagtgtacaaattgtgagtttgggggaaattttccacaagcttggtgtcaggcagaatcgggggagaggtgacatggatgtggaagtttgattatcttcccgtctgcttggagttttttcacttctttgtggccccaggaactgtctcatcttcatatttgatttctgggatattgctggtgataatctcagtgctgtacatttgtttctggttgtctgtggttggggggcatgaagccagcttgcttccatgccgccattttggaatcagacatccaagcatcatattttctttcacatgcaaagccaaagcaggaaagatgtttaaggttttccttgcacacatctcttgcacacacattttgcagaagtgccaactgacatcttttcagatcctgctggccagaacttggtgaaatatatactctaaaccaatctgtgataaagagaaatggattaatatagttagtttagactaattattgtttatcacctgaggagtcgtttttgaggatattgctttcctctacttgggtaaaatcaggacttcataagcgaggaagaagggggctagctatggggtatgtgcctgttagagtttgccataggtggcttctcaaatgttagaaggaggaggagcagcagttagatgacacagctgagggttttcctctataaagacatttaggaagtagaaactcaggaaatcccaaagaaacattgaagataacatcattgtcattatgttttgaagagttgggggattatttgaatcctagctccaaattccttattttcttaataactccagaataagataaaatatttgagcagaggcagaagagatggctcttaattgactcagtcttcaaatttcttattttggtcccagaggctgagcattattataatcatagtttagtagcatattgaaaaattagctaccatctgtcaaatgccaattattgactatgcactatatgtatattatctcatttattcattcaagatattcaaagaaacaaggcttttgcctgccttcatgctttctcccttttcagaaaacagatcagcatgtaagaagggaggttcagctcctcccctccaggaccccagcaagagagtttctcctaaggtcacctggcttggcccaagacaaagctctagaagagaacataggcactgtcgtaatcagatctgattctacttctggcttcttatgaactgtatgagctcttcattttcttggtctctgagaaaacaataggtaatgccatagatccagacttaccttaaccatggtccaaaccacagtctaccctcccctcaaggttcctgagggaaatacatgacaagacaatgactggcagagtaatatttggttattagttggctgcaaacccaaattcagaagaaactgaacctcacttgaatgccctgtggctgagctggcactggctcttcaccttggacttttttttgggccagggcccttgccttagattgaactccttgaagaggaaggagggtgccaccttggccaagggcctttttcattccagtcactgcgaggatgtaaatctaaagtcaatgaacatacccttgtgtcttgagtttgtaacttctcagaaagtttcacttcctgggaaacatggccaattcctgccttcaagcttgagcaaacctttcctccttaggggactgaaatttcttgcctttgaatgtgattcatccaaccaaagcagggagagataggggctggaaaagggtggaggagtcttgaactccccctggaggcttttctatttgatcccttagttcctcattgagattgttctcccagccttctgaacctcagtttggcagttcctgagactatcgcattgcctgcctctatgtaggatctttctcctctagatacagccctcagggtcaggactgtcctgtcccgatttctgcattggcagtttcattctgcttcagatttttgatgttttttgttttgttttgttttatgccctctgtaatgtatccctaagacctaaagtttttttgtctgtttcctcatctgtacaatggggacagtaatatctacctcattgatagttgtgagtcagacaagcagtgatggtctgggaaatgtccaacaaccaactctcggggaatggggagctgatttgtagcacttaccagtttccatggtgtaagtagttctaccacagcctatttcaagctatatcaacatatcaactggctcacaaaaatctggaaattttaagaatcagctcttgtgagtacataagaaagagtcagctccagcacaccactgtaaatagcaaaaagcgggcataccccagcaccacccttaaaaaggttaggtctttatcctagcagtcttcattctatgctgtccttcctgcagggagttcctgttatcgagtcctgcctcttgaagcatagctatgtgcaacacagaaatccagtttcattcccattctttccagaactagttagcctgggtgttctcaagccacagagaatttgttggggagggagtttttgccacagttgcattcagcactgatgatctgattcttagttggtaaatatggtattaaaaattgtcattgctttagtcagtctggctacactgtagccttggttgctaaacagaatccaatgttgtgggcaaattagaaacactaacaagaaagagggaacatctgtagggaattacttatgaggtaatttagaaattatttttaaagatcacattgtgctgtttatataaataagaaagggaagaaacaagttcaataggaaactggaattaaagaacattaaaaacacatttgtttacatatgtatacataaatgtgtgtatatttatatttatatttatttatatttatatttttgttggtacaaaagtaattgtggtttcagaccatgaattttatttttttaattttttttgaaaagtactaaatatataaatattcacaagttcaacaaaggagagaaaataacaccaataaaatccccaaaaacttaacaatacattaatctaggttggatgatcttttttttttaattatactttaagttctagggtacatgtacacaacatgcaggtttgttagatatgtatacatacgccatgttggtgtgctgcacccattaactcgtcatttacattaggtatatctcctaatgctatccctcccccctccccccaccccacgacagtccccggtgtgtgatgttccccttcctgtgtccatgtgttctcattgttcaattcccacctatgagtgagaacatgcagtgtttgtttttttgtccctgcgatagtttgctgagaatgatggtttccagctccatccatgtccctgcaaaggacatgaactcatcattttttatggctgcatagtattccatggtgtatatgtgccacattttcttaatccagtctatcattgattgacatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccttgaggaatcgccacactgtcttccataatggttgaactagtttacagtcccaccaacagtgtaaaagtgttcctatttctccacatcctctccagcacctgtcgtttcctgactttttaatgattgccattctaactggtgtgagatggtatctcattgtggttttgatttgcatttctctgatggccagtgatgatgagcattttttcatgtatctgttggctgcaaaaatgtcttcttttgagaagtgtctattcaggtccttcgcccactttgtgatggggttgtttgtttttttcttgtaaatttgtttgagttcattttagattctggatattagccctttgtcagatgattaggttgcaaaaattttctcccattctgtaggttgcctgttcactctgatggtagtttcttttgctgtgcagaagctctttagtttaattagatcccatttgtcaattttggcttttgttgccattgcttttggtgtattagacatgaagtctttgcccatgcccatgtcctgaatagtattgcctaggttttcttctagggtttttatggttttgggtctaacatgtaagtctttaatccatcttgaattaatttttgtctaaggtgtaaggaagggatccagtttcagctttctacgtatggctagccagttttcccagcaccatttattaaatagggaatcctttccccattgtttgtttttgtcaggtttgtcaaagatcggatagttgtagatatgtggcattatttctgagggctctgttctgttccattggtctgtatctctgttttggtaccagtatcatgctgttttggttactgtagccttgtagtatagtttgaagtcaggtagcgtgatgccttcagctttgttcttttggcttaggattgacttggcaatgcaggctcttttttggttccatatgaactttaaagtatttttttccaattctgtgaagaaagttattggtagcttgatggggatggcattgaatctataaattaccttgggcagtatggccattttcatgacattgattcttcctacccatgagcatgaaatgttcttccatttgtttgtatcctcttttatttcattgagcagtggtttgtagttctccttgaagaggtccttcacatcccttgtaagttggactcccaggtattttattctctttgaagcaattgtgaatgggagttcactcataatttggctctctgtttgtctgttattggtgtataagaacgcttgtggtttttgcacattgattttgtatcctgagactttgctgaagttgtttatcagcttaaggagattttgggctgagatgatggggttttctagacatacaatcatgtcatctgcaaacagggacaatttgacttcctcttttcctaattgaatgccctttatttccttctcctgcctgattgccctggccagaacttccaacactatgttgaataggagtggtgagagagggtagccctgtcttgtgccagttttcaaagggaatgcttccagtttttgcccattcagtatgatattggctgtgggtttgtcatagatagctcttattattttgagatatgtcccatcattacctaatttattgagagtttttagcatgaagagttgttgaattttgtcaaaggccttttctgcatctattgagataatcatgtggcttttgtctttggttctgtttatatgctggattacgtttattgattttcgtatgttgatccagccttccatcccagggatgaagcccacttcatcatggtggataagctttttgatgtgctgctggattcggtttgccagtattttattgaggatttttgcatcaatgttcatcaaggatattggtctaaaattctctttttttgttgtgtctctgccaagctttggtatcaggatgatgctggcctcataaaatgagttagggcagattccctctttttctattgattggaatagtttcagaaggaatggtaccagcttctccttgtatctctggtagaattcggctgtgaatccatctggtcctggactttttttggttggtaagctattaattattgcctcaatttcagagcctgttattggtctattcagagattcaacttcttcctcgtttagtcttgggagggtgtgtgtgtcgaggaatttatctatttcttctagattttctagtttatttgcatagaggtgtttatagtattctctgatggtagtttgtatttctgtgggatcggtggtgatatcccctttaccattttttattgcatctgtttgattcttccctgttttcttctttattagtcttgctagcagtctatcaattttgttgatcttttcaaaaaaccagctcctggattcactgatttgttgaagggctttttgtgtctctatttccttcagttctgctgtgatcttagttatttcttgccttctgctagcttttgaatatgtttgctcttgcttctctagttcttttaattgtgatgttaggttgtcaattttagatctttcctgctttctcttgtgggcatttagtgccataaatttccctctacatactgctttgaatgtgtcccagagattctggtatgttgtgtctttgttctcgttggtttcaaagaacatctttatttctgccttcatttcgttacgtacccagtagtcattcaggagcaggttgttcagtttccatgtagttgagcagttttgtgtgagtttcttaatcctgagttctagtttgattgcactgtggtctgagagacagtttgttataatttctgttcttttacatttgctgaggagtgctttacttccaactatgtggtcaattttggaataagtgtggtgtggcgctgaaaagaatgtatattctgttgattaggggtggagagttctgtagatgtctatctattaggtccacttggtgcagagctgagttcaattcctggatatccttgttaactttctgtctcattgatctgtctaatgttgacagtggggtgttaaagtctcccattattattgtgtgggagtctaagtctctttgtgggtcactaaggacttgctttatgaatttgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttctatttgcttgatagatcttcctccatccctttatttaagcctatgtgtgtctctgcacacgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgtttttgcagtggctggtaccagttgttcctttccatgtttagtgcttccttcaggagctcttttagggcaggcctggtggtgacagaatctctcagtgtttgcttgtctgtaaagtattttatttctccttcacttatgaagcttaggttggctggacatgaaattctgggttgaaaattcttttctttaagaatgttgaatattggctaccactctcttctggcttatagagtttctgccaaaaggtctgctgttagtctgatgggcttccctttgtgggtaacccgacctttctctctggctgcccttaacattttttccttcatttcaactttggtgaatctgataattatgtgtcttggagttgctcttctcgaggagtatctttgtggcgttctctgtatttccttaatttgaatgttggcttgccttgctagattggggaagttctcctggataatatcccgcagagtgttttccaacttggttccattctccccgtcactttcaggtacaccaatcagacgtagatttggtcttttcacataatcccatatttctgggaggctttgtccgtttctctttattcttttttctctaaacttcccttctcacttcaattcattcatttcgctagaccattcttaaaagaagatatacaaatggccaacaaacatgaaaaaatgctcaacatcactaattatcagggaaatgcaaattaaaaccacagtgagacactaccttactctcctgcaagaatggtcataatttaaaaatcaaaaaataatagatgttggcatggatgtggtgtaaagggaacacttttgcactgctggtgggaatgtaaaccagtacaaccactatggaaaacagtatagagactccttaaggaactaaaagtagaactactgtttgatccagcaatcccactactggatatctacccagaggaaaataagtcattgtatgaaaaagacacttgcacacacatgttcacagcaacacaattcgcagttgcaaaaatatggaaccagtccaaatgcccatcaatcaacaagtggacaaagaaaatgtggtaaatatatatatgtatgcatatatatatatatatatatacacacacataaatgtatatacacacactatggaatactactcagccataaaaaggaatgaaatcatggcatttgcagcaaggacacatgatgtattaagtaaaacaaagcagtattataaaaaatttgtctagtatcatcatatttaggttatatatatacatatacacatatataattatataaatatgtattcactattttctattacatatctatttgctatagatattaaacagtaaattgttaaaaagtgtacatctctagaggatggttagattaaggagggacttccatttttaacttgtattatttaaattctatataataaacgtgtttttttttaataagccagcattttaaagacatttctattttgaaggaaaagaaatgaatagggaaacttcatgttttgagaaataaataagagcaagattctgagatgccagagggaggcttctgaaggtcatgggaaatttttcaagagccgatggcatgtagtgtcttggggggttggaggtggcatggaccaggaggccctgctgacttgatcgctatgtatcctactgaaggctcaatatgttgctaaatctacctcatagaaatttgttgtttgttgatctgttttttataatttgtacttactttataaagcaaatgtcactacttagcaaaagcaagagagtttctagatgcttacctcattgagacttttgctaatagaataagctctaggattaatttcagaaagtcttttgaaatgtaacaatttaaggaaatatttattagtgctttattacatgctcattataaaaaaactgtacaaaaagcttaaagtaaagactaaaaggtctcttctccctctcaccccaccatcagttcactagaggaaaaatgaggaatagttgtaataaacaggaagaacttttccaggcattagctatgcgaatccaagcatatataaatttatccagatttaacagagattgttgtgccttaggaactagagagagagcagttttctgccacttatttacggagcactcacatatgccaagtgccatgttagtgagggcagattcaaccaagaacaagggaaattccgcgcctgccatcacagagttggcattctagaaagcaggcagacatgagaccagaaacacaaacaaaggcaaatccgactgctgcaaatcaaaaggaactgctggggcaggtcgcggtggcttacgcctgtaatcccagcactttgggaggccgacgcgggcggatcacgaggttaggagattgagaccatcctggctaatgcggtgaaaccccgtctctactaaaaatacaaattagccgggcgtggtggcaggcgcctgtaatcccagctactcgggaggctgaggcaggagaatggcgtgaacccggacgcagagcttgcagtgagccgagatcgcgccactgcactccagcctgggcgacagagcaagactccatctcaaaaaaaaaaaaaaaagtaactgctgggaggaaagagacagtcctgtgaaagcagataacagagggtcctagagacccctctaaggaggggaagtggaagtccagggaattccagcagagggaatagcaagtgtacaggttctaggggaggaaaggcttggcggggattgaaagccagggtgctgggtatggtgggcatgggggcagggctagaacatgcctggttttcagcgaccttgtaggatttgatttttattctaagtataattaggagccaccaaaggttttaagcaggggagtgatatgatcagatttgtttttaaaagattcctgtgactgctgtttgtaggatgggttggactagaaccagaaagctaatgtggagactaattaagaggccattgcagtatccacacgagatgatagtggcttgggttaagagggcagaaataggaccataccacgatctttttctgcacctgggatacaatgataatggaagtgctggaattcctgagttcagggcatatggaggctctccagtttctgcagagctcgacttcctagaggaatgagcataccagttcagaggctaaatgtatttataccattgctcataggggaaattgctggaaatcaggagaatatctaccagtagagagttgttgaataaattaagatacatctacaccgtagactcttatgtggccattagagtggccccagctgacttggagggatttctataaaggattgttaagaaaagcaagatgaagaatctgtttaaaatttcatttctaaaacaaaccctttatatgtgtgtgtttgtatatgattataggagcatgggaaaaatggaaggcttcatattaagttgttagtatgaactcctgttgggactgaaagtggaagaaaaaaatcaagccaaaaaaaggaaaatttattaaaaaggactaatatgctcacacttatgttattagatatatatgtataagaatattgaaaaatgcaacttttaagaagctggcactgggtttatgtcaattggaactgaggcatacggcctgtttgcagcaggaaattgcctggtggaggatatttttcctcatctctgagtcacagtgagcccccaatgggatctctgctacctcctgtttctttgcctaccaaaactctgtttctttgcctatgcgaattacactttgggaatcacatttgctttctacattcacttctagttaagtaattttacagaaggcaaattataatccccaatctaaccgtgtttgccacagggaaaactttatgcccccctcaaataatctcagtaaactatgactcagcacagtgtctagcaaacagagctcagtgtgtttgctgaatgaacaaatgatgtgctcctttaatatccaacatgatttccccctaaaaactggcacctttttgggtaggaaagaggaaaagcactggagttggggtttgaattgcctcatctagcaagctctgctcaattattttttcccctttaaattatgctctattaaaagagtaaaaaggcagttatagggtggtatgaagtataataaacattttatatgtatcatagaatgagaaagatgctagaagcctatatactatattgaatagcagttgtcactaagtagtagaatttagaggtcattttaatagaatttttttttgttttactgatttgaacttttaactttttttatagttcttatgtttgatgatgataatgatttttaaaaaatttcagttgtgtctaaaatagtacctagcccatagtagacctgtaataaatatttgttgaataaagatggattttttaaaggaaagcagtacatattcattatagaaaataggcaaaaaataagcacaaggggaaaaaaccaatttcgctactcagagataactcaatagtgttgtatagaattttccagttgtttatatttattaaacattcatatgtagtacatagtatttttaaatgggatttttgcaacccctttctctctcttttcttattctctttccccatttttctttctccctgactcttctattacaattatggagaaaagtaactgccaggtggcttagaaatgtgtgtcagcagcaaagtggctcctcttccaggaaggaaacagctcttgggcctgcaatatcactttgtgtgttaatttactcagcagaactttccaggcacctgcacaagggatgcggcctttaggagagcaagttggcatccctctgtgtggaacacagcctaaaactgcgattttctcttgtaggcattttcagctttttactttgtgatgaagtttttaaacttgacatcagagaaagtctctcaggaaaaggtgactgagatgatgaaaaagttctgtgctcagccttgggaggaggtaagtgactaggcacagcagctctaacagcatgagtgccctgtgtcgttgctgatgcagaggatgtgagtctgctctgaaactcctgctggtttgaccaagatccagcaaatgtgttagagaagaccagatggtggactcaggaatgaatttatcagcattccttgataacttgacatccagtggcttaaataagatcttatttttttctcacctaatacaaagtctggcagtaggcagctgctggcatggggtcagcagctctgctctatctcagccattgcttcttcagctctgctgttgtgcctgtttcttcatggacacaagatggtggctgtggcttcaggcatcacagccatgttcagaaaggtcagaaaaggggtcgaaccagatacatctgttcctttttacaggaaagcaaaagctatcccagactcagcagtcttccccttatatctcaatggccaggattgactgggaaaaccaggtgcagaattttgtgaccagcttagagcttagacctataatgagccactgcctcgagctgggcacattgtggcccactctcctccttcagtccccaaatcagagttctgttagcaagaaagcaggcaatttgcagagtctgacacagacacaattgtggtaaaatcctctccatttcccaggtccaagatatctcctacttattcataaacttgaagcacaatttttttcttatcagaggcactgagccattcaacatccagtgccacaagatgaaaatccagggatgagaggtatggaatccactccgattataaaagacatagctcaaaacagcagctgtacttaagttgacagttgcaaaagtgaatggtgttttcattcttaagaaatactattaattaaaaatagatgcttatccctgactgcactgacaagggggaagaaaggctgagcaagagcctggaagcttgccattctctccaggtattttgtctagaacatgaaagaaatgtggtcagggccttcatcaagagttgctcaaatatgtctcagcattttacaaaatgcttagcggtggttttttgcatctggcggtgatctgtggaggaagataagcatgttagagtggaggcaatttgagaccaggcctacatgtggctgctgaggaagcagatttaggctgctctttgaaaaaaaattacttctggtttagattaaaagttctcatcctggctaacatggtgaaaccccgtctctactaaaaatacaaaaaaaattagccgggcatggtggtgggcacctgtagtcccagctacttgggaggctgaagcaggagaatggcatgaacccaggaggcggagcttgcagtgagctgagattgtgccactgcactccagcctgggtgacagagcaggactccatctcaaaaattaaaaaaaaaaaaaaagttctgtcaggtttcctctcttatccacatctcatgttttacttcataagactatgttaggctgggaatgcttatatttagacctgtagttctgctcaggtaagtcatgtggggagttgttcagaggccctggaagtaagctaagaagggcctgcatttgggagaattcctgaagcatttggggaaggggttgcagggttagacccctgtcttcacccagagcctacagcattgaggtggatgttatgacccagggttcactttcccaagctgcatcgtccacccaggtagaaagcatagttttgtcaagtacattgttagaaggtgactctttcttctttccctcctaacttcatcatggactgctactccagtatggcttgtgtttgggaatgttcctcctaaacacctttggtagagagataattaacaatgtttaagcatgtactatgtgttgacagtggtggacatttgcttgctgtgctttatgcatatcctatcatgctgccttcccctgctttggcaagggaaataaaatgcaaaccacacctgctgacactcagtcaggtacctgaagccattgggtctctgaagtggagggaccaggagagtgagtggaagggagactccatggttgtcttctggcagcttcattagagggctagtagaatctttcagcagccagaacacagccaattttctactctgaaaatctggtcatccaagatctggtcagcccaagtgaacaatgtgatcagattctatgtgtactgatgaccagttatatttcagtgtactctggatcctcacattcagcctcatgaatatttagcctttctagggaaaggcatcccattcttgaagatccatcaatgcccctttatgtggagggcagaaagaggatatccatgaagagaaaagaacctcatcatgttccactgccctgggaatagaaaggagagaagagagaggggaaggtgggagagagaggagagaggagagtagacttcccctcccaatttggagagcacatagtgatccacccacaggcatgagcatgatcaattctggattgatgaagaaggtggatgcctttttggcttctatatttttggctactatcataaccttcaggaggccagactgcatagccaatgtacagatttccagaaggaggaggggaataggagtattaaagaattcagggaaattaggccaaaatggcatctcccagccccccacaagggataggccagccttcaaggacctacaggggctcagcactttcaagttggacctaagtagattcttgggattttgtgtcccataggcatccttcaattgacaggcccaagactacttcaataggggaggaggtcttttcacaaagggaaagcagaatgcagtgactgaaaggaaggggtaggaacctggacaggcaatgccaactgatgtccacaccaaggtctcaagaggatgtcacatgcagaggaatcaatcaaaggataatttccagaactgtgctgaaaagacaagctccaagctgggtcattctgagaatttcatcagagcaagacaaggcagtctagttatggacttatccttccagaaactggggacaggcaagaaccaagtgagaaacagaccccagccagcggttaggatttgcatatgggttaggacccacggaagggagagaaatctgggaaaagaggggtgtggtttaggcatcaaggagatactacatataaaacatctggcatagttccagatggtacatgatgcatgcataacaaatgttctctctctgccgagggtatccaggagggaatgcctatctgaagggctgaggaatggggcagcagacagaagtccaggctgaactagagaggtcctggcctgttgtcctcaaattgagggcaggagagttgcagagcaggctgtgggtatctgggtgtatattcacaacagctaggctaggtaagggcaagggatggcaagcagctcttaatatttttagtagggagtaggatgagtaaacataggaaggactcaaggaaacaaccactttgcatgactcagatgcaaaaaaagacattaagacagaagatagaaggtgagatgttggcagtgctagcagtcctcagcaaaatgctgcctaaactgtgtccacagctgtgtttctcaaactttactgtgcacgtgaatcacctgggaatcatattgggatgcagattctgaattggtagttttaaggtgaggactaaccagctcccaagtgatgctgatgctgccagtccagggactaaagtgagtggtaaggctttttatggctgtgggccaaaggctctggtcaagagcatatagaaaactcagattaaacaaagtctagggcatgaacagaggtactgaaatttagtgtttcagaacctactagaccacaggaactacttttttcctggaggacctgttattatctcatagaagcctgtgcaggaaaagcttccttaagagaccctaaactataaaaccctgctcccactgaaggagtgcagcaccacccccaaaaccctctggaagaggccaaccttcaggtgcactggagctggggctttcccctctcttcatcagggctagtagagaaaaagagggccacagagaggtgcctatcatacgagtatgatctccccctcacttcacttctagataaaaacatcttacgctggagtaaaggagaagtacctgagtgaatactgcttttctggtacctacattctctccctccttctgcaaggctatcatttcacagctgattcctgggagcacatccatttcattggcaaggtaatttgggggcctgttgggctggggggaggttggggttcggtggtagtgactgaagcagtttggggcttgaaaaaggggggagtcagcatggtgtagctttggcttgatgtcctgttctgccattctgcttcaaaccctggcattctgtgtcaagccctcctgggtctgttggcccactgtgagcatcctcgctaaggacagctacttgcattttcagttgcaccttcccacataacagtgactaattccttacaaaacaaaacacaaaacgagatatattaaagtaacagcatttcagcagctacagtgactctgtgtgctgacttcagcagccctctgaaaggccccttccataagctgggaaagtatgatcatggtttcatcatccttgttggttattacttcaaggttgaccaatctgaaagctctgtgtgaagaaggggactgagtggctgtgaatgatgagaccgttgtttagaagccaggcttagcctgagtccggaagaagcaacctcaatgctgtgctttaccatagcaccacctgcaggtatccaggaatagagaacccagctgagcgactcatgcttgaccaaaaatacccagagcagtgtgtctctacctttttaagcccatgctcactagtggggaaaacattttaccccctgtattaaatatggtgatttcaagcaaaacaaagcattgagacagagggctgtagcaggcctgaggataacagtgtccttacactcttgtcagtgctgatcttgctaattcaaacttaaatcttttccttgttataatattccagacttcctttaattccagcagtttattttgtttgaaagattatacctatgtcaaatttaggactgacacacgaggtagtcatgatgtatgtgtgtgtatatactttttttttaagagacatggtctcacgctgtcacccaggctggagtgcagtggtatgatcacagctcactgaagcctcaaactcctgggattaaatgatcctccccacccaggctcccaaatagctgagactacagacatgttccaccgtgcccagctaattttattttttagagagacagggtctcactatgttgcccaggctagtctcaaactcctggcctcaagtgatcctccctccttggcctcccaaagtgctgagattacaggcatgagccactgtgcccagccagtgatttatattgtttgaactcttccaatgcatgatccaataattctaagccctaggtgataactcttctaactcctccaaccacaaacagactttccccactgtttgcagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctag

SEQ ID NO: 36935 - DNA, 20239 bp, Homo sapiens
cgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccaggtaggatgggcacctcgggaaacgtaaagatggcctgaacgaccctccgaaggcaggggctcagggttttttaagtctctgtggcatctgcagtgtacattcactccacacttactccttgagtgaatgaatgactgaaggagaactaaagaatggaagtatctgggctgagcctggaatatctagtacatgcattcttttagaaacatgggtgtgtctcagcagcaggtttgagggaacctgcaggaacctagaaatcagaacactgtgttcttgttctgcagagggttaggtgtaaatcactcacctctggctcttccactgcaggttagagttgaggcttttatgctctgacattcagctcatcctaaatgaatttttaactcattatctgatctcaaagaggtgaattattttgagtgcaggtgttaacagggaccagataataccaggtccctgggaagaagtactctaagaagttctctctctctctctctctctccccaccctccctctctccccactccctctccctccccccttcctctccctctccctttctctctctccccctccctctcttctctctctctctccccgctccctcttcctccccccttcctctccctctccctttctctcccgcccttcctccttccttccgtccttttctctccccctccctctttcctcccccccccccccccccgccttctctctctctctctctctctctctctctctctcattcagaagtgtggttcatcaaccctgactggtgggtgagagtggttagaattaaatgctgattatttctaaggtcctttggtaacctggttgaaactacctctcagtaaactttcttcgtgaacctacttaaccgcagctttacagaactcagtgtaacaactgctttacattctagacaggcagcctggtggagtgaagttttgtggactcagcattagaaggttaggggatggggctcttttcccaggtctgccttgaactagctctgtgactttggcaagtgctttctcttctctgggcttcttcatttccttagtctgtcgcaggtctctgattgactgtgcccttggtaccctgccctccccgccttcctgtgcactttgtaacctatacagctcggcacatggaggaaactccttattgtccttacttgcctttgcagacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtaagaaatgtctgttccacactgaaacttcttttaagtcctcttttctatcccaagaatttaagagaagagtggttgagcaaagaaaaaaaataacagcttttgttcatttacttattcattcagcaaatagtcgctgagttccttctatttgcaaagcactgtgctggatgatttgaggggatttgaaactgcagatggctcagaccatggctccaaggagctcaccttctagtggggagaagaaacagcataaagtgttgtatgtgttccttgctgaagatatgcaagagagtccagccatttgagggtctgagaatcttcaagaaaggtgatggatggccctttttgagctggacctcaaagaatagataggagggagatgaccatgacaccatgttccagccctacaaactgttcaactctggatcccactacgtgacggaccagggagcagcctcaggaaacactcgaatcaagtctcccagtctgaagtaataaccccgttatgcataaactgcctggaacatcagaggctctgtcatccaggaaaggaacaccagctgtagctcccttggggtctctcctcaaccttaagggtagccaggactgcttgccgtttccccacacacatcaggctctctcagacctctttgtctctactcgtgtattccctctgcttggctgcttggactggtattttcccctgtgccacctgcaaattcctacccatcatctagggctcaattcgtgtctaccaccccagcccctcaggctcctacaggacacacaaaccaccattaaataatttatcttgcgacactagcattattcgcgagcttctcaagggcaaaaagttcctcttatttgtgtctgtatatccagttcctagcacagtgcttggcagaaagaaggtacttagaatgaatgcttactgaatgaatgaatgaatgagtgagtgaacaaacaaatgcagtcaagaacttgagatggttgtattctaactgccatgagttaatttaccagtgatatctttggttctaggtgtcagtaattaacactgtggatacctcccatgaggacatgattgtaagtattaatatcaccctccctggaggggtgtggacatgggcatttttgtgggagggaagcaatttggggttttcattacccctttctgttgatcattcatggatccagggtggctttgcagtggttgcctatcagcctgtaatctcggggtatggcaggctccctagcagtgccctctgagttgtcaggactgtggcagtctaatcactctctgctgggaggaacctgggaataatttgtagttctaggctgtcagtcttccagccaatacaataacctgctctcggatgaaggctgagtgggtacggaggcttgacaatagtcttcccacctgtcttcctcctgctgtcacttcttagccccactggaaaggggggtgaaaagaagagagtgtagaaagatgactcaatacaaaggcagagggcagccacagtgaaagccccaggcagagcccagtcaaaccaccaagacaataggccagacaaggccctttgaaccagaagtccacactcagggcatttcctgagaggtaaacacaaggctcagtataagaggacagggctgcaggagaaggtccagaggttaaagtctaccgcaggaaaaacacagactctgcttcattcagggccaagcagcctttgagcaagacccaggacagctggctgacagtgtttcatgtcagggttcttgccctcacaacctgtccaccaacagttgcttttgggtttctgagaggttgtctggtcccagagttgtatatgttctctggattcagtcatgagtggtctagctgtaagaccacacctccttggagatagcatggaatcatgggcaggaagacccagtctgagactccctagccaatatcttaacttttctgagccagcctcaatttacttacgggaaaaataatggatatgctacctactcgtatgagtttggtttgagaactagatgaggccaagtagtaatgacaaacatttgcatgctcactgagtgtcaggccccatgctaagtacttttctttttttttttttttttttttgagatggagtttcgctcttgtagcccaggctggcatgcagtggcgtgatctcagctcaccgcaacctacgcctcccgggttcaagtaattctcctgccccagactcccgagtagctgggattacaggcgtgcgccaccactcccagctaattttgtatttttagtagaggcaagttttctccatgttggtcaggctagtctcgaactcccgacctcaggtgatccgcccgcctcagcttcccaaagtgctgggattacaggcgtgagttttcattcaatatcttgtttaaccttcataacaactgttgagacagatgctatctttagccttatttaaagataagggaactaaggcccataggatgttggtaaataataaagataaggaaactgaagctcaaggagatgaagtgttttcaaagtttgcacagcaggtaaactaaggagataggatttagatctgaaaggtactatgtcctgcctccttccactgagaagcatgagaagtgcttcagaaacactcctctactgcctgccctccaagaaaccaaggcctgatacagtggagggagttcccaaagaaaaatcaggatgtgttccttgcgtagggaggtgagaattcccatctgagccagacagaatgagtgcctttgaatgggcataattgcccctggtggccatgggagtgcagctgatagtcctgaaactcccagggtgggacagctggggaaagggacatccattggaataggcagggccagcaagcagaagggaccagggtgttcagtggtgcaggaggcatggtgcctcagagaccatcaccctgcggacaaggatctgcaggtaggggccaggcctagttctgcatgctcagtcagcatcaaggaattcggttcacaagtggtgagagcagcgacacttaaggcattgtgttccttgggtggaaagtctgggaagctctgggcacactactagggaaaaggtcgagcagaagccccaaaacaaaggtccacaaaggatccagggccagggctggaaagagcccaaatatctgaatggaaccctgtgtgcaggccagagctgcatcacagaagacctgactggggactccaggcagtcagaggcccactcctttggcctgctcccatgcattagcatcaggtgctagggctgagctgaacccaggggtattcccctttagcccacagagcctaagaactgaatagggcctgagaggatggaggaagaagagggcagctaggccaactttttttctcccatacccaccctgcggaacaggaatggaagagcccttccctgaggtatgtaaagggtctgtgacaccagctgggcatggcttgctttgtccatttcagagagacactgcccataggtgaagtgagaatgtccacatgctagcttcctgcctgagggtgatgatactttgagatcagattgatttcagggagattctggtccaaactagactctgtgtagtgacagccctcaccccacccacccacccacccagcctgcaggcttcccgagctgtcctccctttgcagcacgacgcccagatggactactatggcacccgcctggcaacctgctcatcagacaggtccgtcaaaatctttgatgtgcgcaatggagggcagatccttatcgccgacctcagggggtaagtgctggcgagcccagggaagggctccaggaatggtgtgggttctcaggccctgcttcaagcgtgggagcaaagcatgggagcccagattcagagcaaccccaaagcacatttagcggagaggacgctgggatcccagccagcctggctgtcctcagcggacgtccccagggatgatgctgttaagggcacaggtggatacaggtgtgaatctcagctctgccactttatgtgtacccaccagaagaccttgggcaagtgactcagtttctctctcagagccttcatctgctcatcctcaaaattgggccaatgctacctcctatccagctagtgtatgcaaggccctgacacagggcccaggacacagtaagtctttagtgcaggcagctactgctacttttaaaagtggtaaacagtaccatttcgttcaagtttagccagtatgacctaaagtgtcacaaaagcatcaccgtaagaataatgtaagaatgctatcattttataaatcccattgttctgcctatatgcccgtggcacgtgttcagtgattatttacaaatgtttgacctgccctgctccctactgagattcttgaggaagtcctggctcatttttatggccacatctctactgctttccctcagctcactgcctttcacgtatttgtgggtttgcctgggtgccgtggatctccaagggttctgtgaatagagttcaggggttgatgaattgggacagggggaaaaaaatgcattttcagtgactctgatatttagcatttccttcaattatggatgtaggccagaaacttcagtagtatttgtagtgcctgtcactttgtcaccagtagaattcacagatattgtcatcacacatcacggttacttagctacctcaaaataccacttatgctcatcacaactttgaaattacagtggttattagacctgccgctagggtttgttgcttgaagtgttaacaaagaagtacatgcatcactatctcataaattgctttataatattttgataacaggctgggcaaggtggctcacgcctgtaatccttaacactttgggaggctgaggtgggaggatggcctgagcctaggagtttgaggctgcagtgagccacgatggtgccactgcactgcagcctggatgacagggtgaaacccttctcaaaaaaaaaaagttgattactgtataatttataattgaattttctttataagcctagttctgtgtgttttgtacattagtctgatgagggtccataaccttccccagaatgcacagaaaagattaagagccatgacaggtgggtgctcagcatgtgtttgttcactgaattaaaaagcataaactaagtcagtgtccatttggggaaatgggcctagaagctcccctctgtctgagtgtcaaatgatcaagtgactgaggagccaaatcaagcttctctatgcaggagccccccaggcaggcagagagctgctgcagtgcagcgtgttggccaaggcagttatgtttgctgtgactctgtcctttctgctgtttttcttacattcaaaggatgtgaaatattggagggataaaaaaaattcccaccccattcttttttccccttagtaaaaactgtgctagttgttggaagattgagtctactcagtttcattagcagcagctttgtagggactgggaatgtcctgttgtcccagccagagggaggaggagacttgagtgtgtgcagcccacggtgaaggagtaaaccaggagcagcactaatagctaatgggtattgagtggcttttttctttccttctaccaagcattgttccaaactttatgaaagaattcttattgatgtctccattttcaggtaaagagacaaagatatccttgcctaaagtcaagagctagtgaatgggagaatgggtctggtctcctaaccactaactctaccatgctactctacctcttgagtgctaaggtgcaaaaccttccctgggccagagaaatggtcaccgtacaaagcctggcacagagcatgtgctcagatagcacctgttatcaggtgaatggataaagatcagaagagaagggaaagacatgcctttcgaacaaattaaaagagtagtggaaaacatcaaaatgaaaccaataatgcctcctcaggaagctgaccgtcgggaaggatgaatagcaattcagtctacaaatatttcctgaacacttctggctggaaaccttggaccaattaatgactatgctgtagacagcacatacagacagtgctggctgcagtctgggcaagtgaggctcctgcctggccaggacaggaaggctgacccagaggctcaactctctctcaaaggctctgtgaccttaggttgcttaacctcttaggacctcaggctcctcactgtccactgagcaccccttttgcaatggcattgtatagttctccctttgaagttcttaagcaattctgccctgatatatcgtctcagggagccatttagttctgtccaaagtagtgcctgcagaggcactgtgggttcctctggcctatctctccctttgtagtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcaggtatgctgagcttggcagcagagcgggcaaggggaccactgggtaaaaaaggactctgtcccggctggagccctggctccctgcccctcgtggtgcctcttgtctgtctcttgagctttggttggcttttctgctactctgtcctcagctgagtaaggccctaagacctaaagccagtccaaagcaaataagaaaagacaggtgagtttctcttcaggattattcattgcaaggactacccttcattctcagattgttttcctacccacttttttgttagatagactgtaggttatgaaatcgtggtattagtaggtgatggggtttttttgtgtcctcagttgaccaagttacagcttcccccggtgactcctacagttgtttgttgtagacatttagtaaaacagtaaatctgtggaaggcgggacctggggccgcggtctccctgctttgctcactgcactctccctcttcccgcagtgaactcggtgtgctgggccccccatgactacggcctgatcctggcctgtgggagctcggatggggccatctccctgctgacttacaccggggaaggccaatgggaagtaaagaagatcaacaacgctcacaccgtgagtccatcccctgcctttcgtgcagtgagagcgcctgccttgccccgtgtctgctgcagcctccctagagggtggcacgggagggtccccgctggacagtgggccggggagtggtcagctgaccagacatgattgctctagagcagctttgagcctctctgccctgaagccagaccaggcagggcttggcactgcttccttgttgtgtgctcccaagcaggggagggctggtgcagcagcagcctgctcactgccaccttagctatggttgcctccaggtgacatgccctgcagtagtcattgggaccctgtagaatggagtggtgttattaaaacttttaaaaagtatgtgagctatgcatacatttaagaaagattaatataaacaaggtcattctttacccaacttttggtgaatcagcgagtgacagtggtcgtgatgttggtggttcaatcaaggaataaatgtttgcaaagcgaacatcaatgtcctacctcctaccaccacacagttcaaaaaccaacaataaccaatgtggggggctcatatgactaatgccacatcgtttgctgtcatgcatctgtatgattattggatattttatgagtttaattctacaataatttgtatctattctttttctaatctactcattccagttcagggtcacaggtggttggagcctgtcctggcagcttagggcatgaggcagaagccagccctggacaggataccattccaccagaggagcactcacacacacccccacactcacactgggacaatgcagacgtaccattgaagtgaacatgcacatctttattgtgtgaaaggaaaccagagtaccaggagagagcccacgcagacacagggagaacacacagactccacacaggcaggggcccccgctgggagttgtttttttttttttaatcttgtcagcattataatgaaatgaaattgaggatcagttgtacatagaatgagacaatctgtggtcttttgtgactggcttctcctacttactataatgagttcaagtttcatccatatcatagcgtgtatcagcactccattcctttttatggctggataatactccattgtgaatatagacattttgtttatccattcatcagatgatggatgttctcggccttatgaataatgctgctatgaacatttgcagataagtttttgcatgaacatatgtttttaattctcttgggtctatacctaggtgtgaaattgctgagtcatatggtaattctgtgtttaactttttgaggaattgctaaactgttttgcaaagtaactgtacccttttacattcccatcagcagtgtatgagggttctaatttctccacatcctcactaacatatgtctgtcattttggttacagctgtcctagtgaatgtgaggtggtatcttattgtgattttttgggtttgttttgttctgtttttttgagacggaggcttgctctgtcacccaggctggagtgcagtgacatgatctcggctcactgcaacccccgcctcccaggttcaagcaattctcatgcctcagcctcttgagcagctggaattacaggcacacgccacaacacccggctaatttttgtatttgtagtagagacagggtttcaccattttgcccaggttggtctcaaactcctggcctcaagtgatccgcccacctcagcctcccaaagtgctgggattacaggtgtaagccaccacacccggcccttattgtgatttttatttgcattttgctaatcaaagatgatggtgagcatcttctgggggcctttggagaaatgaccaggaggggtttgcactctgtaacaccgagtgagtggaagcggcccacaataagaaaggctgaaggggcgggaagaaatctgagctctgtgatcctccagagcaagcctctgggacagggcccctcaggaggaagaactgcaggaaatgaaatcacagttgagctggatagggacacaggaaaggaaggatgagatgtagaccaatgtggggaagaggaacaaagacaggaactcctgaaagccatctcccacgttttttaacaccacacagaaacaagggagagttctgagcttagactttcctgagcctttcttatcaggaaaactcatctcacctaaaaataacagaaaagtatttgaagtgaaattgcatacagttgttatataagaaacaagaatatgcaaaataacctccctgcggacaatgagagcacattagaaagacatgcccacataaccgagccaagctgtaacctgctatttcaaatcaagccaggtgacattctaacaatacaaaacaagagagaatagtgtaaatcaactttttaaaaatcagaaataaggtgacagaactcaggaaagaattagaattaaaaatcatttcagaagtaaagaaagactaagacgaaatgcaagtgtcgatgaacacagcagatcctgcctgaaaaggataaacagtgtgaaaaaggaaacatttcaagagcaaaaaaatgaagaggtaaaaaggttttgaccaaaagtaaagacaggcagaaaggtcagacatacgaataccaggagtccctggaaaggaaaacagaataccaaaaagtaatccagaaaactttcttaaaattaaaaaacaaagatttgaaacttgagattgagagatcataccccacacttaacaatatcagccgggcgcagtggctcagcctgtaatcccagcactttgggatgctgaggtgggcggatcacctgaagtcaggagtttaagaccagcctgaccaacatggcgaaaccccgtctctactaaaaatacaaaaattagccagacgtggtggcgcacacctgtaatctcagctactcggaaggctgaggcaagagaattgcttgaacccgggagtcagaggttgcagagagccaagatcacgccattataatccagcctgggcgacaaagcaagacttgtctcaaaaaaaaaaaaaaaaaaaaaaatcaaggccaggcgtgatggctcagcctgtaatcctagcactttgggagatcgaggtgaactcctgtttgaggccaggagttcaagaccaacctggccaacatagtgagaccccgtctctaaaaaaaaaaaaaaaaaaaaaaattcaactcagcatcaccaacaaaaagatataattctagtaaaattattagactttaaagaaaattttggggggttctagagaaaaggaaccttgtgacttaaaggggaaagacaattagattattgtcagactcttcaatagtaaggattggtgcagaagaaaaaagaataacatgtttaaaatactccaggaaagaaagtgtgagccaaggatttataaccaggaaaattgactttgaagttcacacaaagacttatacacaaaaggttatagcagctttaatagccaaaaactggaaatagtccacatgtccatcaacaggtaaatgataagttgtgatatatccatactttggaaatactgcgagcaataaaaagaaatgactgcaataaaaagaaatgacttaacaaaataagatgaagaataaatttcaaaataattatgctgagtgaaaaaaagaagaaaaaggacacactgtgattccactgctgtaatatctaggaaatgcagctgagcaggcccatggtcaccacgattgggggctgcaggatggggagatggattaccaggggatccgaggaaacttttgggaatgatgggcatgttccttatcttgattgaggtgatgtgatgatcctacaggatatatttttgtcaaaattcaccaaatcatgcacttgatatgcagtttatgtcaattatactatatcaaagctgtttttaaaattagcttttgagtgtaaaggatatgaactattatcaatatgcaagaattcagggactattgtttctaggagcccttcctgagaaatctactagaggatacaagtcacacaactaaaatgactacaaagacttcagcataaatatatagttacttgtagagaactaagacgaaatgagggttaaaaggctgggcccagggcaggcacagtggctcacacctgtaatcccagcactttgggaggctgaggcaggcggatcacctgagctcaggagttcaagaccagcctggccaacatggcaaagccccatgatgtggtttggctgtgtccccacccaaatctcattttgaatgcccatgtgttgtagggggtaaccagtgggagttgagtcatgggaggaggtcttttccatgctgttctcttgatagtgaataagtctcacaagatctgatggttttatgaaggggagttcacctgcacaggctctctctccctttttgctgccatccatgtgagatgtcacttgctcctcccttgccttctgccatgattgtgaggcctccccagctacatggagctgtaagtccattaaacctctcttttttttgtaaactgcccagtctcaggtatgtctttatcagcagcgtgaaaatggactaacacaccccgacgctactaaaaatacaaaaattagccaggcgtggtggcacacacctgcagtcccagctacacgggaggctgaggcaggagaatcacttgaacctgggaggtggaggttgcagtgagtcaaaatcgcgcctctgcactccatcctgggcaacagagccagactctgtctcaaaaaaaaaaaaaaggcagtggctcacacctataatcccagtactttgggagtctgaggtgggaggatcacttgagcctacgaagtttgaggctgcagtgaaccatgatcttaccagcctgcactctagcctgggtgacagtgagaccctgtctcaatttttaaaaaaaaaaattgttaataataaataaagaggagaatcagtcatctttggaaagtgatagaaccagttcagaaagaatcaagcgtttatccagcctttcctttttgaccttgtattagtctgttttctcgctgctggcaaagacatacccaagactgagcaatttacaaaggaaagaggatggagaactcacagttccacgtagctggggaaacctcacagtcatggcagaaggcaaggaggaacaagtcacagcttacgtggatggcagcaggcaaaagagagagcttgtgcagaaaaactcccatttttaaaatcgtcagatctagcgagacttattcactatcatgagaacagcatgggaaagacttgcccctgtgatacaattacctcctaccaggtccctcccacaacacgtgggaattcaagatgagatttgagtagggacacagccaaaccatatcagacctctatccctgggtaactgaatagttaatgagaagaagtgtccctatctggagcattccatggaataaatgacaaagaaaggatggaattagagtatcaccattttacaagccccagtgaattaagagaggcctgagttattgacagctgttaatataagagacaatctaacgtgcctcctgatgagagaacgcaccagctctagtcttgccaaagggatcacacctgagtctgtccagtcttggctccagctgacagttttcaggaattcagaggaacatattgaactgcatatgaagcagcaaaacccagaccgagagactaggctctcttcagcagaaaaattgtaaggaaaaaaatcagaggaggaatctgcaaagtaggagatgtaaaaaacatccaaaaaaatgtttaatggacaagactaaactatagtatctaggggtgcacatttgggtgataaaatggggggaaaatgggttagaagttagggcagtggttacttatagtggaagagggagctgtgattaggaagggcataatgacagggcttttcaggcaggtggcagaattcttgtttcttgatctattactttataataaaagatttttcttaaaaaaaagctccaatgtaccattctttcatgtgtttagaaaatgtcctgtttcttaaacttgtgggagttcttaatttctacttttagcgcacactgcagaaaaatgcacacactgttgggatccttgagggagaattctgagcagtggaccccatgatgagtgcttcatgtcagccttcacacacactccagtcctgagaagcggaggggagagggacagcaggcttgggtctgcagaagcagtgttctcttgcaaggcagagtcaccatgtgtcccatctttacagattggctgcaatgccgtcagctgggcccctgctgttgtacctggaagcctcatagaccacccatcggggcagaaacccaattacatcaagaggtttgcatcaggtggctgtgacaacctcatcaagctgtggaagtaagtagggatgtgtggccttctctttgaggggacacttctaccctttaccctactcaccatgactcagccacactcacaagaaacaaggtcacctttctttctccctcctgccagtaaaatactgttttcaatctgttggaggacatccttgaaaaacaacacaacacctgttcacctaattcccaactgttggagctgactctttggctgtggaagcagagcattttctggagggttttttttacagctggggtgaagggaataaaatgccacaaactccatgaatgaaagaagaaagatggaatcgcttctccaccccaggcagagcctgttgggttggggaggagttgaggtgtgggaacggccccctgctgattctctttctgtccccactgttagggaggaggaggacggccagtggaaggaggagcagaagctagaagcgcacagtgactgggttcgagatgtggcctgggccccctccatcggcctgcccaccagcaccatcgccagctgctcccaggtcagcccagggccatgagtatcccttgtcatttagtctcgagtcaggcccatcagctcttagtctccttagcagaaagtcctctgggaaggtaaagggagagcaacaggcacctttggcccagagcacagggagtcaggtcattgtgtggggaagtcttggtcagaagccacaagtggcctgcctccactgagatgagacagctacaacagaaccggcaccaagaaggaggcggattcgggatgaattttcccttctgacccatgtgagactagggcgccgaggtgcccaggtgcagttccaagtgttcccaagcaacgatggggttggatgggaattatacgcttagctaccaagccacccttcccagacagcaaggacggccaagggtgagccttcagttatacaccaccaccctagagggagccagctaggcctttcacatcatgggaacctgtttggtttggttctaaacttgggatttttgtgcttttttacttgtgccttctcattcttggagcttggtttttggagagctctgcccattcagttgagaaggtatagacggccagtggaagtgacttggcaggcatgaggaaaaccccagagaaaatctgagttagcaatgcagacagagtccacctccgaaacccggatgagaaaaggaatccgggagactcttaaccagtgtgaagagacagaaacaaagctgtggacgccccagaggtcctcggctcccctttgaatcccccaccctgttcctgcagagaggtgccgggtggctctagactgggaggacatcacatcacaaacgcaggagtcttgactccacctcctgactctatcctgtttcttcctaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtacatacccattccccgtggcatggtggacacagcctgttggtcttcaccccgcccactagagagggcacttgacattcccatctgactgcaggctgggcaggagccttagccaggactgcgttttgagtgtgcctcttagttacatcattaatgtcacagcccctgaggtagtattaacacgtccccctttcacagatgaggaaagaagctgacagaggcgatttgacttgcatgggggtcccaaaactatgaggtggcagagccagtcaggcccatcaccctactaagcatttggtcacctcatggtgatgttcagttagctgtgccaaaaaggcaagtgtataagaacccataaacagaagaagattggggatattttttgtccataacactgaaaaggctttttaaaaacctttagagtttatgaatacttgttatgctggtaagaggcaggtacacagtgggtgcactggaagagtttgcattttgcagctgaaagagttctggagaccagctgctcagggacccaaatgtacttcacacaactggactgtgcagttaaaagtggccaaggtcattttatgtgacgtgtattttacaattagaaggaaaaaagctacccgcagaaaggaagcagtaacaagccatagccatctgcccagctgaattcccctataagacagaggatctctaacgccgcagggtcagttccacgtggagtggctgtgctgcgttttcaggcacatctgctctgcgcctgaagtgcgagttggtctggatcctgccagcccttgctgcttctctcccttgcctatgttggtcttttactgtttcccagtggccactttggctccatgtcttacctttcatttgtgtggctcacggcacaaccaacacaggcaaggcagagaagcagctggtctccagaactcttttcagctgcaaaattgaaactctgtacccattaaataactcccttccccattgcccctccccagccctggcagccacccttctcctttctgtctatgtgaatgtgactgctctagcgacctatctaagtggaatcatacagtatttgtccttttgcgactatgtcactagcagtatgcccttaaggttcctccatgctgtacgtagcatgtgtcagaattccttcctttgtaaagctaagtagtgttgcattgtatagacagcccacaccctgtttctacacttattcctccaccaaagggcacctgggctgctgccacctcttagctattgcgaatagtgtggctgtgaacatgggtgtgcagatcttgagagcctctgcaggcggcttttctggccgagggtccctttcatctacagtggtcccagaaagatctagcaggccccctctcaaagccatatttctagtgagtgccagagtcaggaccagaacccaggttgatggcactcagggcagaccaagggacccagattgcctcaagcaggcccccagtgacttttttacaaggctgtaagcaagtgcctggctgtgcacgcagtgttgtggggcccgtcactgtgcatttaggcttcttgctcttctttacaagcctgtttcctttcgctgtctccatagcacccttacctaaaggacttagtatgttttcaatcccagagcattctgcagtgtgttgagtgaatagtttgtccctaaagcaagagttcttaaaatcaaaatcgttattttcatttttaatcaaactaatatatgtacataggtttagattgtttttgttttttgttttgttttttgagatcgagtctcgctctgtcgtccaggctggagtgcagtggcgcagtctcggctcactgcaacctccgcctcctgggttcaagcgattctcctgcctcagcctccccagtagctgggagattacaggtggctgctagtttttttgtgtgtatttttagtagagatgagatggggtttcaccagttcaggctggtcgcgaactcctggcctcaggtgatccacccatctcagcctcccaaagtgctgagattacaggcgtgagccaccatgcccgacctagactgattttttttaatgcagcctcctaattttctctccaggggcaaaccttttcagctcttagctatttcttatacagtttacttcagtgtagaaacaacatattgaactgttaccttcctctaccacagtagttttcaaactgcagtgttgttaaacctgttaaaacagattgccagccccacccccagagcttcctaatcagttgttccaggccccaagaatctgcagttgtagcaagctcccaggtgaccgatgctctgctctggtctggggaccacactttgcgaaccctgctccccgccaccccatatcctctcgctgtagctctgtcacagtttgctgaaaacagtatcctgtgttgacatcatcatccacagctgctgttattgttactcctttttttctgtgagtttttattcctggactctcattttggtgagatttcagtggaggagggacatgctctgttcacccacaagcctctgggcagtggttcttgatgaggatgaggctcatatttaggggacagcagagggaagggcacagacccgtgataatctgcttgtgcactgactcgcaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttat

SEQ ID NO: 36936 - DNA, 6053 bp, Homo sapiens; identical to SEQ ID NO: 35600

SEQ ID NO: 36937 - DNA, 30256 bp, Homo sapiens
atggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggtgggcgccccgaccccgccagccctggccccgacccacccagcctgctgcccgggccctgcacctgaggccctgcacccctctgtccccgagacccccgcacccctccatccccgagccctgcacccctctgtccccgggacccctgcacccctgcatcctcaggctccgaacccaactcggcctgcaccccggggcctgcacctgaggccctgcacccctctgtccctgggacccctgcacccctccggtcctgaaaccgacccggcctgcaccccggggcctgcacccttccatccctagactccacccagttccctgggctctgcacccctctgtccctgcctctgcacctctctgtccccagaccccaccaggcctgcactctgggcctctgcacccctccatccccaggcccccctggatcctccacctctggcttgcgcccccagcctgttccccgggatcccaggccctgtacccctgggacccctgctctcctccgtccctggacccacccagcctgcactccggtaccctccgttcctgggaccctccaactcggcctgcacttggagcccctgggcccctccatcctcaaaccccacccagcccgcaccccagaaccctgaataccccatcctcagggccctccaccccccgcctgcaccctaggaccctccattcttccatccccaggacgctccatccctggacctcacccctccctgcaccccaggtccccagacacctctgcccccagatccctgggcccctccacctccggctggaacccctgcctacaccccaggcccctccatccctggaccccacctggcctgcatccctgggtcccctccatgccctggccctgcacccccacccaccacccctgggactcctgtgaccctccaaccctgggacgtgtacccctatctgctcctccattcccaggaccccaacccactgtttctaggacccatgaccccacatgccacacccctccatccctatacccggggatcctcaggacccctccatccccaggccctgcacccttgcctgccgcccctctccccctgggacccctactggtgacccctccgtccctgtacccagggactctccaggacccctccttccccaggtccttcacccctgcccactgcccttccactctctactcccggggccccctgggaccccactacactcaagtgtgtcacccctgcatcccaggatggagagacttctccgctctcacctgagaccccccgtccccagtcctcaccacctcagtccgtaacccccaacctatgactcctgaactccaggacccctcccttcaggggtcgtgctatttcctccacccccacccatgaccacaagacccctccctcttcccccaccatccagggaccctgccactcccacccgcacccctgtgcgccaagacccctaggccttgctccctgcgtcctccctgctgcctccagacccagtgacccccaccggagacccccaggctcagcacatgatctggatcagagaccttcaaaccatgctgctcccctccagggataccccctgcccgccctgcagtccagatcatagactaccatccacagcccctccagccccggacccccacctcagccagagacccctgggccctgccacctcccacttcagtgaccacccacctccagctccgccactgccaggctctggaccctggactctgcagaaggttgtctcccctgggccctgctaccccctgcaccccatcctatgatcccctgccaccaggccaccaccctagacccctgcccagactcccatctccgggcccttccaacccagagacccccagctccggggtccctccctccccagcccccagccctcctttctgggaaagaagtgggtttggcccagtatctgtctttgccagtgtgcggggtaccggccccaggccccaggttccctccactccccggtccctcttaccctgcccctcattggtcgggggcaggggctgggttttcttgctgcgggcactggagggggagggtcctgccctcccttctgaccttcgggtgcttttgttaacgtgttctggcttcttcctgggtgtttatgggcagctgggtctcctttcgtggggtcctgccctgggcggtacttagcagaggttcctgcccctggagggttccggggcctcctacggcttgtgccgtccgtgtcgccgtccctgtctctgtcgtccttagctgctgggcctctcctagcttggagtgaggggcggtgggtttgctccctccacctgggtggtctttgtgctctttggggagggggtaggttggatgcagctggaactcacccagcagcaggtgcagctggagaatcccaggctttctgtttgaggggggaggtggggcgccccgggcaccggctgaccttgggacatgtatgcgattgcacttgagggaccgctggctcggttgcaaagtggggaagatggaggcaggacaaggaccccttggagaaaagtaggtgaggggtctgcccccggggggctcaggagagggcaatgaggcccagcgggagatagcagcaaggtaaggtgggcgggcctgggacagcggaccctcgacatgcggggttaggggcgtggacccccactcagctcaaatccaagtacaacttttgactcccacgaacttaactaggaatggcttctcgctgaccggaggccttgtgaggacacttggtcaatgcacaccagcctcctgttctcacaataacaggctggagaacagaaaatacattcagaaaagtctaaggggccgggtgcgggggcgcacgcctggaatcccagcactttgggaggccgaggcgggcagatcacgaggtcgggagatcgagaccagcctggtcaacacggtgaaaccctgtctctacaaaaatacaaaaattagccgggcgtggtggcgcacacctgtaatcccagctactcaggaggctgaggcaggagaatctcgtgaacccaggaggtggaggttgcagggaaccgagattgcgccattgcactccagcccaggcgacacagtgacacaccatctcaaaaaaaataaaggacaggctgggcgcggtggctcacgcctgtaatcccagcactttgggaggccgaggcgggcgaatcatgaggtcaggagtttgagaccatcctggccaacgtggtgaaacaccgtctctactaaaaatacaaaaaattagccgggtgtggtggtgcacaactgtagtcccagctacttgggaggctgaggcaggagaatcacttgaacccgggaggcggaggttgcagtgagccgaggttgcgctactgcactccagcctgggcgacagagcaagactctgtctcaaaaaaaaaaggaaaaaaaataaaaggagaaatcctgtttgctgttcacacagtggaggtggccacgatgaaggcctgtgtccttgtgttcatattgagggctgaggagcaggagcaggagggtgggtctgtctccggggtggcagaggtggaaggggaggcaggagaggccggcaccgttggggcagcctttattgaaaaaattcacatatgagtggacctgtgcagttgaagcctgccttgttgaaaggtcatctgtgtttccttagcatttcaggagggttgaaaatggagagggggcactgacctggtccagaacgaccccctgagcaagtgatgttgatggagagtgcagtgccccaggctcagggatggaaggcccagagcccagaggggctgggcaggtgggagccatggcaaggccggagcaggaggagtgagggaggccctgtggcccagtgtgaccagatccgcattgagggtggaacgcgccgtggatgggcccaggagcgaggctggggagtagcagctgcagactccaggcaggagacagcagcgggctcggtggggacggcagaaatgaggggtagaggatgcaggtcctctttggaggaagcgagttcctgtggccaggagaggaggcagcttggcaggtgagggcgtggggggctgtggtgggggtccccagacttctggctggagcatcacaagccaggacaggctcaggagggacaagtactggcttggatgtgttggcgggacctggggctgagaggtccgcagagcagtgtgtcccaagtgctctgtgcctcagtttccatgattgaaacaaggtcactcagacacatctgtcctggggctgtgggaacaaacggacccgatgggttgctgacagccacaggccacacagcagagagaaagaaaacagcagctgaggccgggcgcagtggctcacgcctatcatcccagcacttcgggaggccgagatgggcagacatctgaggtcaggggtttgagaccagcctggccatcgtggcaaaaccccgtctctactaaaaatacacaaataagctgggcgcggtggcacgcacctgtaatcccagctactcagagtctgaggcaggaggatggcttgaatccggaaggcagaaattgcagtgagccaagattgcgccactgcactccagcctgggtgacagggcgagactccgtctcaaaaaaaaaaaaaaggtggggggatgtcgggacgaactgggggtgctgggataaagtctggagttcaccgatgagcagagaggggccgggccttgccagctgtgaggagagcaagtggcctgggcttgggcctggtccctggcgggggtgcagggtgagctgagacatggcagagaggaggctgggagcaggccttggtggtggccccagtgtctggaccgtcgcgcaggggtcggcgtttgtgctggggaggaggccaggggttgcacgcggcttctgggctgttccccggtcctggatgggcacccgtccatctcagcgcgctggagcctggcacacagtaggcacgcagtgattgtgcattgaatgatctgtgggaattaaacatctgattctctcatggggcttgaagggagaactgaagatctccagggttgcacttttgtagatgtgcacattggctggtcccatgaagttagtatctaaaatacctttttcttttttttgagacggagtctcgctctgttgcccaggctggagtccagtggcgcgatctccgctcactgcaagctccgcctcccaggttcatgccattctcctgcctcagcctcccgagtagctgggactacaggcacccgccaccacacttggctaattgtattttttagtagagacggggtttcaccatgttagccgggctagtctcaaactcccgacctcaggtgatccgcccacctcggcctcccaaagtgctgggattacaggcgtgagccaccgcacctggcctcccctccttttttgtttttttgagacagaatcttgctctattgcccaggctggggtacagtggcgtgatctccgcatgctgcagccttcagctccctggctcaagcaattctcctgtctcagccttctgagtagctgggattacaggtgtgcgccaccacgcccagctaatttttgtatttttagtagagacagtatttccgtcatgttgcccagggtgatggtgaactcctgagctcaggtgatccacccacctcggcctcccaaagtgctgggattccaggtgtgagccaccgcgcccagcctaacgtatctttattcactctatcatggaactgtcagcattgtagcgaggtctagaagtagaacaatctgggtgggtgtggtggctcacgcctgtaatcccagcactttgggaggccgagtcaggcggatcacgaggtcaggaatttgagaccagcctggacaacatggtgaaaccccgtctctactaaaaatacaaaaaattagcctggtgtggcggtgggcacctgtaatcccagctacttgggaggctgaggcaggagaattgcttgaacccgggaggcggaggttgcagtgagccaagatcacgccaccacactccaacctgggtgacagactgagactccgcctcaaaaaagaagaaaaaagaaaaaccacaaaaattagccgggcgtggtggcgagcgcctgtaaccccagctactggggaggctgaggcaggataatcgtttgaacctgggaggcggaggttgcagtgagccaggattgtgccactgcacttcagcctgggtgacaaagcgagactctgtcttggaaaaaaaaaaaaaagaacagtgtgttctggggtctcacatttcattgactgctttgtgagtccttgttcccataacacattgtttgatgattgctgctttgtggtatgttttgagaactgctcaccaaattcttcccaactttattctttgtgaagacttttcaggctgagtgcagtggctcacatctgtaatcccagcactttgggaggctgaggtgggaggatcacttgaccccaggagttcgagaccagtctggccaatatagcgagacctcattacttggacatggtggtgtgtgcctgtggtccctgctactcaggaggctcgggtaggaggatcacctgagcctgggaggttgccgctgcagtgagccatgatcctaccactgcactccatcctgggcgatagagtgagactctgtccctaaaaaaaaaaaaaaaaaaagctgggcacagtggctcacgcctgtaatcccagcattttgggaggccaaggcgggcagatcacctgaggtcaggagttcgagatcaacttggccaacatagtgaaactctgtctgtattaaaaatacaaaaagtacccaggcatggtggcttgcacctgctgcttgagaggctgaggcaggagaaccgcttaaacctgggtggcagaggttgtggtgatctgagatcgcacgactgggctccagcttgggcaacacagcgagactccacctagaaaaaaaaaaaaagagtgggcgcagtggctcacccctgtaatcccagcactttgggaggctgaggcaggcggatcacctgaggtcaggagtttgagagcagcctggcaaacatagtgaaaccttgtctctactaaaaatacaaaattagccaggcgtggtggcaggtgcctgtaatcccagctactcgggaggttgaggcaggagaattgcttgaacctgggaggtggaggttgcagtgagctgagatcgtgctgctgcactccagcctgggcaaaaagagtaaaattctgtctcaaaaaaaaaaaaagactttctcagctggtctgacacatttattactcttctagaatcagtcacccacatccacccatctgtccaccctacagatactcactgaaatacagtcctggctacaggaggtgcatatgacagaaaaacatctccttccttatggaacttatattctgtgttttgttttattattttttgagacagagtctcgctctgttgcccaggctgaagtgcagtggcatgatcttggctcgctgcaaagctctgcctcctgggttcccggcagttctcttgcctcagcctcccgagtggctgggattacaggtgtgcaccaccacacccggctaatttttgtatttttagagacggggtttcgccattttggccgggctggtctcaaactcctgacctcaggctatccccggcctcccaaagtactgggattacaggtgtgagctaccgtccctggcctaaggcgggaagatcttttgaagccaagagtttggtaccagtgtgggcaacatagtgagaccttgactgtgtgtaaaacaaaaccaaaacagataaaagacacaggtgccagcaaattcatgtgaagggtcagatagtaaatatttttggcaggccatactgtctcagttgcagctacttaattctgccgtagcagcacaaaaagccataaatcaacaacatgtaactgagcaagaagagctgtgttctaataaaactttattggccaggtgcagtggattacacctgtaatcctggcactttcggaggccgaggcaggagtatcacctcaggtcaggagttcaagaccagcctggccaacatggtgatactccgtctctactaaaaatacaaaaagtggctgggcgcagtggctcacgcctgtaatcccagcactttgggaggccgaggcaggtggatcatgaggtcaggagttcaagaccagcctggccaagatggtgaaaccccatctctactaaatatacaaaaattagccgggcgtggtggcgagcgcctgtaatcccagctgcttgggaggctgaggcaggagaattgcttgaacctgggcagcagaggttgcagcgagccgagatcgcgtcactgcactccagcctgggcgatagagtgagaccgtctcaaaaaaataaaaaataaaaaaattagctgggcatggtggtgagcacctgtaatcccagctacgtaggaggctgaggcaggagaatcgcttgaatctgggaggaggaggttgcagtgagctgaggtagtgccagtgcaggccagcctggtcaacaagagtgaaactccgtctcagaaaaaaaaaaaacttaatttacaaaaacaagtggtgggccagattcactctaagggccatagtttgccagccctgggctaacggtgcctgatgatcttgagaatcagtttgtcaagtgataaaggaatttactgaggagattggtctttctaaggacataaagttgggtgatttttcttttctttttttttttttttgagacggagtctcgctctgtcgcccaggctggagtgcagtggcacagtgtcagctcactgcaagctccgcttcctgggttcaagtgattctcctgcctcagcctcccgagtagctggcatgtttacttttatctggtttgaactgtttcttcctgaagccttattaggtttaacagtttttctgtggtcttgtgctctgcagtagagtatcctgtagtaagcgggatggtttggatgtgtgctgtccaatactaggcactcatgtgccagtacggactacagatgtggacagtgtgaccgaggagttgaatgttgaattcagctgaatttggatatagatttaaatagccatgtgtgtctagtattgaccccttggactcttagactttttaaaaattaaatttttttttttttttttagagacagggtctcactctgtcacccacactggagttcagtggctcgatcatagctcactgcagcctccagcttctgggctcaaacagtcctcccaccttagcctcccaagtagctgggactatagacatgcaccactatgctcggctgatttttttctgtttagtagagatggggtctgctgtgttgctcaggctggtcttgaacttgtgggttcaggtgatcctcccaacttggcctcccaaagcactgggattacaggtgtgagccactgctttggctaaaaaataatttttttttttttttttgagacggagttttgctcttgttcccaggctggagcgcgatggtgtgatcttggttcactgcaacctctgcctcccaggttcaagcgattctcctgtctcagcctccttagtagctgggattacaggctccggccactgcacctgactacgttttgtatttttaggagagatggcgtttcatcctattggtcaggctggtctcgaactcctgacctcaggtgatccacccgcctcggcctcccaaagtgctgggatgacagacatgagccactgcgcctggctaaaaaataattttaaaaattagccaggcatggtggtgcacgccctagtcccggatactcaggaggctgaggtgagaggatcacttgagcccaggaagtcaaggctgcagtgagctgtgatcatagcactgcactccagcctgggtgacagagtgagaccctgcctcaaaaaagaaaatgttaaacgtcagggtcattccactccgaggcatttatccaggagaaggagaatctgtgtcctcacacagcctcgtgcgtgaatgcccagagcagcatgattcacagtagctcaaaaccggaaaacccgcagaccagccagtgagtgcagaaacaaaccgcggttcacagattccatggaatttggcagtcaaaagaattcctggctgggcgcagtggctcacgcctgtaatcccagcactttgggaggccgagacaggcagatcacgaggtcaggagattgagaccatcctgactaacacggtgaaaccccgtctctactaaaaatacaaaaaaattagccgggcgtggtggtgggcgcctgtagtcccagctactcgggaggctgaggcaggagaatcgcttgaacttgggagacgggttgcagtgaaccgagatggcaccactgcactccagcctgggtgacagagcaagactccatctaaaaaaaaataataattttttttttgtagagatggggtctttctatgttgccgaggctggtctcaaactcctgggctcaagtgatcctcctgccttggcctctcgaagtcctgggattacaggcatgagccactgctcctggcctgattttattttcgactcagggggtatatatgaaggtttgttatgtgaaccctgaatatctgagacaggtctcagtcaatttagaaagtttattttgcctggccgggggcggtggctcacgcctgtaatcccagcacttcgggaggccgaggcgggcgaatcacctgaggtcaggagttggagaccagcctgaacaacatggagaaaccccgtctctactaaaaatgcagaattagctgggcgtggtgatgcatgcctgtaatcccagctactcgggaggctgaagcaggagaattgcttgcacccgggaggcagattttgtgattttgtggtgagctgagatcatgccattgcactccagcctaggcaacactagtgaaactccatctcaaaaaaaaaaaaaaaaaagtttgttttgccaacattaaggatgtgtgcctgtgacacagcctcaggaggtcctgacggtatgttcccagggtgggtggggcacaggttggttttatacatgttaggggacatgagacatcaatcaatatatgtaaaatgaacattggttcagtccagaaaggggggaaactcttagctgggaggggcttccaggtcataggtaagaaacagaccattgcattgagtttctgatgagcctttccaaaggcagcaatcagatacgcatttatctcggtgagcggagggatggctgagttctctctgtcctttgtctgcaaggaatttccttgtggacagattgggagggaggtatgtagcttttttatcttggtagctgtctttttaaggaatagaacagaaggctggtttgccctaagcggttccagcttgatttttccctttggagtagtgattttggggtccagagattcctttttcttttcttttcttttctttctcttttttttttttttctttgacggagtttcgtttttgttgcccaggctggagtgcaatggcgtgatctcggctcatcacaacctccgcctcccgggttcaagcgattcttctcctgcctcagcctcccgaatagctgggattacaggcatgcatcaccacacccggctaattttgtatttttagtagagacgggatttctccatgttggttaggctggtcttgaactcccaacctcatgtgatcacctgccttggcctcccatagtgctgggattacaggcgtgagccaccgcacctggccttttttgtttgtttgagacggagtcttgccctgtcgcccaggctcgagtgcagtgatgcaatcttggctcactgcgacctccacctcctgggttcaagcaagtctcttgcttcagcctcccgagtagctgggattacaggtgcacgccaccatgcctggctaatttttgtacttttttagcagagacggggtttcaccatgttggccaggctggtcttgaactcccgaccttgtgatctgcctgcctcggcctcccaaagtgctgggattacaggggtgagccactgcacccagcctgtgtgcggctaagttttaaacttttcgtagaaaagtaggcaaggcggagtcttgctacattgctcaggctgatcttcagctcttgggctaaaacgatcctcctgccttggcctcccaaagtggcgtctttcttttgatgttgacgtagccactccagctctcatggtttctgtttggatataaaggaaaatctgtttttactcctcataggagttctggcactgtgtgtgggttttccacagcaagtgattcctcatcttgtagatacaaactgggcatactacaatttttttttcttttttttttttttttttgagacggagtctcactctgtcgcccaggctggagtgccgtggcgcaatctcagctcactgcaagctccgcctcctgggttcacaccattctcttgcctcagcctcccgagtagctgggactacaggcgcccaccaccacgcctggctaatttgtttttggtatctttagtagagacggggtttcaccgtgttagccaggatggtctcgatctcctgacctcatgatccacccgcctcggcctcctaaagtgctgggattacaggcatgagcccctgtgcccggcggcatcctacaatttaactcaaccctcacacccaccatccagagtgagcacagaccccacaggtggtcagctgagccccgtgccacccacgtcagatgcctgttgcaggggcgagtccccaggtgacccacacttctctctgactaaaatcaggagtcccacatctccgtccttgagcttgataattagccataacagcttacagaacttcgagaaatacagttatcagtttgcctgtaatcacagcgctttgggcagctgaactgggaggatcgcttgagcccaggggtttgagaccagcctgggcaacatagcgagaccccgtctgtacaaaacatttaacagttagctgggcattgtggcttgtgtgtgtgttcccagctaccgggaggctgaggtgggatcattgcttgagtccaggaggttgaggctgcagtgagctatgatcgtgccactgcacttcagcctgggtgacagagtgagaccacacctgtaaaaactaaaaataaaaatgaaataaaaataaatgaaagatttaataaaggacatctcttccaggcgtgggggctcacacctgtaatcccagcactttgggagacggaggcgggcggatcatctgacgtcaggagttcgaggccaccctggccaacatggtgaaaccccatctctactaaaaaaatacacaaattagccaggcatggtggtgctatgcttgtagtcccagctactcgggaggctgaagtaggaggctcactggaactcgggaggcggaggttgcagtgagccaagattgcgccactgcactccagcctgggcggcagagcgagactccgtctcaaaacacaaaaacagcaaggacatcttgcagccagatgaagaggttcacatgtccagagggtatcggagcacctgcacctgtgtcctgtgggctcgggacggccaccctcgtggcacgtggataaagtcaccagcttggaggttcagccctgtggtttaaggctcttcatggacgttgcattgcgtagattacatcacggaatcattggccctttgtgcaccacacaattctttcggtctttaacctgttttcttttctttttgagatggagtctcaggcttgtagcccagggtgcagtgcagtggtacgatctcagctcactgcgacctccgcctccagggttcaagcaattctcctgcctcagcctcctgagtatctgggattacaggtgccaccacgcccggctaatattttgtatttttagtagagacggggtttcaccgtgttagccaggatggtcttgatctcctgacctcgtgatccactgcctcggccccccaaagtgctgggattacaggtgtgagccaccgtgcccggtgcctcctgggttctaagtgattctcctgcctcagcctcctgagtagctgggactacaggtgtccaccaccacacctggctaatttttgtatttttcatagagacagggtttcaccatgttggccaggctggtctcgaactcctgatcttaggtgagccgcccgcctcagcctcccaaagtgctgggagtacaggcgtgagccactgtgcccgtcccccatcctttctgtctctgaatctgaggactctggggacctcctaggagtggatcacacaggatttgtccttctgtgcctggcgtctgtcatagagcacgacgtcttcaaggcgcatctgcaccgggtcctgcatcagagcctcgttcctgtttgtggctgggtcgtgttccagtgcgtgggtggtcgcaccgtgtctgtcaatggacgctggttgtttcccccgttcggagttgggaatcgtgctgctgtgagcaattgtggatgtgtttttgtgtggccgtgtgttctcgatttgtttggaaggggaaggggttacagatacatgaaggggggaacagccgggagtggggctggggactcacggtgggcagaggaggcagtagcggtgcccaggggtcgaatcctgaaggcccatgcaggtgtctccagggaggggctcggtgttggaggagcccctgccttggggaccggcagagctgcctggggacccgcccatgtcagaggtgctccctgattccaaactgcatggacggcccacgccgggcccacttgagtgcctcctgctttctgcttttgaaccctcctcaaaggttttccccacaggagaccaagatacatttttaaatcaagaaagagaagtcccacgcacaggtactctatttctggaacatcgtgtgggaggggagcgtttgtcctggggcaccagctgtgggtgatggcgcagggccctgaggcctgggcccttgaggacgcggccaggagggcagacgggcgggcggcagtcccaatgcccacacactgggggggtcaaactcagtgggttcatcctctgccagtcccggagcccaggaccatggatcaaggcgtccgagggcggcgctccctctggaggctcaagggaggatcctcctgccccacccagcttctggggactccagacgtccttggcctgtggccgcatcgctccagtccctgcttcatgcggccgcccactctgtttcttttttctttttctttttttttttttttttgaggtggagtctttagtcttgctctgtcacccaagcaggagtgcaatggcgtgatcttggctcactgaaacctccgcctcccgggttcaagcaattctcctgcctcagcctcctgagtagctgggattacaggcacccaccaccacgcccagctaatttttgtatttttagtagagacggggtttcaccatgttggccaggctggtctcccaactcctgaccccaggtgatttgcctgccttggcctcccaaagtggtgggattacaggcgtgagccactgcacctggcctttttttttttttgagacagagtcttgctctgttgcccaggctggagtgcagtggcgcagtcctggctctctgaagccttgacctcctgggcttaagcagtcctcctgcctcagcctcctgagtcgctaggattgcacttgctcaccacgatgcctggctaattttcaatgtttttgtagagatggggtctcactatgttgcccaggctggtctcaaactcctgggctcaagcgatcctcccgccttggtctcccacatgctgggatgacgggtgtgggccaccgtgcccggcctgtttctcctccttccaaaaacaccagccactgtttagggccagccttccccggcgccttcgtcctgactcacggagttagcaccggcctgtttccgccgggcctcgcattccgaggttcggggcggatgtggaagctgtggtcggggcccatgtggaagccactgcgttggtttctgacctgactctggggtgcagtcaagccctgggctggaccgggtgggctgagggcctgcggggtttaggggggcgcgtgtggtgggaggagagcgaggagcttctcctcggaagacgggggctttcccgggagctgtgtggaggtcgcccagccagtcctggaggttcagctgtgcaggagtgagaagcaggtcccatccgtgcggaaccacctgtagctccggagctttccgggcgtggggaggctgttgagagccggcacttgctgtggtgggagacttggaaggggacaggtggggaagaggtgacgcagggaccgcaacgtcctggggcaggtgctccgccgcgcgcaggccgagcgtctgtgatcccacttcgcgagcgtctgtgaacccgccccaccagcgtctgtgcccctgctgagtgtctgtgacccccctatgctgtgtgtgctctcagccccctgggaggccatcgtgtgggcaggccctggggactgtacatggacagcacagagtggcgtcttgagcctgggagccgtggagttctccccaccccatacagacctggccaaacgcgggttcatagccggctcttggggaggcaccagcagcctttctctgctcaccgcaccctcctgcctgtggcgatatcgaagatctgagccactgagtgggccccataggcagcctgagcttcacacggggcagaacccccagcgtcctcacagccaccgctttcccagctggggccacccctgctgcctcctaacgctcctcccacgctcctgctgttcctgggcctccatgcccttccccatggacgtggcggctcagatgaccccacagggcttccctgggccttgcgttcctgatgggaccacgctcctctctcttctctcactcagtgggggctgttcggccatttggtcctcgtctgtctccctcagtgaggccaggccctgtgcctgtagctgactccctgggaaagcttgtgctgatgagggaatgcgtgagcaggagagtgatagagagtagacgagtgtgaatgaatgagtgaataatgagactaagtggatgagtgcatgtgggaatgaacgaatgtgtgtgtgtgtgaatgggtgagtgaatgagtgtgcgatgaatgagaaagtgaatgaatgcatgtgtcataaatgagcaagtgaatgcatgcccacgggaatgaatcagtggatcaatgaatgcatgtgtggatgaatgaatgagtgcatgtgtatgagttgagtgaatgtacatggaaattagttaatgaatgaatatgtgaatgaatgagtgaatgaacgcctgtgtgaatgaatgcatgtgaatgagcgagtgaatgcatgcatgaatgaacgtatgtgtgaatgcatgtgtgaatgaacacgtgtgaataaatgcatgcatatgggaatgagtgaatgagtgcgtgcctgacgcctggaaggaaagagagaggatggtgagggctggcagagcgtgaggccctgtgtggcccagggcatggtcctagccctgcctgtccttgccgtgggtccgtctgcatcaccctcctgctgtcccaggccccttccagaagcctctgccatcggggggcctggtacatgcctgctggaggctggcagggagccctagtggggtggtcacccaggataccgggctggccctcccggccgtggggtggcggccacgggcttaaccagggccttctctctcccgtaccaggttcgtgctggccgtgggcagcgccgtctttgatgccatgttcaacgggggaatggccacaacatccacggagattgagctgcccgacgtggaacccgctgccttcctcgcactgctcaagtaatgcttccggatgcttcctgctggggagctgggcctggggagggggacctcagagaacgtagaccctgtctgacaccagctcagaggccctggcttggtggagatttctagaacgttcctgtgcaatgaggggttccagaggcacttttttttttctttttgagatggagtctcgctctgttgcccaggctggagtgcagtgccgtgatcttggctcactgcaacctcagtcttccaggttcaagtgattttcctgcctcaacctcctaagtagctgggactacaggctcgtgccaccacgcccggctaatttttttgtatttttagtagagatggggtttcactgtgttagtcaggatggtctcgatctgacatcatgatccacccacctcagcctcccaaagtgctgggattacaagcctgagccaccgcgcccagcccagaggcaccctttttattttatattttttagacgtggtcttgctctgttgcccaggatggagtgcagtggtgtgatctcagctcattgagacctccgacttcctggttcaagtgattctcctgagtacctgggattacaggtgttcaccaccacacccagctcatttgtgtgtttttcagtagagacagcgtttctctatgttggccaggctggtctcagactcctggcctcaggtgatccgcctgcctcagcctcccaaagtgctgggattacaggcatgagccactgtgtccagccagttccctgcttttctttttcttttcttttctttccttctttttttttttttttttgacagttttgctcctgttgcccaagctggagtacacaaacaaaaaataacaacaacaacaaaaaaaaggaaacatcagtgaaagaaatttaaaaagacacaataaatggaaacacatcccatgtccatggattgaagagaatattgttaagatgtccacacaacccactgcgatctgcagtcagtataatcctatcagaattactgttttttgcaaaaatagaaaaactatcctagaattcatatggaatcccaagggaccctgaatagccacaacgatcttgaaaaagaacaaagttggagggctcatactttctgatttcaaaactcactgcaaagctacaatcatcaaaacagtgtggtactggcgtaaggacagaacgtggggaccaatggaatggaacagagagctcagaaataaatacctttgcacatagggttaaataattttttgcaagggtgccaaggccattcaacagaaaagagagtttaacaaatagcacaggcacaactagaaatacacatgcagaagaatgaagttagacccttaccttactgtatataaaaattaactcaaatagatcaaagtccaggctgggcacggtggctcacgcctgtaatcccagtactttgggaggctgagatgggcggatcacgagatcaggagattgagaccatgctggctaacatggtgaaacctcgtctctattaaaaatagaaaaaataaataaaaaataagaaaattagccgggcatggtggcggacgcccgtagtcgcagctacttgggaggctgaggcaggagaatggcgtgaacccgggagatggaggttggagtggactgagatcatgccactgcactccagcctgggcgacagagcgagactctgtctcaaaaaaaaaaaaaatagatcaaagtccaaaatgtaagatctagacctgtaaaatacttagaagaatccaaagtggccaggcgcagtggctcaggcctgtaatcccagcactttgggaggccgaggtgggtggatcatgaggtcaggagatcgagaccatcctggctaacacggtgaaaccccgtctctactaaaaatacaaaaaaattagccgggcatggtggcaggcgcctgtagtcccagctactcaggaggctgaggcaggagaatggtgtgaacccaggtggcagagcttgcagtgagctgaggtcatgccactgcactccagcttgggcaacagagcaagactccctctcaaaaaaaaaaaaaaaaaaaagaatccaaagtatggctaggcgcggtggctcacacctgtaatcccagcactttgggaggctgaggtgggtggatcacctgaggtcaggagttggagaccagcctgggcaacaaggcaaaaccccatctctacaaacatacaaaaattagctgggcatggtagcaggcacctgtaaccccagctactcaggaagctgaggcaggagaatcgcttgaacctgggaggcagaggttttagtaaaccaagactgcgccactgcactccagcttgggcgacagagcgagactctgtctcaacaacaacaaaaaaagaaaaaccagaatcaaatcttcatgacattgggtttgaccatgattacttggatatgacaccaaagacacagccaagaaaagaataaacaaagacattggacttagggaaaatgttaaaaatgtatacctcaaaggacaataccggcagagtggaaatgccacccacaggctgggagagaaaaaaaatatttttttattttttcattttttgagatggagtagcgctctgccaccatggctggagtgcagtggcacgatcctggctcactgcaacctctgcctcccgggttcaagtgattctcctgcatcagcctcctgagtacctgggactacaggcacacgccaccacgcctggctaatttttgtatttttagtagagacccggtttcatcatgttggccaggatggtctcgatctcctgatctcatgatccgcctgcctcagcctcccaaagtgctgggattacaggcctgagccactgtgcccagctgaaaaaaaaatgtgtttagagacaggatctcaccatgcccacactggtttccaactcctggtctcaggcaatcctctcgcctctgcctcccaacgtgctgggattacagatgtgagccactgctccaggctggagacatttttttattttttattttttttttgagagggagtctcactctgtctcccaggctgcagtgcagtgatacgatcttggctcactgcaacctccgcctcctgggttcaagcgattcttgtgcctcagcctcccaggtagctgggattacaggtgtctgccaccacacctggctaatttttgtatttttagtagagggggattttgccatgtcggccaggctagtctctaactcctggcctcaagtgatctgcccgcctcggcctctcaaagtgctgggattacaggcgtgaaccaccaggccggcctgtgctgcttttttttttttttttttttttttttttttttgagacggattctcgctctgtctccaggctggagtgcagtggcgagatctcagctcactgcaacatctgcctcccaggttcaagcgattctcttgcctcagcctcccaagtagctgggactacaggcgcccaccaccacgcccagctaatttttgtatttttagtagagacggggtttcaccatgttggccaggctggtctggcacttcttgacctcaggcgatctgcccgcctcagcctcccaaagtgctggggttacaggcgtgaaccaccaggcccagcctgtgcttctatttttgatcggcccaacttctgatctgtattcagtgtcgtgtgggcccctcgctggcaggtggtaatagcgtccatgattatccatgatcctaattagcgtgttgggttctatgatccacccagaagtggttgaggttttcggtggtgcccgaggtggggaaccaacagttcctcatggaaaaggtgcccaagaaggagacacccagctcccagtgccctctcctggggcatcccgggcagaacaagacaggccatatagacgcttccgggtgtgtgctgtgtagatgggttcagcctcttgctcgttttcatgggtgaccaccttgccaagtcgtgtccctatgtcagagggcaacggacaggggctaattctggaaggttcctcggggaacctgatgtgggtgtttgggtcctgccagctcaagggccggtggccgagtctaacggtctgagtggtcccctgacgctctcccctgggggcgggcatggcggtcccacctcacggccacccgcgttgcttctgcaggtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggtgggcggggccggtacgaggcgggggcggggccaggcctggctggaggcggggccggggtggggcggaccgaggctggaggcggaggcggggccgggggcgggcccgggaggcagcaggctcctgcctggtagtaaaatgtgttttgggccgggcgtggttgctcacgcctgtaatcccggcactttgggaggccgaggcgggcagatcacctgagctcaggcgttccagaccagcctggccaacatggcgaaatcctatctctactaaaaacacaaaaaagagccgggcgtggtggcgggcacctgtaattccagctacttgggaggctgaggcaggagaattgcatgaacctgggaggtggaggttgcagtgagccgagatcgcaccactgcactccagcgtgcatgacagagcgagactccacctgaaaaaaaaagatgtgttttggacttttccgtgatacttcaaaaaattattggcagggtgcggtggctcacgcctgtaaccccagcactttgggaggccaagtagggaggattgcttgaggcccggagttctagaccagcctaggcaacatagagagaccccgtttctacaaaaaattaaaaaaagattcaggccgggcactgtggttcatgcctgtaatcccagcattttgggaggctgagacaggcagatcaccagaggtcaggagtttgagaccagcctggccaacatggtgaaacctcatctctactaaaaaaaaatatttcataaattagccaagcacgctggtgcatgtctggaatctcaactacttgggggaccaaagcaggaagattgcctgagcccgggaggttgaggctgcagtgagtggagatggcgccactgcactccagcctgagtgacagagtgagaccctgtctctaaaaaaaaagtaaaataatttttttttgagacggggtttctcttgttgcccaggctggagtgcaatggcacgatctcagctcactgcaacctccgcctccagcgttcaagcgattctcctgcctcagcctccacagtagctgggattacaggcccccaccaccgcgcctggctaaaaaaaaagaaaaaaaaaaaccagagagaactttctctctctctctaaggaaatgtcaggtagacagagcagggccagggatctcaggggaccccagttgggctctgtgcagcccaaagggcgggggctggggaggtcgtgcaggccagggaggctgagaggacgtggggccagtacgggtggacggccgcttgggagccgtgagctcctggtcgggggtggagggtggccagaggggacagcggcactgggtcctccaatgggctttgggggtccggcatcctggaaaggacccagaaccttctccccctccatcctggcaggtcagatgcagggcatcccggactcccacagggaggggtttcttgtccgggtcatctggtcgccttgctggagaggcctctgcctgagctgagaggaggctggagctcactccccgggcttcatcttgtggctgcctcagcctccctgcccctaaaaccactacgaacccacttgagaggtgtcctcgggaggatgcccgcagaaaggcctgcccgggtccctgctggcataggcccttccagcaccttccactaactaagcctctgtttccctaagagcacaggcgtcctccagctctgtcacctgactgtcagaagtcatgtctgctgtttgtcttgggatggagctgccggggacacggcccctcccaccacaagtggccaagggcatgttgtggtcgggaagcttcaccggtcggccccggccacctcacctctgcctgccactcggggtcctgggccctgctgccccccgagtgcagctgcaacgccccttttgcctaaagcagcaggccctgccgacagggacctgagcatctttttcttccttccttggcctctgaggtcctgagagggaactccccaactctcccgccccagtcagcggtcacaggggagtctctgggcccacaacagggccggcctggtggctgagaccctggtggctcctggccacgctcaggaaggcccgtgtggtcagggctgcatttgaaccggccccgcactggggatctgccgagggctgggtgctgatgtccccaccgcgccccccgtcgatgtctcttgccaggcgcgactcttcgatgaaccgcagctggccagcctgtgcctggagaacatcgacaaaaacactgcagacgccatcaccgcggagggcttcaccgacattgacctgggtaagggcccaggagcccaggtgtgggaatcccagcggggcctcggcgggagggtccggggattgacagtgggagctttgggcctgggggagttgcacaggtgagctggggcctcaccacttgcagcaggtcaggagtttgggtcctagcacagccccacgggagtccggggccttggccaggaggccacaggccagagcccaccatcccagctgatggtgaccatctcgtcctccgatggtccatggctttgactttgctgttgaacagcttttgtcaaagctactcaagtctgtccttgtggcttaaaaacaaccacagccgaggaaaatgaaggggcgtggtcttgtgttgataaagctttatttataaacacactcacagggccagatttgggccacgggccatagttgccagcccggctttaactgctggtcctcacgttagtctcactgcctcctgcagggtgggcatgtgggtgtcgtgttcacgcagccccttcctccaccccacagacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtaacagagctcgggctcaggggctggtttgggaggggagtggcacacaggtgggcatctgggtaccgaggatagtgcccccgagttcactgcggaaagcctggcagatgcctggcatatacagataggaagaaacctggcttgtgaggacgcgtccacagggccatctgttagccccggcccggctctgtccccaccgtgcacactgccagaccccgcctctcgtgtctgtccagctgttttggtggcatcttcccaggagggaagggagtccccgtctcgcgcccttgtgctacctgctggtgcaggtaccagtgtctgtgacgagctcaggagggctctgacatggccggggtggctgtcatgcgcccgagtgggccttggggtcccctgctgcagggcctgggttccagggtgacgtgaaggggcagcgctaacgatgcctcctgccctcgtggctgctcactgcctgacgccatccagctctggagcaaaacaggcctggaactttccagaaggggctgggacagagccctggggctggtgcacactcgccgtctggccttccccaggtccacgcggcccccgctcttgcttagctgaaggtcgccagatttagcaagagggtctctgtcgcccaggctgagtgcggtggtacaatcacagctcactgcagcctcgacctcctgggctcaagtgatcctcctgcttcagactccggagtagctgggatcacaggtgccaccaccacacaaggcttatatttgtatttttttgtggggacagggtcttgctatgtcacctgggctggtcatgaactgggctccagccatcctcccatctcggcctcacaaagtgctgggattatggacatgggccaccgagcctggctagatacatacttcttaaaaatacaactgttgatcagctgggtgtggtggctcatgcctgtaatcccagctacccgggaggctgaggcaggagaatcacttgaacccaggaggtggaggttgtgatgagccgagatcgcgccactgcactccagcctgggcaacaagagtgaaactccatttaaaataaaaaaatatatacaattgttggccaggctgggtcactcactcctgtaatcccagcactttgggaggcccaagatggggggaatcacttgaggtcaggagtttgagaccagcctgaccaacagggtgaaaccccgtctctactaaaaatacaagattagctgggcatggtggcgcatgcctgtaaacccagctatgctggaggctgaggcaggagaattgcttgaaccctggagacggatgttgcggtgagccgagattacgccactgcactctagcctgggggacaagagcgaaactccgtcctgcactctagcctgggggacaagagcgaaactccgtctcaaaaaaaaaaaaaattgttaacattgtttattgagttttgatactcagtcttcctgattcacttaacccataatggtctgtttctcaccagttattaaactgtgtctgcactgggctggcttgcagctgagcgatgcggagttgagcccaccttggttgatgagtgattaggtctcaggcaggcagggctgctctcattagagcagagggtgctgtgtcctggcactcctgggggtggatggtggacccccaattctgcccctcctggcctcccctccctacccagagccccttcacatcccatgcacagtccctctgcctgtgacatctctgcaccgggattaagagcctggctcttggagtctgcctggggtccgctagccatcacccctgggggtgtaagcgcttgagaaggtgtctgcctagggcccaccgtggagaggaacccccagactgcttctagaagccagggctgcagcctggggggtacaggcctagcagggagccacagtgacccctcccagccaatggccctgagagaacaggcagtggagccccccgcccccacccacagtgaagtgacgggtggtccctacagtggggccagaccctgagacatcacccctgagtgagtgcatctgtcagaccctgaggcatcgcccctgagtgagcgtatctgtcggcctctggtctgtgccctgggacctctccctaaaagcccaggcagcaggggccatggctggtggctagtcccccggggaggggctgcccaggtccctgcaccttgaaagtccgacgcagacatcttagggggaaggagcgtgtcctcccaggcactcgggatcctggggtgcagcccggccctcccccacaccctccctgtgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggtggggcttggggtgcaggcgggggggtccggacatgggggtggaggactcggggatgacggagatggggggccgggcatgggggtggagaactcagggatgatgaagacggcgggggggccgccgggcatgggggtggaggactcagggacgatggaggggaccgggcatgggggtgggctcgccccagctcaccttaggctatccctgggtatccacgctgctgcctgtcatctgccacggcaggttctcagtcaacaagcgcatcttcgtggtgggatttgggctgtatggatccatccacgggcccaccgactaccaagtgaacatccaggtaccagccccaagcctcatccccaggccccactcaggcccatgtcctctctccacctccatggaaccctggctgaacccccggccctggtccctgtgctgcccccaccctgggcaggtgggctgggcctcgaggggtccccgttggccctccccaggcctgagcctcccacttcccacctccccgcagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaaggtgcgccgccggggacaggggtccctccgtgggagtctctggcccatcctgaagccaccggggcacagcacacactctccagaggcagccaccctggcccagtcggggccttgccctgtccacacctggggcatcccagcctggtggtccttgacctcactgtacccctattccctacagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggcccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgc

SEQ ID NO: 36938 - DNA, 113982 bp, Homo sapiens
gcggcgagcgcctgtcaagcagtgggaggaaaaagcgcttggagccaccagcccactcttaagcgaaactcgcctggaaaacaccccgcctcccagcagagtttctgccggtttctttagaagggtggtgcggaaaagcaacttttgggaacttgaaggagtggggtgtggggcgaagtggaaagagcacacaacgcgaccccactcagtccccgcttgggactcccatcccggcatcaggcgtagtgggcggtccgggccagggccagggccagagcggcggcggcgaggccatgccgagggcccgtcggccgcagttccccgtccggcctcgcgggggcgccggcgctgccgatcaggtgaccgagggcccgtccggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaaggtgcgcacgggccggggaggccgcggcggaggcgggcgggcccgggagggatgaagggcaagggaggccgtggggtgggggcggcaggaggcgccgggtgtagaaatctcggcgtcgccgcccgaggcccggcccggggtcgcctggatgcgccgcggcctaatgcggagtcccgggcgcctctccctgtggttcgccggccggccgaaggcagagaagccatttcccggctcccggcggcgggatcgggcgctgggcctcgcacggggtgggggcgccgctgggagccgggagctgtcccctcctcggcgcccccgcccccatgatggggcccataggaaagggagggtggtgggtgggcgaaattctaggtgggtaggaaaacttgagtgttccatattcttacggagatggcagcagtgaacagggattacaccccacatccccattttttggtgtgggaatgtgggtagagaagggctgattggatgaatcccgtatcccctccactttgccactttattttagattgctaaataaaaagccattgagagtgtgttgacgatttgggattatttcattttgaaggtggagaggagggggaagtgagggtggaaccaattttctgaaatacttctaggctgtgagtcactagaactggaataacaaccttctactctttcccctgtactcctcctcatgttagattttccaataccatttcttaaagttcggtgtctgtacaaaataaaaaccgtaaaaatgttgcaattgctgctgatttatagcatagtctgataatttgagcaactatagctaataggcccatttaaaggcttttacatgtcctcagtacagtaaggagtggaagaccactggaagtttagaaaagtccatgtaaagatagaacaaataattacattcattatcgtaggacaaaacaacaaaatctctccccttaaggcaaggttggtaagttttaaacaatttgataaagagaaaaagagatatttggaaaatttagatccatcgagtttccaatgtgtctttgatgtcataccttcataactatttgttggctttttaatatatcgtgaatgttaccgtttagtttaatcatagcaatagattgtaggttgagagggcttctgaagaaaggtttttttttttttctttggaaattcatttccaagcgtttgagtgtaaaattgatttattttttacaatttgatgtagacactaattctaaagagtgtcctggtttaatgatgataaattttggataaggacaaagtctggttgctcacctaattgcaaggctttattactctaaacccagtgctatctggagagtaactgcaacatgcttactcagtttgttaccttttatgtggcaggagctcagtgtcatgacaaagaagcccctctgcatttaccaaggagcctaggttataaatttatataggttaggaataattcagttttaaatagtattacttagaggttgcattgacctgaactgttcggggagattgtgctgcttaaaaaacttggaaattgattcctatatgaattttgtccaaaaatgaacaagtcaaatattataaaagttactagacctgtggtattgtggtttaaaggaaatggttatgatggtttctaaaagaggaagtgagagtaacatcaaaagtgatttgggtatttgggcaaaataccttttctaagcatttattaaacatttttgtaggataaatgcaatcaaactttaatatcccaccttcataaataagattaaatgaaattctgggcatttgaactctaataattccagttcattgccttttctcaaaagcactgtttttttcacttcctgttttgggaagcttcagcctcttgtattattgaacttgtgaaagttaaaatgcattgaatgtgatcattattatatccatgtcaaatattttgatttattgaaacgtcatattttagcacttgccttatatttttagtttcttaagaaatacattgcttaccttgcttgagtgtgaattttctctgggcagggacagtgtaatttttgaaatactagagtatttagggccttatctgatactcgaggccttcagttaggccaggttgaaatgaatgaattacttccctcctctctctcaaaacctgtgtgctctagttttaataataatacccttgggtttgctccctttgtgtaattttgcatgtaaatgaatcagataagattttggatctttcagcctatagaattgtctgtgagtctggcatatcttcccagctggctaggaattgaaacatttgttcaaatatcttgccaaagaagtgagtaagatctgttcaccatgtgtttattaggttcatgctgtctgcattcttactgcattataaaccacatactcttttcaatctcaacctcttctagtcttaaaaaaaaaaccttccacctcataatacatgtttgccaatcaattatcacattttcattaatgcatgtgcattagattgtctaccagatctaattactctgtttcaattggaagtatacagtggaaatgatattttagtgaacatatacaatgaaaaatagttaagtaaaataacttattattgtcagtaatatgctttggcgcttattagggaagttggagcatgattactgaagaatgttttttttttttaatttcatcagtcaaaaattttgagatcttaatatttacaatttatgggaattttagggaacttgtagtttgacggaggatgtaggaacacataaaagcggattttagggaaaagacttgaaggttgttggtagctttacatttaaatttatttgttgcttaattcctttttttttgtttttaaatatatggtttcccttttgcagacctaataatgtgactcactcatgtagagatttgtaacatttttaaaggttccagcatggcaacttgtgtggtggtgggattaagagcactgggccagaagttaagagacttgcattccaatcttcattctgtcactgagagttctctaacattggttagtaatttgactttcttgagcttcacttttcctcatctgtaaaatggggaaaattaactgtaaaaggaacactaaagtctattccagctctatctttatgattttatggtgaagtagtagagtagaaattatgtttcattttaaacaataactgaactcagtttagttttctgtaatgtagggagcataatgcctgccctacatacttcacagaattgcttctgaaggtagaggatggtaatatgtgaaaatagtatttaggaatctgagcatctcttttgggcaacattgtttttctgaaattgtataactgttcaacaaaactgccaaatacccaaagaaaacattttgctcagttaaatttttgtgtgtgtggtttactctcttctttttttccttctcctttcttttcctccaccattaccaacatgagattaatctctgtattaaaaagatcttagttaatacttgcgtcttttcctcctgttaaatttctgcctgtactgtaaaggtcagagaatgagaaaaaaaaaaaaacccatacaactattacaaactttttaaagtggagtattgtggtggtttaaatgcagttttacttctttaaaaacattagaggaatatttttctttttttccctatccttttctcattattttggataaatttattttctaaggaaaagtttaacaggactagcattgtaaaattgaaagtctttagccagtatctgcttatttagtgggggaagaaaagatgtttgtgaagggagcagtgcagggtaaagggaggggaactggttttagtcttccctttcagtattgtatttgtttccacttagggtgttattttctcttttggtcaatcagatgcagaagcgtgttccagagatgcttaggaaaataattatttttaatttttaagtagcaatgataaataatccatcttttgtttcctttatggaattgttaagtaactttaaaattttttaatgattaccagaggaatatatgtttattgtcaaaaactcaaacataacataaatgagtgacttcaaaaattcactgtctgcccatctttataactttataagctactgaattgttagtttgtaagtagggttgtatatgtgccagtttgaaatgattctcttgttttaagtagaagaacccatactggaaaatgctttgttattgcatagttgactattttagatagtaataaaattgcatctttaaaactgttttataagccatcatatgagctattctttcagttactctcaaatattgaggttttcccttttaatttattcatttactcttcgtttattgaatgtgttccctggcatgagggaaatagaggtaaattaagatgaagtctctagtgccaagaaattagtgtcttagtggggagagagatgtatagatatttaactaaaatgcagtgtgtaagtaggattgtcggagtcttgagaagggaattaaggattataatctgggagagatggtaaagaggagagtcacatttgtacttggttttgaagtatgaatagaaacttcaggcagccagtgacagaaactaactagttactatttcagattgcagagtttttattcagtaggatatacagagggtccccaacttgtgatggtttgacttaacaatttgttgacttcttgttggcacaaaagctatggcatgcagtaggaagtggtatgatactttcttgtgatctgatactctgcagtgtactgtattaccagataatttactcaactgtagtctaatgtaagtgtttaaggtaggctaggctaaactatgatgttaggtaggttaggtgtgttaaatgcatttcttctctttttttggagacagggtctagctctgtcatacaagctggagtacaatggcacgatctcagctcactgcagcctctgcctcctggctcaggcgatcctcccacctcagccttctgagtagctgggactataggcacatgccaccatgccaggctaatttttgtattttttttgatagagttggggtttcaccgtgttgcccaggctggtctctgtctcctggggtcgagcaatccactcgcttcagcctgccaaagtactgggattacaggtgtaagctaccgcacctggctgatttatgatattttcaattaaagataggtttattggaatgtaaccctattgttaagttgaggagcatctgtataaagataacaaaatacagtcattctgcataatgatatttcacataacactgaaatgatggactgcctatacacagtagtcccataagataacactgtattcttactgtttttttttatgtttagatacatttagatacaaaaatacataccattatgttgcaattgcctgcagtattctcattgtacgggtttgtagcatgaaagcagtaggctatatcccatgtaccctgggtgtatagtaggctataccatctaggtttatgtaagtacgctctgatgttcacacaatgatgaaatcatctgatgacattaagcaatgcatgactgtgttagagtataaaatagtaatgctcttcttgcaggcatataacctctaaacttcacttattttctaaacattttccgtacttgcagaatattctgtgagttgagagagctagattctagataatgctctgatactttttttttagtttgaacaagttatttaacatttctgggctgtaggttacttacaaagtgaggagatcagtggttcctagccagggatacataatagaatcctcttggaaggtttttccaaattccatacatctggatcctgacccaaacttaacttgaacagaaaaaaatccctgaaattgttccaatgttaactactgaaataactgaaatgtaaattcttaaatacctgtaatttcttttcctgctaattattaactgtggtgatttaatttagttgtctgggttataactaaatttctggaaggctgcacattggctgtctactagcaaaaccagctccatggtacttatttgctctcagcttctgttatgcttcaagctgtattttttggctttctaagccttgctagtcttattgattctaactcttgtaatcttaaatagatattccagttatctcacgtttttggaatacgcttttattaacctcataggttaagaggagaattaaatgagtgaatccataggaagtattggtacagtgccttgtagcaagcgtaagagctgaggaaatggtggctgttgttactagttctatttctggggcttggaacatagtggacacttaataaatgttcattcccccccacccccagattaaattaagctcaagactaccttttaggaaacattcctcactattctattttactgcctgatacagtttgacatctacttactgctaagacagaataattatttgtatttcagaagtatgtgttccacagtagtcctttaaataacaatttctttttaaccgcaaaggtatgacaatatatatactttaaaaaactgcaaaaacacctttgcttcataaactgagatgatcctgtatattggaagctgaaaactgtttaaaggcaacagtgacatatatatcttcttgtaaatggaatggtaattaataactcatttgaatcactaaatttttttcttttttttgaatcactaattttgaagtgtataatgggttgaagtttttcaagttcatgactttctcagaacttgtgtctaaaggacaataactgtgatttctatatttttagatctcaattattggctccaattaagaggtagttattgataaaattacattaatttgaaagcatttccaataatttcagtatactttgttatcaagcctcttaatccaagttactagcagtagattgctctcttttctttttacctacctaagagggaaagtgctaacttaaagcagatcggttggccaaaatatacatcataacacaggaggaaaaaaataatcggaaagctaactactgatgaatttgagtcttattttgctcttgatataaagttttccagtacttatggacaattttcatactgtaatattttcattatttaaaaaattggaacataaaataatcataggtatatattacttttacattccataatttcaggtaacgtctattcttcctctaggtattaatttcaatttgttgaaaactcagggaagaatctttgtccctttattccttcaattttgcaaaacgtgtggtgtttcttggttattaagtcaaattcctctttcgagtctaaattggccacattttgtatttttctcctcatccttgacattattcagatggggctggtttctgtgccctcacgaatagcattctcactctgactcctgagatcttgttcatattttttcagttaattcattgtactagaaaatcattttgttcttccctattttggcatttttccaattattgtactagaaaataattgttcttccatattttagcaaaggaatgtgttttattcctgagttagaatagaaattaaaaaataaaactgaagctaggcacagtagtagtgcgtgcttgtaatcccaggtacttaggaggctgaggcagaaggatctcttgagaccaggagttcaagtccagcctgggcaatatagcaagatgctgtctcaaaaaaataaaatggattgaactgatcagatttttaccgtgatagcaactgcttcctgaggttttaagcagcggaggttttgaataagtggagcatgtttttaaacattatttttgggaggggacatatatttttagatagtgttttggaatcaggtatgaatttctctgtaggtcctgtcagtagttgtgaaatcttgatcaagttacttaatttttcagaagctcctttcctttctgttgagtgataatttagataatttctaaagcataggtgttttgcacacaataattgcacagtaaatgttctttttacttccaacatcttttgtatcttgattattttgttgttttttttccttctctctctttttttttttttttttttcgagtcagggtctcactcttgcctaggctggagtttgcagtggttgtgaacagggctcactgtagactcaacctccctggctcaagcagtccttccatcttagcctcccaggtagctgggaccacagatatttaccaccacgtttggctaatttttaaacattttgtagagacagggtctccctcttgcccaaggtggtctcaaacttgtgggctccagcaattctcctgccttggcctccgcaagtgctgggattgcaggtgtgagctactgagcagtcttttttttttggtgtcttgattgttgcttaatctcttgtgaatagatagaggaattttaaaaatctgtattttttttttttggcatcatggtaagttcttggaaaaatagtaacattaaccatgtaaagttaagctgtggtatgtaatcctatgctgtaatagcttgaggaaaggcctcagtatgggggtttgtggtagagtggcagaaagatgtgttttaaagtcatactttaaaatggcatagggtctaggcttgatgtttctaatcaaagatgtttcttttgtggcccggataatatattgtgtagttttctgaaacatccttgtccttcatttttactgataacatcagatttgtgttttaaaaggaacttagagatattgaattgactactgacctatagttttttttttgtttcttttgagacagagtttcactcttgttgcccaggctggagtgcagtggcgcgatcttggctcactgcaacctgcgccttccgggttcaagcgattctcctgcctcagcctcccgagtagctgggattacaggcgccagaccatacctggctatttttttttttttgtatttttagtagaaacggggtttcaccgtgttggctaggctggtcttgaactcctgacctcgcgatctgcccacctcggcctcccaaagtgctgggattacaggcgtgagccactgagcccagcctagaattgtttttatggaaaatcttgtttccataattgagaactcactatgtgtatccatgtatataaagaagttttatttaaaaaaatatttggaacttatttattaactacatatgtgccaggcacctaaataaacagtttatgtgtatcttatcttttaaatattttaacagtgtaccctatgcagtaggtagtaataatatcctcaatttatgggttaggtaactgaggctgagaggttaggcaacttgcctaaggtcatataggctattatgcacttgacccaagagacaagggttttaattactatgtttaagtgtatcctttaacatcactgtaattttatctgtcacataaaataatcctgacttttaaaatattataattagaatattcatggagaataaagttccaattctgagaactggaaatttaagtatataaatatttaaatttattttagatcttctgaaatttgaaattatagtattttatgttttatgaaaatatgctgactcaagataaagtaaaacagggtacttgggggagtttttgttttttcaattctgtactttatgcatagttttctttctgtgtagtgaaatacctcttttagtcaattctctgaaaaagttttttttttggtagggctataaaattcagggatttagacatcattttacactgtattcacctttcctttttttctatttttgggagtatgggggatagaagtgctcaaatgtttaattgaattggtaatttgttaaatcttttgattacgtctttctggtaagcctttctgaaatatattagtctaaaatgttttgataactaagtttaattgtgtatttagtttttaaaaatttgatacttcaaaaggtgataactttgagttaaggattaattttgtgtaatattgtagatgtaatagaaagatatatgatttcaagtataccaatagcaggctgttttctgaaaatgcaagttgtgattttcttatcctcaaaatgaaagttttttgagtttgggtggggaataagatgaatttttataaactataacttctggttatttggaattttctatactgttttagtatggtaggaaaccttaaagtttttttaaaaatttttttgtagagataggatcttgctatgttgcccaggccggtctctagtttctgtcctcaagtgatcctcccacctgagcctcccaaagtgccaggattacagttgtgagccaccatgcccaatcagccttcttacctgaattatttgttatggttctttgccaggatatattttacctagctgataacttttagtcatgtcagtttatttttttcatagacttcttcttttttgcctaagtattccccatacaagtgtctctcttgttattaagcaaataaatcaagtaagtggattttagaaaaaagataagatggggcctagtacttctgtatgtattaacctcttatttttaattggcattttttgggagctcttggtatgccaaatactctcgtaaagtctacaggtaacactttcatgtagtgaacataaaaactttttagcataggttgtaattattatctgtttaacagttgaagaaactgaggcacagatagaatgacttgctcatgggtacacagctaagtgatggtgccaagattttaaacatggacagcctgtcttgaaactcaggttcttaacaattaggttaaactctgtacagttacagcaaatgtagactttaggctgtatttaggctgtatttagatgtttaggcttaaagtgaataaaggaaatatttgattgagagaggggattgtatttaatagttgcataaggaagttaacactaacttgctagttgtatatatatattatgataaagactgttactatgattactattcatattagacttggataattattatcatcattatagctattattaaaaagcagctagcatttttagagcacttatgtgcttatcattttgctaaatgctttacatggtttctttatctctcttctaatccttataataaccctgtgaggtaagtactaatttccccattttacagacgaagaaacataggttaggagatattttgtaatatattccaggtcccatggctagtaagtcatgaaaattgaaactcagccagttttattccagaatatttgtttttaacctttgagacatactgcctcccaattaagtatgttagataaggtccactgagcagtgtggaaaaggtaaatcaattccagggaaagcagattatatagtcctttatttttttctgaattttttttttttttttttagtttttagttttaagagacagagcttcactctgtggctcaggctgcggtacagtggtgtgattacagctctgtagccttgaattcctgatctcaagtgatcttctccctcagcttcccaagtagctaggagtacagttgtgcaccaccacacccttataatttttttttctcttaaagccctgagcttacttctctacaagctaatttaaaacatttttttgtagagacagggtcatgctatgttgtccaggctggtctccaacttctggctcaagccccttagcccccatttctggaattacaggcgtgagccactggacttggacaaaatgaaattctgttctttctgttttcagtgtaagaaggaagagctgctcatttatatatgtgtatgtgtgtatacacacatacgcacacacatacttgtttggttatcaaccaacgaagttgtttatatgtttacattcttaaacagtaaaatttgtggttgtgggaaatggatatggtgatctgtcattttcattatatgtgatagtccctaatagaggaatggatagctaaatttttcaatagttagaatatgaaagacaacacatatgaaaaaactgaacataatttggaatcactttaggattttgcactacctcaagcatgtttatgacacttgatttttattatgtgattatgtaaggcaatgctaatctatagctatttgtgtttgggcaaatttttagtatgtgattattattcttagctattatatttggggagaagaatataaattggaagattttaagaatattttaaagaaatgatagtctactcaaagaaagttggatatattttaatatttatgatgttgaaatggaatttacatagtagtaatgtcagtctggctaaagattatgaagttctaaatttcttaagattttgttttatttaattatatttgagaattaagagatttcttactgcattcctatttccatttggaaaatataggaatgttaacattgatttttatactttggcatggtaggaagttaggtgatgtttgaaaaatagttacaatttgagctgaaatacaaaagtcatccaataacaatttatttttattctcggctaccgtttctttttaaggtatgtaaaatttcactgatggttttgctcctgtttttatagctgcatgtagtctttattttccttctttctagtattattttaagttggtttagaaagagcaccaagaaactgacctgattgtacacgtacacagtagtgtttatatgaacagtataaactctataaatttattttatactaaaactcgctacttagaatacctttaaaattgtagcaccatataattctaatcttgttctgttattcatagtctgcagtgcataagttttcttctgaaacgtatatcatagtttgacaatcattgtttacacgtaattttctctctttttattacaatgcttccccagcaaggacaagtttggaaggtttgcaaagcttttcaccttccctctgcccgcttgcccgctttcagatcagtttcatgtttcataacttctctttctgcaatccacaacatagccatagtaaacaatggaaaactataaaattgcagtagtgtatttcctcacacatggcagacagatgtaactttccaaaggacacatccttttcaaaatgcaataaaaagaagttaaatagaaatgttataattttagtaattccctaaggaataacatctcgctagcaagcagttaatttaatgtcacgtaataaaacaggaacagtattcaagattatattctgtattgtaatagttcaggtagaaagttctttctaataataataccttacatttgtatagtgccttacagtttactgcagagaatgctgtactgctgatacggtcaaaacgtaaacatatccatttgttctgtgcttatgatatatagaacagatgtagattcattgtttgaagtgctgctggtatgatggaaaacagtgttgtaactcagatgttcagagaataagacaacacaccttagcactataaagacaattttagcagcttccagttcttttgaactagggctcttgtattaaaatgtttaaagtgaatgaggaaaacattttggaaaagacatttaaacataagcttttattttataacacttagaaagaaacatgtctagtactctactgaatatttaattttgtaatattttattagcttcagatgaatacaatcctacctcaaaccaagaattttttttctttttcttttttttaggtttgagctttttccttcactgctgttctgcgctaactgcttcgaaactttccatgcatttttttcagtagaagaacatctctgtactgtctcccattgcatatttcagctgtgacaatccctgcactttgcctattcattttatcacctgctcaccaaaaacaataaatatctctttaatttctaattgcagatttgctatttttgattttagaagaagggtgcatttcacttttttttattactgttgttttataggcatgtggagaccccaaggcaaaaccatcctatcttatcgacaaaaacctggaatctgctgtgaaattcatagtcagaaaattccctgctgtagaaacccgcaacaacaatgtaagttatctaaatttttctattgcttaattttaagcatcttttagagaaacagtggtcaacacagtgcttatagtagctcttatttacctaatttttaacattttgatatacagattatataccttaagggtttttttgagacaatattcttatgtccgagaccggaaaaaaataactcttaacgacattgccactttattacagcaaagatcttagattactatatatttattccctttcaaattgcaacaagagtaaggtaatagatatgtatatattccaaattcttgtgtggatacttgggatatttttgtttcttatagtcataaacttcctgttgaagttagtaaatgtctgcatagagcttctgttgttttaagtagttagctgtatttagttttaaaatgtgtttgtttttctagtattttcataattgacaatgatttctaaagattaaatagtacaagtaaatgattgtgttagggtctttattatctccatattacttttcatatgggaaagttttttcttagtatactgaagaatggtcatgttcagaatcttcctgatatgtttacatatctttatagtaatttctatgaataactacttttgggaaattagagttattttttgcctcagtgtggcatttttatataaattttgactcagaatctttctgcctgtcttctctttttatttttttctctgatattttcttgttactatctttgctgcctcttttgctttacatacaaatttagtttagaaatttcctctcacatatgatcttcataattttgagaagctctgttgaaaagatatatcgtcagctggtccaaaaatagtgagttatctcaattgattgttctgcgtcagttacagatccagctccttgttctactctttgcccccttctcactactgcacttgactggtttaaaaataaaaagatacattgtcacctttttgttttctcaaatcatgtatgttcattgaagatttgtatttagcctgttgatacttttgcttaaaaacgcttccatgtagaaagaaaatgctagtaagaactaatacaaataagtcagataaagtgctttttaaggcatttttttaaacaaaatcaagtctgtttttggggagtacaggttagtagaggtttcataaaagattgtttttgtagagacgagatctcactatgttgtccaggctggtcttgaactcctgggctcaagggatccttctgcttcgacctcttaaagtgctggaattacagacatgagctgctgtgcgcagccagaaatattgttttataatatatcaatatattaaagcattataattagttcctgattgcaaaataggtgattcaaaacttgcacttcttaacacttttgtttgtgtggagaactcttttttagttactgacattaattggctacctcatctgagagattatatactcactctaaaagagagattttgttatgaaaatctgtcttaaattaattttatatacacttctttttcttacagctcataaaatttctgacatgagctcttcagagaatctttgaagcttagtttacacatgtgtttgtgtgtaaacttatatgtgagaatatgcatcgttccttaatattaggtctttccttagaattagaagtatctggtgaaacaacagtaaaattgtctgttgtcagcagaccaattaagcatctgctgttcttgatatgccgggcaaactgtttattatcatcctgttgttttttgttttttgatagttttacttctctttctaacttttgaagcacaaaatcgatatttttaataatagttttattgaggtataattcacataccatataattcacccattcaaagtgtacagtttcagtgttttttaagtacattcacagagttgtgcatccagtaccacagttaattttagaacattttcatcaccacccaaagaaactttgtgcccattagcagtcacccctgatttcctgccaacacccctgccctaaggcaaccactgatgtactttttctgtctctgtgcctattctgaagatttcatcaggaataatgtaatatgtggtcttctgtgactggtttctgtcatttaacgtaatattttcaaggtttatccaagttgtagcatgtatcagtattttgtttttgttttaagagacagggtttcactctgtcacccagggtagaatgcagtggcgccatcatagctcactgtaacaccgaactcctagaccaaaatgatgttctcatcttagcctcctaagtagctagggccacaggtgcgcaccaccatgctcagctatttttaaaaattttttttaattttttatccagatgtggtctggctatgttgcccaggtaggtctcaaactcctgggcttgagcagtcctcccactttgacctcccaaagtgctgagattacagctgtaagctgctgtgcccaatcttcatttctttttattgccaaataatactccgttgtgtggatataccacattttattcattcatgagttgatggatgtttggattgtttctacttttttgcctattatgaataatgttgctataaacatttatgtgaaagtttttgtatggatatgttttcatttctcttggctttataaacctgtgaaagaattgctgggtggcgtggtaattctgtgcttaacctataaaattgattgtacaatgttgttgaatgttatgacttacttgtagtatttactttgttttgtttgcaaagcctgagttttttcatattgcctttacaactattctttgtaatgctactctgttgttttttttacctgctgaagtactatgtattgggcatatataaagtcttgtgatctcagttttgatctgggtctgctaaaattttggtgagaagttcctagctagcttggatcaggacatgagaagtgaggtttcagttctattattattttttaacttattgaattagttgatggagcttaaagactggaaaagatagtagcgtctgggattgataggaggttgcagatttctggctactaagtgcactgtagaagtggtattgatatcagtcttttctttctttttttcttattcttgtgctttggattattatgtaaatatgtgaaacagaacatgcttactttttcttagggacctaggttattactatttctactctgattcatgtcttacaagtaacacatgtcccccaatttcagaaaaggtactcataaaaacagatttctggtgaaaatgcaataaatttttttttcttttttttcttttttttttttttttgggacacggtcctgctttattgcccaggctggagtgcagtggagcaatctcagcccactacaacctccacctcctggtctcaatcaatccttctgcctcagcctcccaagtagttggaactacaggggcacaaccaccacacctggctaactttttgtatattttgtagacatggggtcttgctatgttgaccaggctggtctcaaacttctgggctcaagtgatcctcccagattggcctcccaaagtgctgggattacaggcttgagtcaccatgcccagcctcaaaatatttattttttgaagtttctaaaatggattcttgcaaaattctgcccttatcttgcagctaaaaaattgttgattttttattttgttttgtttgttttttgttttttgttttttttaataactgccctcacctccatactttttaatccctttagaatccttgagcacatagttatttgatatgcaacaaaggaaggcactgctgacaggtagcaggactggtacacaacatgacttctacagtgatgatgttggactctgttgagtcatttttactttcttgtttgtgaccagttgtaacaagttttatatttccgattctgggtttagggaaaatctaggaccaaggaatgaggttttttccttgggtcatgatgttgaactaaatgcctcatgcttcagagcaagctgattaaatgaaattcaaaatgaataaaagccataccagttttataattatagcagccacttgttatctaatgtgtgccaggttatgtgtattaatagagttcctcatttaatttcagattaagccaagtatttttgagctgaaagattatctaatttatctgtaatataaatgctttcattattttgaaagtgtaactctcaaatgaaatttgtttctcgtaggtttcttaagggtacctggaggggaatctgttattttcctggatgaagaaaatagtagaaactcctttcttattttattaacacatacaaattatttggctcaggaaacctaaaaggcaatgtaagcaaatgttcaggtgtatgttaaaacttttctaattttttttccaatattttttaaactttttttttctctttcctatattgcattacacctaaaaggtagtttgtgttttttaaaacagtaaaaatattatctggcacaatagtgttattatggaattagcctattgcacattttaatgtaaaattttggatttgatatccaaattaatgaggaaatgataaaaattactatcctatgtatgctgaattagatcttgaagtctttaagaatagggacattgctggcgagtagagtgccacaggagtgatatagggattctagactaggacacaggctgttgttgaaataatttgaaaattatgttttcctaagttataggaatcttttatgttatagatattatttatcccctctcccaaggaacatagaattataagatgttatgtaaaacataattttttattgaagtagcttataaagtcactctaggaaagacaaagcaactctaagtgtaataatcagcagtaaagttagttcagaggcgaagcaatagagccttttaaaaatgttttatccctagtgcctgacacataagaggcactaaataaatgtcccattaatgaatggaactatttgatacactctaacataaccagctttcacttgtattcaaacattgctttagatttatgtcaggacctgaacttatccacactttttaaaagttatggagttaatgttagctaaaaaaagattgtactttttagtagaactattcagatatatcttattaatggtattattgaaagtcacccagaaatagagcaagagtctcaactcctaaaaacataaatgtgttttaggggtggggtggtggaattggtgataggtgtagggaggcccttgacacatgcatgcactgtggtttggtaaggacttagaaggaaacagtaggcatatttaactccttcttaacttgtctttaagagggcattccttgttttgtcatgactcctattaagatagtaacatactggttaagaggatggactctggattcagtaaaccagaatttgagttctggtctttccacttattagctggataattttgggcaaattatttaacatcttaaggtatcattgttcttttttgttttgtttttttgagacggagtcttgctctgttgcccaggctggagtgcaatggcataatcttggctcactgcaacctctgcctcccgaattcaagcgattctcctgcctcagcttcccgagtagctgggattacaggtgcctgccaccacgcccgcctaattttctatttttagtagagacgggtttcaccatgctggccaggctggtctcaaactcctgacctcaggcaatccgtccgccccagcctcccaaagtgctggattacaggcatgagccaccgcacccggccaggtatctttattcttatttctaaaatggtgataataccaatctcaaggagtagttcattgtttcctaaagcacttagtacagtgtgtgacaaattgctcttgaagaatggaagctgttaacttaacatttacctctttgactttttggactactttgctggcttttcttctgggtaccctttaaatgtgggttttcctaaatgacttctccccccatagtgtatatgtgtgaaaacacttactgctgtggcttcaactaagtacatatacgatctcctatattctgtgctctagatcagggtccccaacccccaggccacagacaggtaccagtccgtggcctgttaggaacccggctgcccagcaggagatgagtggtagtaccctaagcttcatctgtatttacagccactccccatcactcacattactgcctgagctctttctcctgtcatattagcagtggcattagattctcataggagtgaaaaccctattgtgaactgtgcacacgagggatctaggttgcgagctcttgaggagaatctaatgcctgatgatctgtcaccgtctcccatcacccccagatgggaccatgaaattgcaggaaagcaagctcagggcttccactgcttctacattatgataagttgtgtaattatttcattacatattataatgtaataatagaaataaagtgctcaataaatgtaatgtgctttagtcaccccaaaccaccctccacccctccgccccagtacatggaaaaattgtcttccatgaaactggtccctggtgctaaaaaggttggggactgctgctctagagctgaattctagctacccctttggacagctccacaagctaaacagaaaactttttatccaatatggaacatgtgattatcctacctttttttctcttttgtgtttccccccttgagctgtcaccatccacttagttatttaaactacaaccttcagaatcccttttgacttgtaaaaaatatcaaactggtcatttacgacttgtccgggttccccactataatgtcatttgaatttatccccttcaggtctacatttcctgccgggacaaatgccatgttaatccaaacattgatttgtatgccatccaatctctcctactttcgccctcccttcctccctccctccaacctccaccaggggaagcagaacaaaacaaaaaacaatcactttctctgtggtaccccacatctgcatcttcctggaccacgcactcatctttgaatccctcttgactggcatgtagtaggccaacaaataagagtttggtttagaaggaatcaccttactgtaaaataatgtaactgggagttgtaacagcatgctgggagttgtaacagcatcatgaataaatatatatgccctaatggaaactcaaaggaatatttggtcccgaccaattaaacattgccaggatttaaggaattttgatacaatgagaattaactgaaatgtcaatgttcttttaaaaagatatcatcagtattgagttgttaatgactcttagacatgtaaaagtctttaattctatcttgaacaaacaataaataaaagaactcctcaggagatgcaagtaagccttgctttgatatatttggaaagtaattgaaataggtcaaatagtggcagggaattgcatcagcactggtgacctacctaaagtgatttaaattttttgttttttatttttgcccaaagaacatgaatacatgataatgaatagtccagaagaatttaggatgaaaagtgaatatctcctagtttactttttcccaccctagtcatattcctcagagggaacttctatttttagaatttctacaggttactgctagaactataacaaatatgcttattcccttataacttcagttaccaactttagacagtgtctctcctatgcaacaaaagatgaggatttagcttgctcaatttacttccccttacttcccctctcaagcctttttcccagtgttttttgttagtatttttggatcattgattacttccttttttaactttaatatagttttttttttttatatcctcacccttggttatttatccatttgtccttttcttctcatgttgtcaaaattgttaatgcttttttttttggttctgtaattatacagtgttctgatactatatttattatatgttggttgaaaaaaattaaatattaataaaggcctaagtgcttggtttggatttctttattccattgtcacactttgggctgtaagatgaataatatatttagccttaaagagaaaaggaatctctcttcctaaattctgtcatttacttaaaattattttacagtttcatagttataccatgactttctgaaattatagttataagcctttttactttctttaaatttatttggccttataatcatgtcacctttttataattttttttttttcctggagcctactttcctctaaccttctgtcttctaacatcaatctagataatttgtaaaagcctgctgtgtagctttcattatgggttatagctttgtcttcagtgtgatgattttacctgcgcttttccactgaattttcatgagtttgagaatcccctaaagttgcatatagaatttgtgtgtgaatgaattattaagctttttttcatattctcaagggtggttcttatgatcccaaaacacatctattttaaaacatctcctttcttatcctttttatataattacctgtggtttcagaatattattttgtgcatcttatgtgctatatatttttgtcatactaaactatattcataacctcttcaactcaaagagactttctgctttcctggaaatgaggctgccaatgagcattacactggggttccatagcatagccttcaagtatatacatttctggcatctgtagtcatttttccatactcttcaaatttcctgaagttatgtcttgcctgtaagtgatagtttttcagctttcaaacagttgttggtccatttggctgcagtggtgattttgatgcccttcatagtagcagaggacattatcactacctaatcacctattgacctttaactttggtttccttggtcatttctttggggcctttagccacttttaaccttgtaccttttaagtacctttagcatgttatcttctcattgtttcttcatggcaggttcagtactaccttttgtcagatctaaagttaattgccaagattgaaaataacacagtaaaagctacaatggaataaataacacatgttgcagagtacttactttcttttattcttcgtagtactcatcttggccaagaatattttaaataggtacattaatggtccctggccaagagtatgcaggctagtatactatgttagttcccattgtctagtgtaggatagaatgtagaacctaaggaaaatatatttgcttgctttatttttttaaaggagtgttgtatttggggaaagtatgtttatactttcattgaacaaatggccatgtttcttttgcctcgacttttttttactatctggaatagtctctctttcccatgttctttcactaggctagcttgtctttcaggtctgtgcttaaatgccaccattcagagaagctttccctgacctttccaaattagtttaagttctgcatatgtatgtttccatcacattctccactgattattcatttatttatttaaatcctttattgagcgccttctatgagccaagttctgttctggaagagaggattccagcagtgaacaaacagaagtctctgttcttacagagcttatattatgttgaacagaaataaataatgaacaaataagaatataataccaggtaaagagttctaggaagaacaaagcagggtaaaagcataagactaatgcctggcagatgtaatttacttagggtgaccaggaaaggccttactgagaagaaagcattagggcagagatttgaagatatgagggagtgagtttagctaggggaggagcattctgtgctgaaggaaccgcagctccaaaggctcaggtgggtgcatgcctggcatgttcaggaacaaggagggcattatgagcagagtagatgattgaaggggacggtggtaggacatgaagtgccagtggttgtaatgaataggcagatcatatagggctttctggaccatagtgaggaccttagctaattaccctgagtgtgttgagatgccataggaggggagtagtaggggaatgaagtgatatgactgtgatcactatggctactcggtagagaatagtctgcaggagagcaaaggtgaaaatagggagaatagttaggaaatttgccatcattgagatgagagctgatggtggcttggactagggtggttgaggtgagaaatgttcagattctggatatatttttgaagacagaacctatagtatttgctgatgaattgggtgttgggtgtatggacagtgagaaataagactttaaggtttttggcctgaactcatgtcaagatataatggggtgagagaacaggagaaataggtttggggtagtgcagtgggagtagtacagtgaatgcagtgggggaagtactcagtagctcaatattagacgtgttaagtttgagaggcttactggaaatctgagtggagatatcaaatagccaattgtttatatgaatgtagatctcaggttaggtttaagctgactgtcaagttgaagaagattattgagggatttgagagagagagaaaggaatggaataatcatctaggacagtaggaaaatgaattgacagaaaagtttgagtagtattgctactcagttgtggtcaatgatcatgaaatcaggttgagatcagagtcagcaaagtatatgcttttctgctactgtaggttttatcagacagttatgaaagagggagggaagggcaaggcagtaattataatgatgggccatttaaagttaagatggataagaaagtagggggcctgggcacagtggctcatgcctgtaatagcactttgggagactgaggtgagtggatcacttgaggtcaggagttcgagaccagcctgaccaacatggtgaaaccctgtctctactaaagaatacaaaaaaaaaaaaaaaatagccaggtgtggtggcgtgcgcatgttttcccagctacttggggaggctgaggcacaagaatcacttgaacctgggaggcggaggctgcagtaagccgagatcatgccactacactctgggacagagtgagactctgtctaaaaaaaaaaaaaaaaaggcgtaaggggatgagtgacagtaaaaagatggtagagtgaatggataggaggtccctctgtgttgaaagaatttgtggaggcagagtattacagattttaagtgggaattattctcccagtgatgccacctcactttgtctccaaatctcccaagaacaacagatgtccaaaaaggccagacagaagccaggataatttaaacatcagctttattcctgtttacaggcttgagaaaacttaacatcagctgtcatgccctctgtcagtatgtattcatgtaccaaaaatcattcatgggtacctactcagagcagcctctcctttgacttccctgttttgctcagcattttcaccactcttagaagttctgacctttcttattgtggtctttatcacactaatgtgtagattttgtttttattgttacccttttcatgttattgccagttggtgaaaacctttgtcttgaagggaatatgggaattgatcatagtagtttttcaccatctttaaaccttgcacctagaagttaatcagcttcaaaaactggatatttaccttaaaaagaacaaaaaagccaaccaaaccaaaaagaaaaaacaattgggagttccctgtacacgtatatacacatccctcactagacaatgagcttgtttagggcagggtcagtacattattcatagtttttctcagcttctcccacaatgcctggtaatataataggttaagatatttgttgtctgaataatatgttattacagtaactcttcacttatctgtacttttcatgtcacttgcctctttgaatcatatctcagagttaggaagaaagcaattccacttctgggacttatccgaagagaaatgaaaatatgtctacccaaagacatgttcatagcagaatttgttattcatgatagccccgaattggaaacaattcaaatgcctattaactgacgaatgaataaacaaaatgtagtgtgtacatttaacagaatactactcaccaattaaaaggaacaaactacgataaacgctataacatgaataagtgaagctagatgtaaaaagctgcatattgtctgattctcttttataggaaatgtctagaaaaggcaagcttattgataaagagagcaaatcagtagttgcctagggcttgggagtaacagcaggattaactgtaaatgggcacaagggtttggggtgatggaaatgttctaaagctggatagagtgaatagtttcacaactctaatttactaaaattatttttcacttatgggtaaatttcatggtaagtaaactgtaccttaataaagctgtaaaaaaccaaatgattttgaacaactagaaatgtattctagaataaatgaagtttattcagagaaaagcattttggttctcctatgaccaaacttgttgagtccggttaggcaaaattgtaacaagtatattttctaacacactgtacgttaaaaggaactctcatcaggagcaaatgataattgatagagaaataaaaactcttaagtatagcaggcaaggaccatttaatgtcagattatcttgtacaagtcagtagcatctgaggccatcttgacataaataaatctgtataattatcaattacaatgatgacatctaatcagtaagaaaagcttgatttatgcctggtctactggttttgaaagtaagttaatcacatattagaaaggttttaaaaaattattaaaattgaatgtaaaggaactaacctatttatatttctatttgtaatggaaaatagtgccattaagtgaggtaaattgtgttatcattaatgcaatgtgataccctttatacaaaaatgttacacttgaccaaccccactataccacggtatataattagtgatttttgtagtactgatgataaaattaatttcaaagtttgctttaatttgaccatctatagccagaatcttaaatttccaaaagttttagctgaggcacattaatgtgctcaggtggtgaaatagaaattattttaatctatattgctgaacttgatattaattgtgtcagttacctattgctgcataacaggtcacctctaaatttcatggcttaaaacgacagcagcttgtttcttatgattctgtgggttgactgggtagtttctctgctggtctcactggttttaggttaccgcagtgcattccactggtgcattctgggggatgggcccagctggaacagcagggatgctgaagtgccctttctctatgtgatacgatatctcaggcttcctcacatacagcacgtcagggcagtgttccaaaagagcaaaatcagaagttacaagaccttgccctggacttagaagtgactcgttgtttctgctgctttctgttggtcaaagcaagtcacaaggccagccaagatgggaagggtggggaaaatagacaacagtgcttaatggaggcagtagagttctattgcaaggaggcatggacacaaattttaagtttttttctttgcctttcagttctttaatagaaaactctttgtgcattccagaattaatttaaacagaagactagcagtgtgaacttagagaaacataaccttaattataaagtgaaacagttgaattagattttttagaagtttaagtctgtgtaattgattataatataattaaatacaaatgttttctttagcttgtccctacgctacttttatgtcattgtatagcaacttgaatgttgaagtgtattgaagaagtgtttcaagttttggaatctcatagacccggattggcatcttacccttttctggtctgtttctgtatctggaaaatgaggactaaaatgtattttgattgagaagatgaaaaccatctggagatggatggtgctgatggttgcacagcagtgcaaatgtgcttaaagtcactgaacggcacactttgaaaaggttaacatggcaaattttatgcgtattttaccacaataaaaaaagtaatgtaccttgaaaaagtattaagaggattcaatttagtatacatcttaaacactcagtaattcagtaatgcatattttactaggctagtgttaggataaccaaccttgcttgcttgcctgcttgcttgcttgcttccttccttccttccttccttccttccttccttccttccttccttccttccttcccttccctctttcctgtctccccctccccctccctctttcctcctcccctcccttcccctccccttgttgcccaggctggagtacaatggcacaatcttggctcactgcagcctccacctcccaggttcaagtgattctcttacctcagcctccagagtagctgggaccacaggtggctaacctgccatgccggctaatttttgtatttttagtagagatggagtttcaccatgttgtccaggctggtcttgaactcctgacctcaggtgatccgcccacctcggcctcccaaagtgctgggattgcaggcgtgatcctccgcacctggcctggatacattttcctaaaatatatttactacagtttcctcagaaaaatgcatttttgaaatatttactgccagtataatcactttgtatatgaaaaaagaaatacactacaaaagattttaagtaggagtctaaggttcttttaaaacatgactattctttgtgttaattagaatttttaggtaatcttaagagatttgcttatatttgatatgcatatgtcagtctctatggttgccactcatttcttttatgctttcctttgctggaaggacataatgtgaagtattttacccaactttggggattttattcaagggattaaatcaatttagaaactcatttgagacatgaatttatacctactgtcaaattcatttatggctagcaatgaaattttaaaattggtagtatctactctccctcactgaagagaagtgaggtgagggagtaagctgtgctcagaaatgttgaagagcaccccagacatgagaaagaacaaatgcaaaggctctgcgatgggaacatacttggtgaatgcaaacacagcaggaagaccaatatgataactatactgagtgagggtggaggagcatgaaagaagatgaggtcttagagatagacaagggctttgatttagactttattctgaggcactggtaattatttttttattctaattgtgaggtgaaactgttggaattaaaaaatgatttttgtattgaaataatgttagagttataaaaactttgcaaaaatagtatagagaattcacctgtattcttcacgtgctgttaaacatcttgcataacatcagtggaatcagtttttttagggtagtgtgttgctttaaaatgttcactgtggctgggcgtggtggctcatgcctgttatcccagcactttgggaggccgaggcgggcggatcacctgagaggttgggagttcgaggccagcctgaccaacatggagaaaccccatctctactaaaaatataaaattaactgggtgtgctggcgcatgcgtataatcccagctactcgggaggctgaggcaggagaattgcttgaacctggtaacaggaggttgcagtgagccgagattgtgccattgcactccagcctgggcaacaagagccaaactccgtctcaaaaaaaaagaaaacaaaaacaaaaaacattcactgtgctgctgctatgtggagaagattgaagaggcaagaggagaaatacagagaccagttagggtgctaccgtaggagtccacatgagagttgatgactagggtggtagctgggacagtttaggcagagatttacccaaatagcatctcagtgcactcttactttgagcagcctggcctagaatatcatactaagaatttgaacaaagcattccttgaaaccaaacttctgaatttggtttttttttaagaggaacaaatgctagcaaaacttagattaagaaaaataatttatgaataagcagtttcaataacaatagaaggtaataattgaaatgagtgaataaaaactacccacgttcctttgtattcagtggtttagctcgtaggcactgattccttatggtaatttgccattgctttttctttggaagaatgaaatactttaggatttagaatacataataaatttcaattttctcgatacttatatttgtgtggaaaatgcttcttaattgaacaaagattaattaccaggatttttcagtatgaagataggttctttgccataagcatgcctgatatttatcctgtttatttccagtttttacatattttacttgaatatttagaataatgacccatagctagaaagtttaaggaaagcattatacaaattctttgctaaaatatttgcatgtatcacatgaatatgcttttataagtattagcgtattgaggccgggtacagtggctcatgcttataatcccagcactttgggaggccgaggcgggaggatcacctaagattaggaatttgagaccagcctgaccgacacggtgaaaccccgcctctactaaaaatacaaagaaattagctggatgtatggtgcctgcctgtagtcccagctacttgggagggtgaggcagaagaattgcttgaactcggaaggcagagattgcagtgagccgacatcacaccactacactccagcctgggcaatagaacaagactccatcccaaaaataaataaataaaatattagtgtagtgaatagaatcaattttttctcacagtagtacttttctaatgttctgttgtataacatcaaacaatgtgttacctatgttcttaggccattttctgctttttatttcctataaaacaatgtgattgaattaagaaaacttggttctagatattaataatttttggtagtatctactctccctcactttaggaactaaaatgtagcattttttgtagttgaagcaagagagttgtagacacttttgttcttcattgttgtagttgacctctttcacccaggctttatggaatttattttcactaaaatggggaacgtgattgcatagagatattgagaggattgtgtgagagacctgtaaaatgtttggaacaatcgatgcctgacacataatgtatgctcagtaaatatcagctcttattagaaatactatgggtaataatggggaatattaaagttttattatatttattttgaagaagtgatctgcaagcttcctttgttattcacttaatatttaatgtacagcttctggctgtgaggcattgctacatattcttatgtacattatcttggttaattgtccatgtcagcttccatttcgatgaggagggtattaggctagagatgttaagtcatttaaccatggttgcataataaggtatgctttctagcatcacctaccaaaacatatcatctgacactggtagtctttgaagtttgtcattataatcccttatctgatagatgtttgcattggatacttcctttgtccagaactgtatgatatggactggggaaattaaaacttgagtttggtacactgtctaattgtgctggagatagctataatagaagatagaaagtgatagctgctgttagacattatacatgtttagaggagggagatgttagcatttcagggaaggagtgcaatcaggtgcggttttctgaaaatgggattagcatttaaactaagtgctttaggaatagtggggttgggacatgtttaaatggtgggattctgacattccagtagaggaacagtaagaaagcaggaggtgtgtatagaaaatagtgaatagattgttttggctaccgtatgtagtgtgtgaatacatgtaggggaaatgtagattggaaaagtaagttagggccagattgtggagggccttgaaagctagactgttttgaatttaggcatctagtagttgtttgataaatgtttgtagctaagtagagtctagttatatatggctttgggggaaataaagttgaatgagaaatgtagcctatgagattgtattaaaaagggagatgatgggcatgtagaatggtagaaagaacactttcagaagtaaagagatgagatttccaatcttggctctgtcattaagtagttgtaactttaagaaggttcttttaaggtctgtaggtcttaggttcttaatatggaaaatgaggtttgtatttaagaccatttaaggctcatagtaagatggtgaccgtattatttattgttcagactaggacactgaagttggaaggaaaggggacacaattagtaaaattatactagggcaactaaaataaattgggattattaagcccaatataaaccaaattatacccttcatatcttactattatgaatgtactttcacctgttgtattttgaaactcaagtttaaagtactgaaaagcaggaaaaaggactaagacatcaattctaaatgtttaatgttgtcgaataaggtaataagtattcactttatgtttttggagtagtaatgattaaaatgtgcatataaacatggaatcgttctgaaacagataatgttgtgcaaaatagagtcagctactctcagatgaagctaaaaatagtcactacaagtatatatcttaatttgtctggtatttaggggtagtaatgaaatatttcatttgtgaatattttcttttttctttttttttttttgagatggagtctcatctctgtcacccaggctggagtgcagtggctcgatctaagcttactgcagcctcctcctccctagttcaagcgattctcctgtctcagcctcctgagtagctgggattacaggcatgcgccaccatgcccagctaatttttgtatttttagtagagacagggtttcaccatgttggtcaggctggtctcgaactgctgacctcaggtgatccacccatcttggccttccaaagtgctgggattacaggcttgagtgtgaatattttctagatagaattacttctttaaatgtcttcagggagtgcaatatttagggtggtttaccctataatagtagggtcttccagactgctgtgcttgctgtttttttttttttttttttgcttgctgttttaaataggtttttcgtagttaaaaatatatatatattcctctgatgttaggctcactgctgtaaattttctgacttaccatagtggttcagtacaattatgtatggatgcatcttccccctaacgttcctgagtgtaattcagaactatatggaggcctcagcattgtatgggctttgatagcaaatctgctattttgagccacttatattttccagttttctcatgttctgaataaacttctcacacatttaatgtgtgtttacaacacctgggtatcttgttaaagggcagattcagattcagtagatctgaggtaggcctgagattctgcttttctaacaagctcctgaatgatgtgggagtggctattcagtaaactatactcaagagtgtcaaggttctagatcatttattggaattctgagaatcttatagggcattaaaaatagctagattcttttagaaattatatcaatagttgattttaaaagaaaaattgggacttttgtaaatttaattatacagttgattaaaatactatttgtctttcaacatttccctctttcatgtcttaactctagttttgcttctttctcatttcttttttgttgttgtggtttttgcttttgtttaatatattattgtgttttctggatctggtcagggaaccgttaccgtattttatgtttgtatctacattttattttgcatgcgtaacgtggctttacctggatgttctttttggtaagttccaaatttatatagcatattgtttttttgtagtgtgagttgtaatgtttttcaccttcttttctcccacttctagtaatgtgatcatgctcatgacttgtttttaattttttaagagttcatttgatactttttttcctaacactttcagattttccttaatagtagcgcaatttggtactaatatgctttgatttgttttatagcctcacactgtcagttgctgatcactattagcagttgctgtctcgagtactttggttttttaaaaagccgtaatcatctagaaatattctaaaagcttgtgcttccatatagcagtcataaaagaagatagtttgtagtaaaattaaatacttttgttctctatgagcaatgcattctaattttgtttttacagcaacagcttgcacaactacagaaagaaaaatcagagattctgaaaaatctggcattatattacttcacatttgtagatgttatggaatttaaggtatgtattttaatatataatatttaacacttcagaagtagatttaaatgtttattaattgtgtgaattgctgtgtcagttgtaaataataaaattgaaattcttccagaactgaagtttaacacataccttatttgtttgtgttttctgaatttaaacagatttatacagataaaagattaaaataagtatttcttttcaggaccatgtttgtgaattgctgaatactattgacgtttgccaagtcttctttgatattgtaagtatcattttcagaaaaatgtccaattattctgtttccagaagagctcaggggaccacttgcttttctttagctagattatgtaactagcatataaagttttagcattattaatttggcttgttttatagcttttttaaaaagtaaagtgtgtattctttttatttgttttgattgtcactgagtataagtcttgtacatattgggaaatacacgttaactttagtattttatttaataggcccaattttgaaaagttaagtggataatattttctctgtaaaaggcatacttgatggactctttcttagtatgataatttttagatacaagaagtcaaagtgaaaattgtctccatttacttaatggtgaactttaaaaaataatttttttcctctttcgtgagattggcaccagtgttccttattattctggcttttattcttttgaactgttaccagtttgaatatagtgatcacaagctctttttctttcatccataaaattgtgtcagacacaaaactgttatctgtaactgtcaaattttagatgtgcttttagtgaaaggaattagcattttagaacagggataaaataaatacagaaaattattagctctcaatagcttctatgaagattttgtgtgtgtttaaaattttaagaaataggaagtagttgaacttgatttttttttctcctagactgtaaactttgatttaacaaagaactacttagatttaattataacctatacaacactaatgatactgctgtctcgaattgaagaaaggaaggcaatcattggattatacaactatgcccatgaaatgactcatggagcaaggtagatttgcattataaaagtctttctaaaatgctcagtttgatggattacaactcattgaaatttgatatgtctgttttaagtgacagagaatacccacgccttggccagatgattgtggattatgaaaaccctttaaagaagatgatggaagaatttgtaccccatagcaaggtaagaggcagttgttaggcatatgagagaatgggcatataacatagcatgaggatggatggttggataaagggataatcttgtttttgaaaaatactataatgggatataagtaatagttatgtgtgcttttatctaattatagacagggaactaattaatgagattcagaatagtgtatagagactcaagaatatattgattgatttcattatagttttttagattttaatatagcactaaacaataggatttaccatatggtatttgagagggtctgttctcacactaatgggttttaatagcaattctgcaaattatagtataatatttgtcgagttacttaactaacctcacgatacctcagttttcttatcagtaaaaatggaataataatagcacttatttcatatggttcttatgagaattaaatgaattacttcattaaaaagtacagtgtttgataaattttaactttattatagtctcaaaaaatgacgggttttatgaaaataatttgaaatgactatcttttaagagatattaaaaatagttcttaatgaaataagtttggttgtaagtagtcttgtcattatggattctctgcagaagggctgattcacagaatggtagtttctgaacacttcaaggaaattcataggtatcttatccagtctcattatttatagctaaggattaagggctggagcagtatcatgacaaggtaagtcatttggtaacaatagtggcaaaactagaactgaagcccaggatactagaatcttggtctacattgttctctttgaatcataaaagttaaactatttaccttgtgtaagtctgtgcttttttctttctttgagacagcgtctcgctctgtcgccccagccggaatgcagtggtgcaatctcagctcactggagcttccgcctcccgggctcgtgattctcctgcccctgcctcgagagtagctgggattacaggcatgcactaccacgcctggctaatttttttgtatttttagtagtgacagggtttcaccatatttcccaggctggtctctaactcctgagctcaggcaatccacccacctcagcttcccgaagtgctaggattacaggcatgagccactgtgcctggccactgtgcttttttcttggcatacagttaacaccaataattttctttgaatttttttactcccatgaaaattctgaagaattctttccagatttgcatagctacattatacacaaatttatataggttttctgtcttggaattggttgaatcattagtttgcaagaagctagtagatggcatcagttttgaaatttaaaaaaatcagcattttagatggaagtatcagaattcctcaaaatactgcacatatcatggtcatctcctatctctaatatcagtagtggtttttccccacccggaactgtcttttctattcctctcctcttttctctctggatccatttaggatttttccctaatcatgtatggtcttgtttttatttagctattttatatttggttctttctccacttaggtgttgaaaatttccttgacaggctcttgaaaattccaagctaggctctcggctttttaagttctatataggcattagcacattaacaaattcagtatatagtaggttattgataattacataggataattcatttgaatttagaccacttattttccaatcttgatttttttctaatattccgtgataccttagaattttgataaaacactattttttatttgccagggtttgttttcctgtttcttgtttagattcatggggtacactttcaggtttgttaaatgagtatattgtgtgatgctgggtttgggcttctaatgatcctgttgccaaagtagtgaacatggtacccaataggtagtttttcagttcttatccctctccttcccacttctggagtccccagtgtctgttgtttctttgtgtccatgtgtacccaatgcttagcttccccttataagtgagtacaatcagtatttggttttccgtttgtgcattaaatctcttttgataatggcctccagttccatccatgttgctgcagaaagacatgattttgttcctttttatggctgcatagtgttccgtggtgcatatataccacactctctttatccagtccagtgttgatgggcacctgggttgattccatgtctttgctattgtgaatagagctgcagtgaacatacgagtgcaagtgtgtttttggtagaacagtttattttcctttgagcatctacccagtaatgaaattgctgggttgaatggtaattctatttttggttctttcagaagtcatcaaactgctttccacagggtttgaattaatttgcattaccaccaacagtgtataagcatttccttttctccagtagccttgccaacatctgttatttttttgactttttaatatttgccattctgactggtgtaagatggtatcccattttaccagtggttttgatttgcatctctctgatgattagtgatgttgagcattttttcatatgtttgttgggtggttatatgtattcttttgagaagtgtttattgacgtcctttgcccacattttagtggggtggtttgattttttcttgttgatttaagttccgtatagattctggatattagtcctatgttgggtacatagtttgcaattattttctcccattctgtaagttgtctctttattttgcctttgctattcaggctgttttttggttccatatatattttagaatagatttttctaattatatgaaaaatgacagtaatttgattggaatagtgttgaatctttaaactgctttgggcattattgtcattttaatgatattgattcctccatcccatgagcgtagaatgcttttccatttatttgtgttatctgtgatttctttcagcaccgttttctagttcttctcttagagaggtttcacctccttggttaggtgtataggtgtattcctagttattttatttttttgtggctattagtaagtgggattgcttgcccttccttccttcccccctttttttttttttttttttttttgttggagtcttactctgtcacccaggctggagtgcagtggtgccatcttggctcttggctcactgcaacccccacctcctgggttcaagcaattctcctgcctttgccccctcagtagctgggattacaggtgcctgtcaccacgcccagctaatttttgtatttttagtagagatggggtttcatcatgttgaccaggcttgtctcaaattccagacctcaggtaatcagcccgccttggcctcccaaagtgctgagattataggtatgagccaccgtgcccggccaggattttattcttgagtcctcagcttgaatgttattagtgtatagaaatactgctaatttttgtatgttgatttttgtatcctgagactttgccaaagtcatttagttttctaggtatagaattatattgtcaatgaaaagagatactttgacttcctttttttcaatttggatgccttttatttctttctcttgcttgattgctctggctaggactttcagtactatgttgaatagaagtggtaggagtacagacatggtaggagtacagacacccttgtcttgttccagttcttacgggaaagcttctagcttttgcccattccgtatattggctatgggtttgtcatagatggcactgcttattttgaggtgtgttcctttgatgcctagttagttgaacattttatcgtgaagggatattggattttatcgaatgctttttctgcatctattgagatgatcatatggtgttttaaaaatttttgtttatgtggttaatcacatttattgatttgcttatgtggaaccaaccttgcatcccaggaataaagcccacttgatcatggtgaattaactttttgatgtcctgctggatgtggtttgtgagtattttgttgaggatttttgtgtctatgttcatcagggatattggcctgtagttttctttttttgttgttgtatttttgcgagattttggtaccaggatgatattggactcatagaatgatgaggagcccctccccctcaactttttgaaatagtttcaataggattgtatgtctggtagagttcagctgtgaatctatgtggcctctggctttttctggttggtaggtattttattactgattcaatttgattactcattggtctgttcaggatttctgtttattcctggtttcataaagcaaatctcaataaattaaaatcatgccaagcatcttctcagaccatactggagtaaaaatagaagtcaataccaagaggaattctcaaatccacacaaatacttggaaactaaacaattttatcctgaatgacttgggtagataatgaaattaaggcagaaataaaaaaattctttgaaacaaatgaaaatagcgacacaacatactgaaacctctggaatgtggcaaaagcagtgttaagaggaaagtttatggcactaaaacgatgataaaaatagctcaaattaataacctaaccttgcacttacaagaactagaaaaagaagaatgaactaaacctaaagcctgcaatgaaaataaataaccaaaatcacagcagagctaaatgaaattgagacccaaaaaccatacaaaggatcagtgaaacaaaaagttagttttttgaaaggattgccaataaggttgacagactcttagctagattaacaaggaaaaaagagagagagaagatgcaaataaccacaattaaatgagaaaggtaatatcacaaccaatcccacagaaatacaaaatattatcagagactactaggaacatctctgtacacacaaactagaaaatctagaggaagtggtaaattcccataacataacaacctcccaaatttcccaggatttaaaaaattacattatttaatttttaaaacattcttagttggctacgtcagaatcactttgtgtagcttaataaaatggtagattgtggggttctgtttccagaggttcagtttcactaaatttcagttacagccctgtattctgtattcagaacagacttctctggcattctgtgtgcagtcagattaaagaatcactcttacagccaggcgtggtggctcacgcctgtaatcccaacactttgggaggccgatgcaggcggatcaggaggtcaggagatcgagaccatcctggctaacacggtgaaaccccgtctctactaaaaatacaaaaattagctgagcgtggtggcgggcgcctgtagttccagctactccggaggctgaggcaggagaatggcgtgaacctgggaggcggagcttgcagtgagctgagatcgcaccactgcactccagcttgggcaaaagagcgagactccgtctcaaaaaaaaaaagaatcactctttacagaatttttaggaagcagggattaatagcaaaagacatttatgaaagcaagaaagaaacagttgagatgaaacgttaaataccttgataataaagctgtaatcaacaaacccgttgataaagagaagttaagtaatttattaagatgaggtacagtgtattatttttataagacattctttagagaaatataaagcatgttgagttttattaacacttagtcatataaccctgaagtctttttcttttggaactatcagaaactatcagaatggaaacttgcattggcaaaaaggtgacagtgggctgtctatcccttttggaataaagttcccaagattgccacgtattttaacctttaagaaaataacatgagtttctgacctaagcttttgctcaaaaacgcagaatctgtgtagcttttataacgttagcaaaaaaattctagaggagaggagccacaacccaactcagatattataaggagcatgggtataattaggctgtgttgttttatgatggtatagttagaaacacacagcaattatagctgcaatgtaaacagaaaaggaaagaaaattattcttcagcttttttttcgtattttaattagtctctttcagatgcactaatttctcttcaaatggtatatcctcgaaggaatctttcagctgaccagtggagaaatgcccagttattgagcctcatcagtgcacctagtacaatgcttaatccagcacagtccgacactgtatggttctatttttctcttttgaatgaaaataaagtgacttttaaaaaaataatagttcagtaatgctgttgctgtttgtttctaattagcattagcttattagttgaagttcattataaaatgttcactacttaagtcatattgttcagattttttagctttagagtcttaatgaaaactggtgataaattaatatggtgaatagtatgagtacttttttctttaaagtttaaaagtttgttttgctttatcatggtagaaaaatttgaagtataaagcaaaaacaaaaatcaccccaaatctcaccaagtagaaccaagtagacaaaatcattgttatattccattatatttttttcagtctattctctgtatttatgaacataggtgtcacacatatggagaatacacacacatagctactgattttggtgagacagtgagtattcagacacataaatgtcttttaacttgactaaaattttatcttttggaatattgtaaactttgaaataggcttgagaaattgataagttgtcatttaccagattaaagataattagcaacaatatttttttaaagagaggtttgagggtatgcagatgtgaaaggggcacacctctcgttgtttattgactgcaagtttcagtataggtaataaaacttttatccagctcttcaaatttgttgtggtagtatttgggcgaagaattgggtagtaagttatcaggagaaagggaggagagtggctcaatatggaatattttttagaatttcttttaactgcaaatgtatatattctctttttaagatgccttgtgaatacctctctttggatgcaatggaaaagtggattatctgtaagtaaaatgggttagtgttatgattactccccaggctttatgttttagagaaaaatagcaggtgacatggttactacctctgtgcttagcattgtgctaacccatctatgtccattacctctttcagtcctcatattgatcctatcagagtagatagcctgtttgtgggttttttttcttttttttcttttttttttgagatgaggtcttgctctgtcatccagggtggagtgcagtggcacaatctcggctcactgcaacctccgcctcctgggttcaagcagttctcgtgtctcagcctcccgagtagccgggacaacaggcacacgctaccatgcctggctaatttttgtatttttagtacaggcgggggtttctccatattggtcaggctggtctcgaactcctgacctcaagtgatctgcccgcctcggcctcccacagtgctgggattatcggtgtgagccactgcacccggccaggtagtctattttaaagctggggaatctaaagcttaggccacacagctagtgagtgacaaagacaagataagaacccagcctaactccaaggctcatgggctacgttatattgcctttcaacataaccttcaaaactaaattttggttttgcttttaatgattatttaaatgtcacatccgttcacttaaagtttttggttttaattcacttcagtttaataaattactcgtatgtttggcagttttttagatgcacaggagataaaagtactagtttctgcttctaagaagcttacaaactatgagagaaatagacacaaggtttttgtttgtttgtttgttttccttcgttttattgtgaacatcaagaaagttgaaataattgtagagtgaacacccataaatctaccaccaagtttctatgacttctaatagcttgttgtatttgcttttaagctgtttgtttatcagcttcaaaagagattttatttaaacttttaggttcatgcatacatgtgcaggtttgttatataggtaaattgcatgtcatgggggtttggtgtacagattattttgtcacccaggtaataagcatagtacctgataggtcgttttttttatcccaaccttcaagtaggccctggtgtctattgttcctttctttgtgcccatgtatactcagtgtttagctccccttataagtaagaacatgtagtatttggttttctgttcctgccttagcttcctaaggataatgacctccatctccatccgtgttactgcaaaggatatgaattcatttattatggctgtgtactattccatggagacacacaggtttaatacagaatgagaatttctgtaatatagataaattcctcctactcacccctaggctcactgccacaggggaataattttgaagtgtttgtgttttttcattcttacaggttttgttcttgatttattaacctttagagaatagagttggccctttatatcctggggttctgcatccagagattcagtcaacagccaattaaaatacgggaaaaaatttcacaaaggtccaaaaagcaaaacttactgcataatgagtattacattgagtccacgcaaatgaagtgatgtgtaggtattgtattaggtattacaagtaatctggaggtgatttaaattatgcaggaggaagtgtgtaggttatatgtaaatactacaccattttatataaggaacttcagcatccacagattttggtatctgttgatggtcctggaaccaatcccctacattgagagatgactgtatttgttgactttttattacagtgtttctcaaactatggtgaaggactagtttttcttctttaatattttttggattgatcctttaataaaataaagaaaatgaattactagaattaccagaaaaacaaaataataaagacataaaatacaagctcatagtttttattactagattcagtctaacagattattaagtttctactccaaaatcactgtgaaatatttatgaaaatttctaaataccctgttccaatacttagtctcattatggactgatactttgagtagtgtgtttttagtatgaaagaggggaaatttaacaatactatctggccgtagctatttttattaattatattattttttacattgaccaggtttgtgatatttatattttcttctataaagataagtgaaattatcatgctttgtctcatagtttatttagaaaaacagctttcagagttttgatcttgctcggttgtgtggtaattattagttgttttgtgcttatggatgtacagatgaataattgagttaattagtagagttagctgtcattagtgacttctggattttgcttcccactggtctttattttaaacgggaatgctgatggcatgagtttgtgtaatgagccggtaagtcgatcaggaagcaggctcccctaatggggaatatatgggcatggagaaggcagatttgggataaccacagttgccaaaataaggaatgaattttgcttctttcatgtatttgaaccctgagtagagctaatctggaggttaggagttgcctcaaattctgcacttctctttttggaactactacccagactaggatttttcttcaataggtagtctactttctttggacctttgttctggattagttcaaagtgtggttcctagaccagcaacatcagcaacacctaggaacttcttagatgtgcagaatcttggtccctacccaagacctactaaacagaaactctgcagatggatcttaacaatctgtttaatgtactttctcagtgattctggtgcaagctaaagtttaagaatcactgctctagattatagcccgatgctaagagttgtgcaggacctagaatattgaggacccagcacttgaagtacagatgtaaaattaattatcctgatacgtattttagggttcatttttgggtctgttgattggacttgggagactccttaggaaagattttttttcctatctccagagttttggattactaatttctgccttgttttttatattgatagtccaattttatctgttttctgccttcaaagattttcttcaactttcttgtcaagacttggtcttctgttttaagagctacttttaaatttttttttttttgtcctttcatcctaattttggtaaaggagattgatgtgtagtttaattaataagtcatccccctaatcttgggcaatctattttattttattttattcttttgagacttgagtcttttctgtcacccaggctggagtgcagtggcatgatctcagctcactgcaccctccacctcccaagttcaagcgtttctcctgcctcaccctcccatatagttgggattataggtgcccaccaccatgcttggctaatttttgtatttttagtagagatggggttttcaccatgttggccaaactggtctcaaactcctgacctcaagtgatccatctgtcttggcctcccatagtgttgggattacaggtgtgagccatcatgcccagcctgggcaatctattttaaattcatttgccttttttggtccaatttaaacaaataaatatactttaactcataacacgtatgttaaaaacaaacacttttaacttgtaagtgataaaaattttcagagaaactttgtattagtagtagcaagtattttgtaagtgttaacgtacaaaggtgtaagacactaagtgaaatctgatttcacttgatattagggtggaaagtcaagtacataagaggataatgttttataaacaaaatttctcttgagggctctttaatctttcatacatgtattctgtttctttgattgtgtgccagattgaataattggcttgttttaggggccctgttgtatgaaaaatatttttgtatagttcaagtcaaagaagttaaatatgtgtgtatgattctacaaaatatgcctacttagagagttagcttgcttctctagtgacccaagaaggaagcttgagctaagaatcaaaagataaatggcaagttttatgttaaagtgtcaagatagttgcacagctataataggagtttaaacatgggagtgattattgagaatcatagggaagtctcaaagaaaatgggattggtttctaactggcccactacagaaccttgtatatatagtagacactgagtagatgttcagtgaatgaaagatgaggtcttacgtcctagtatggaagactagagaggatatcagtcagcatgtataaaattatacatttatataggatttccagattagataacaaaaggtaaaaaagatatttagaattcatataataaagagcaacttaatatattgaaagtattggactttaaggatgaataattggggctaagtcctagctttattactttaatagtattttagtaaagtcattgacccttcacttcttcaactataagaagcatatggaccaggtgcagttgctcatacctgtaatcccagttcttggggagaatgaggtggaaggatggcctgagaccagaagattgagaccagcctggtcaacatgacaagaccccatctctaccaaaaagagaaaaaaaaagaaagaataccacctgtcttgtctactacacaggataatcatttgaaataatatatatgagaagacttaatgaactataaattgctattaaaaatgtgaggatgctattaaaatgtgagatgctatgatttattctcatgattaggaaagtagattctctttatgtatgtatgcatattatatatatataaattatatatatatattttttgagacagagtcttgctctgtcacccaggccggagtgcagtggcatgatctcggctcactgcaacttcggcctcccgggttcaagcgactttcctgcctcagcctcctgaatagctgggcgcaccaacactcctgtctaatttttgtatttttagtagagacgggatttcaccatgttggtcaggctggtctcgaactcctaacctcatgatccgcctgccttggcctcccaaaatgctgggattacaggcatgagcacctggccattaaaaaaaaattttttttgagacagggtctgtcacccaggctggagtgcagtggcgcaacctcgactcactgcaacctctgcctcctgggctcaagcaatcctcccacttcaacctcccgcagtgctgggattaaaggcataagccacagcaccgggccccaagataagctttatttttaagttattataacaactgtaatgattactgcattatgttaattagaaatttctgatctttggttgaaaatattttataaatgttatttttattaaaatgacttggttcataacccagaagtgacatttttcccgttttgtcagttcaggttcaaataactggttttgcagaatacagaaaattataattggaaaagaaacgtattaccatggtttatacatatgtattgttactgtcactcagaagcctcaatttagtgatcgtggttacgtttctgtatttttcaaaagctacactgtcaccaaactttggaatacttgtacatttacatttgtatttgctttctttttatttaaagttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgagggtatggcattttcatttattttgtcttttttggagaagggtggtgagtgagttatctttactgaagttttggggataaaggagtagtcacactgtgcaggaagatacagcctataccatctgacttggatcccaggaagttgtttttaacagtcatcctgatagttaataatcatgttttttacaggtaacttcacatattaaaaaaaaactgaggttacctgacctttcaaaacatgtaatataggagaaggaagatatgtcttcttttgcaagtcatatatgattttagatgcaaaagtaccatatacattttagaggtttaaaatttttataagtgttattttagaatagggtgtacttgtaaaagtatatgaagcaataaaaaatagttaattggattaattataaccattacagaattcatatcactgcatgtaggaaatcatgttgtttttatttaaataatagtattccacattatttattttcatttatttccagttcagcaaataattatctgaaatgtgtttctttgaaatttttaataactttatttctctccacttgagattctgtagccaatatataaaagccaaattgaactcagacttggtggcaattatgaaatcttttaaaaatatctaggatctgctatacttatgttgaatatataagttgggcttcctagcttcagataacagtgaaatttgcttatatttatttcacatccagttgaataatgacttaatgacattgaaatgaaataaaacttctagatattttaatgtatgtgtatatgtctgacgctaaatgtaagccaatatatcccacattttagtgtacataagaattaccccgaaatgcaaattgaaatccaggttcctgagcatcacctctaacctcctctatctgtgtcttggagaggttaaaggaatctgcccttttcttcccgagtacttttttgagagaaaatacaaacagaaaaatacatacatcttagctgtataactcagtgactttgcatatgaaaactccggcatcatcaccacttaaatcaagatgtaagaacatttccatcatctctggagaattcttttgtgcttctttctggtcggtactgccatgcctagtccccactccccccccactcctttctcaagtgactactattctgatttctgtcaccatactgatattcttatggcagtgatctgtcagtcatatgataaatagtgccctatgtacttttcagctcttattttagatggtggaataccctgaaatattatgtgcaagatgggctttgtcattttctaattgatttagattgaaaatcatgaaacttttattaatatcatgtactagcatactgacaaactcattgtagaatcatatgtaaatatatgtaaacatttaaaaccagttagcctctgtatattgagtgaacttatgtatggtgcaagtaaatttaatggcatagtgaaaccagttgtctttgttatgctttattaataataaatttatcatttgagaatctctgtatttaaaattatgagtttgcatttttaatttaattgtgaatgatcatccagtttaaaatatgaattatcatcaaaccataagtataaaagtgtattaattatagagggtgatgattacagaattattatattttggaaatttgctcaaagaatacataaatcttagaccacttaaacatagaagttggagtccattttagtgtaagagatttttatttatttacttttttttttatttgtttttgagacaagagtttcgctctgtcacccaggctgaagtgcagtggtgtgatctcagctcactgcaacctctgcctcacggcatcaagtgattctcctgcctcagcctcccaagtagttaggattacaggtgcccgccaccatgcccgactaatttttgtatttttagtagagatggggtttcaccatgttggccaggctggtcttgaactcctgccctcaagtgatccacccaccttggcctcccaaagtgctgggattacaggtgtgagccaccgtacctggccatagtgtaagagatttttagagaggttgtcaggaagatattttttctttaacattttaggaattttgagtttttatatctattattcatgaaattatttattagcatttgttttcatggtagcatctttaagctgatgttaattaaatgtttttttatttgaaaaataagtttttttaaaaaaatacatagcttaaaatcatatatagttctcttaaaataatttgaagtcggcaaatgcttttctgcctcagttttctccttcacaaaacctttttatccaaacagtcattacttttgatcactaatatatatcctttcagaattttttcatgcttaaagatagacttgattaaaaagtcagaaatgatagctttgtcagtactttagacttttggaaatcacttctgatgttaattacatcagaagtataatttcagtgtctccattggggcttaaggaagtaataacatttaataaaatgaaaatctacattgtgaagtttaattttattgttggatttaatataatgttacttttttttttaggaaggcttgactggacatctaagtgctaggaaaaagtgtgggtagattcttccatgcacttccagtttgatggccagtttctgaattgataatgtcatttttaattgacttctagtattagacttactcattttgacagttattgatcaaattaaactaacgttctaatttgtttttgcacctagctataataaacgtattaatgacataagagaatgcaaggaggcagccgtgtcacatgcgtgagtagttttattttatccgtggtagctttaatcaagaaaaattcttaaagcatcattttgttgaagtgagtacagattaatagtatgcaagatatggtagtagaagagggggactttcagtcaatgagaattattaagtatattgcctcaatatgtagaaccttggaattagtgaagtcagattttaaatgtttttgaagtgttgataaaatgctataaggaagtatcacacaaaggactcttactttgggtataatctcactgccactatgctctgcataccaatatgatttttgtactactacatgaaaattaatatatccatataactcttacagataatatttacttttttttttttttttttgagacagtctcactctgtcacccaggctggagtgcagtgataccatctcggctcactgcagtctccacctcccgggttcaagcaattctcctgcctcagcctcctgcgtcactgggattacaggcacccgccgtacattcccagctaatttttgtatttttagtagagacaggttttcaccatgttggctagactggtcttgaactcctgacctcagtgatcagcctgccttggcctcccaaagtgctggcattacaggcatgagccaccgtgcccggcaaatatttacttttaagagtacacctctttcccaattttaatttcttatattagtaaatatatagatatcctaagtgagaaattagtgtattttaaatctttgaacaactttccagttttctcataaaataattctaaataatttgatatttcactttgttacatatatgatatacttaatatagaatattttctccagttaacttaggtactatatacagataatattatttgatctatcagtatttctatataaggcagagagaagacaagcaacactccatagcgaaaactataaaaccacaggaagttttaaaatttcagtttaggctataagatattgggaatttaaaccatctttactcatcgtatctgtgctatatcattcctcatgcatattttatttacttgaatgaagtacatgtgcttaatttttcaaaaatgatttctagtgcagataacgtactttggagtttgttagaattcctctctagacttgcagaaatgcacataattattatttcttcgtgggatagacgctactataggcagacatataggcatagctatcttttataaagatcttttacaattaaggtatttttattttcctccttctgtttattaaataaaatataagtagtaagcagtggtaacttctaggactcattaccatgtgccaggcccaagtactttatagacattttctcccaataaccatcacagactcctcacagtaatcctgtgaagtaaaataatcaaaataacatttgttcattttcttcttggaaatgacacgatgactttattattgtcagtaaaaagagcttgtcattgaaattaaagtaacagaagcactatatatcaggcatcatgaaagattgtgcatcttttgagacagatgtcatcatacttattctacagatgaaaaactgaaacttagagttggaacctaaggtcatgtagggagaggatggattttaatttgagtcctctgaaactgatctactgtgtcacagcgaaattactagtggtgtgtattctttatacttgggtttttggcataggcaacacacacacacacacacacacacacaccccaatctaaattctaaaactttcttggagcagtgtatattttgtgtagtatgaggagttgcttggaacattttatgattttttttccttctgttaatatgtgagaatgttttctaatcttaattttaaaataagtagtatatgaatatttatgattatcccttcctttccccatctttctatttttgaacaagagtgccaagtagctctcatcccaatacctttattgactatagctcttgtgtattcagttttgtatatttaataggaatataacttaataagaatatagataaccagatacttaagttctatttattaatttctttatggaagtgacaaaaatgtatacagttagtcagtttttgccttcaaggatttttttttttttttgaggtggagtcttgctctgtcacccaggctggagtgcagtggcatgatctcagctcactgcaacctctgcctcctgggctcaagtgattttcctgcctcagcctcccaagtagctgggattacaggcacccaccacacctggctaatgttttgtatttttagtagagacggagttttgtcatgttgcccaggctggtctcgaactcctgagctcacgcagtctgcccaagttggtctcccaaagtgctgggattacaggcatgggccactgtgcctggtcaccatcaagaacttcatagtctataaagtgcttaaagctacatggtactaaaattggataaattattcataaataaatagctagatgttgggaaatgcttcttgaaggactggtcttgaaggttgggtaggattttgatagatggagaataacaaaagaaacatagtttaaaaagcaacataagaaaggcaggataaatgtaagattagaaactcacttaacgatagacacatagaagatgatttttataggaactttggcttcctaaaaaaagactttggaagttgcacctataatgctagttactttaattgccaataataattttagtagaagcagataaactattatggtgtctttccccatagtggttcaatgcacagagaaagacgcaagtttttaagatctgcactgaaggaattggctactgtcctctctgatcaacctggattgctaggtcccaaggtaattcatttaattattatttcaataattgtgccatattaaaattttaaaaaacgtttctaagtgaaattttactgaaatttgagtcagggactacataaaaggatttttatatttagtggagaatgaatttgctgacttgacattcatacatcgtacctccctgcattcttctcccttatatgcatgctctctctcatacatacttacaggttctcttgtgtcctcttctgttagtctcttcactcttttgaattgatattatcacttcttgccaatgacttttcacatagaaagagattaccagttttgtttttaatctttgaataagaataaacacttacttttttttaaacaggcactttttgtttttatggcattatcctttgcccgtgatgaaatcatctggctacttcgtcatgcagataacatgccaaagaagagtgcagacgactttatagataagtaagttagcaacatttaaaaaaatattttctgtatatagatgcttcttgatttacaatggggttatgtcctgatagacctattgtaagttgaaaatattgttaagttgaaattcatttagtacacctattattactgaacattagagcttagcctagcctaccttcaatgtgctcagaactcttttattagcctacagttgggcaaaattatctggcaacatagtacactgaagagtataggttgtttatctttctgatcacatagttgactgggaactacggcagcatcatgagagagtatcatactgcctattgctagcctggaaaaaaagtcaaaattcaaagtacaatttgtactaaatgtgtatctcttctgcaccattgtaaattagaaagatagtacatccaaatcactgtaagttgtgcaccatctatattctgatttgtgggctggggaatctggagacttatatttgaagcaaaattattttgaagagcttggaatatttgtaatatatcattagatgatattaattagactgcaaagtcaaatttagttttaaattagggcttttattttctcgtagtatgctttgtggtgataaagtttttgttttcttgctatgctcagtaatatttcttatggaattcattttttaaaactatttactacacaaaacatttaaataaaaatcctgtttttagagttgcaactcagtgtgtcattaaaatgtgtcttattttagttcagtctctcaataagagttagaaaaatggagcagagaaataagagcatacagaaaaattttatttcttgctaatcttcttttatttgagattttttgatgatgtatttataacatgtcctgtttatttttttaatttaaattttttttttttttttttttttgagacggagttttactctgtcacccaggctggagtgcagtgatgccatcttgccttactgcaacctcaacctcctgggttcaagtgattctcctgtctcagcctcccaagtagctgggattacagacacccaccaccatgcccagctaacttttgtatttttagtagagatgggattttaccatgttggccaggctggttttgaacccctgacctcatgtgatcagcccgctttggcctcccaaagtgctgtaattacagtcgtgagccactgtgcccggccctgcttattttcagtttggattttctgctgtcgatttttagctttaactttttttctttcttctttttttcttgctttccatgatttctttattcatgaaatgatttaaaaaggaagtaattgacattaagtattaaacaatgccctttataagaaaaatacttttagaaataagattaagggcatcgaatatattctttaataatgatgaatttattatttgaatatttttcttgaaattttaaaaaaggcacattgctgaattaatattttacatggaagaacttagagcacatgtgaggaaatacggacctgtaatgcagaggtattacgtgcagtacctttctggctttgatgctgttgtcctcaatgaactcgtgcaggtaaaaactatctcatactatttcccttttgttccttccttcccacctttgatagtattttatttgtttgttcaacaagcatttatgaaatatcatgtgccaagtgataaatcatgtttatattttggagatcattacctagaagggaagaaacagttagttgtagtccaatgtgataggtgttatgcattaagtatatataaagctcagaatgaacacaaggaaagacacaattatttatcctgaagatggaggtgtacgctaaccaaattacagagggccttgggaaagaggaggttaatcataaatcaggtgtactacttaaaaagatcaccctggttcagtgtggatggtagattgctgggaaccaaatgaggaggcagagagaccagaagaaaaatgactgcagtaggctagatgagaggtgatgagagtctgaacatgggcagtagctatggagattcagaagagatgatagagacaatataattggtaattaagtattagagggaaagtagaataaaaatctttttgaagaagattgttagaggatggccagtaaataaagatttcatatagacattcccatttaaatgtccaattttttttccttaattggtttttagcctttttttgctttccataatttatttattcaatatttttcatctttatttaaatttaaaaaactttttattccaaataaactgactctaaggaaataatattttattttgcttcactttatagaattacatgtttcaaatgactgtaagctaatacatagtataaagaaaacagttaagaatcctctttatataaagacttctctaaagctgctagttttccagagaaataaccatactttgaagatctcatttttttcaaatcaacctaaaaatataataaggaaaaaaattgttcatgtaattttttttaccttgagttacatgctgttacaagctagtattctaaactctatagtttatttcttcttttatccactagatggagctcagatacttcttttctatggtcatttaaaaagggaacagaaaacctggggtattattgccttactataattttatttgaatagttattacttaacagataagccagaagcttttgttactgtttattatttattcatactagcatacagtttaaaaagtaaaccagaattcctgaattacttaatctatttttatataaagtggagtttactaatactgagaagattaattcttagcatttcttctggaattatagtaatagtatagtatcagcagcaatcatactgatattagtaattgccagatttattgatagtgtatcttaccaaatctgtagaaaacctctgtgagagtggatatagttatcattatttgttgaagaagaaatgccttatgtaatttgctccttatcaccaatacagctcataagtaataaagccagtagtcaaactcaagttttgactccaaagcctgagcattttaccaccctcttctgttgcaaagtatattcacaatgtttttcaccatttgctagcatataaatttagaactaaggttgtaaacctgttagcatagttgattgcaataggtgttaatattttattgtggtaaaatatatgtaacaaaatttaccattttcatgatttttaagtgtacagttcactcgcatcataaagttttaaaaatgtgttttatttatactgtttgtaagctaagcatccactttttaaaaggaatttattttttagcatccactttaaatacagtttatcaaatattcattttttaagctagattgaaaaggatttttaggtcttaattttgttgaggcctaacatacagacaacaaaaatcattcatttttagtgcatgttgtaaattttggtagctgtatgcatttgtgcaactattaccatcaccatattcaagacagaacttttccaacacctttaaaagtttacttatacacccttatggtacaccttcatcattcttgcataagcccctgacagcaactggtgtttgtcattatactttcgccttaaaaatactttttcatataaattttcctatatagtgtatgaaaaaattactttttaacacaaaatcatttattttttatttctttcacttaatgtaatggttttgagattcgtgttatggtgtgtgttaaaatttcatttcttttttattactgaaaaatattccatagtatgggtataccagtttgtttatccgtccactaattgatagacctgagttgtttcccaactatagatgtttttaacgttactttttgtttgtttttcagaatctttctgtttgccctgaagatgaatcaatcatcatgtcctcttttgttaacactatgacttccctaagtgtaaaacaaggtaataagccttttaaataaaagcatattttcttctaattagattttcaaacttgattattaaggagataatttaccaattaatttggctaatgatctattatcttttatcttaattttgttctctgaagcaaagatttccaaaatgggtttgtgatgctatttacaaaaataataattacagttttatatttctaattattaagcaggaaaaaaagcattttgtaacaaaaacaataaaacatttgcattttgtagcaaatcatatatttggtccaagcataccaataacaatatttaatgccatttataaaatgtttagtctgtgccaggcactttacatatatattatcccatttactccacattcttttttcaacactgttattacttttgacagatttggaaactctgggtttgagggttaacctcgcagttactgaacataatttgccaagctctaatagctgttaagcaaaagtaggaatttgagctcaaatctgtcaatctcaaaaattgatgtcatataatcaccttgccattatttgacactccattctagtggatcgatagtgtgttttagttttatagtcttttaataaaggatatcagaaaccttgaaaacttctgagtaataaatgtataaacatttttcttagttcaatctttattgctaccacatctaagtaatgaaactaaagtaattttttctggtgatatttggtttatatagagttattttgtggaacttcagcatgctgtccaaagtttctattcgtaggatctctcaaattctattcaaactcctgtaaattgacatgtaagcacactaagaatcagagagcttaggagaaaagcctttacttcccttagcacaactgtctcctttatcatcatctttacaggatttgagaattgtttcactgtcttcactctttaattttaaaatgtttttattttttaattgtaaaatacacataaaattgaccatcttaaccatttttgagtgtatagttcagtagtgttaagtatattcatattgttgtacaaccaatctccaaaacattttcatcttgcaaaacaaattcttttaatgattattgaacaacagtgtgccatttccctttcctgctagcccctggcaacctccattcaactttctgtttctgtgagcatgactgctctagatacctcatataagtggaatcacagagtatttgtcttgctgtgactggctaatttcactaggcttaatgtcctcaagttcagccatagtagcatgtgtcagaatttcctttcttttttagcagaataatagtgcatgatatttatttattttatttttgagacccagtcccgctctgttgcccaggctggagtgctgtggtacaatctcggcttactgtaacctctgcctcccaggttcaagcaattgtcccaccttagtctcccgagtagctgggactacaggcacgcaccaccacacccagctaatttttgtatttttagtagagatggggtttcactacgttggccaggctagtctcaaactcctgacccttaggtgacccacctgcctcggcctcccaaagtgctgggattataggcatgagacactgctcccggcctccattgtatttagatactacattttgtttattcattcatctatcaatggaaatttaagttgcttctacctttgactgtttgaataattcttctgtgaacatgggtgtacatatatctctttaagaccttggctttaattgttttaggtatactcagaagtagaattgtcttagctcttaaaatttaaaatgtgcttatagattgtgaaaacattaatttgctttgtaatcttttttttttttctattactacagttgaagatggggaagtatttgatttcagaggaatgagattagattggtttaggttacaggtaagaataaccttttattgtcattctgttttgttattttagttaacatgaaaaattttataacaactataaaatattcattgttatatacctattgaaaatatttcttttgtataattaaccataaaagaaacattttgtactaattattaaagttggataaatatattaataacttaagccaatatgagtttttgaatagattattataattttaaaatatctaaaaatttaaatcccaatctctctcttgattatcctgattcaaatatttaattctaaagtgaaagcacaaaatcttttctgagaaaatatttaaaatctactgtgggcatcagcaaactttttctaataaagaaacagctgctaaaaaattttaggcttgcagccatatagtctccgtcatcatgattgcactctgccattgcagtgtgagagcacctatagacaatacataacttaatgggcatggctgtattccagtaaaactatttataaaaacaagcaggtagcccacaggccatagtttaccaccacgatctgtacaaaaaacttccattttctgaaaaacaaataaatattattagacttagagtgttcatttaatatatgtctcatataaatagttcctaaaggcattaagaatgcaagcctaacaccttggtgtatactgtaaccttaatgataaaaattagttgccctgtaaatattttaagtaattatgggaaaatggcccagtgttctcaataatgtgcatgttttaaaaatccatatatttttaaatgataatatagtcatttgactcattgtgaagtcaaaacattcagtttgcccctttcccagtttcattctccagaaatactcacttttaataactggcctatatttttttagatgttcaaacaagtaaattagatagtactatgtactgttttgctatttatttttgtctttttaaaaaaatatttacttatttatttatgttttagaggcagggtcttgccctgtcacccaggctagagtgcagtggtatggttatagctcactgtaacctcaggctcgtatgttcaggcagtgctcccacatcagcctcctgaatagctgggactataagtgcaagccaccacacccagctaattaaaaaaaaattttagagactgaatcttgctatgttgtccaggctgatctcagactcctggcctcggtgatcttctcacctcagcctcccaaagtgctgggattacaggcatgagccacagtgcctggcctgttttgctgttaaaaataaataaataaaatttctatttgtttaattaaaaagagaaaatataagaagtatttttttgtggaagccatttttagatggatacagtctcaggaatgactctcaggatgaccatacttttctggcggtctgcttagtactctgaggtgcttttgcttttcttaggttctttccttccaacctcaaaatgcataagcacttttctcttttttgttctatattctctagggagcttatttttagaaatgaagacttttataaataaaagcattaaataccttaccagttagtgggagatcagggaagtacacttgaaataccaacatcccaaaatgttaaatgtgtatatattataggttattttcttattacaaataaagttttaaaattgacacctctttgtttttaaaaaggcaatgaaacaatacaaaagtagaacttgtaaaaaaaagaagtggaatttcctctgccaaaggatatacatgtttaaaactttgaaagtcattgtcataaagcttgaactgcttcaatctcctgttctgggtttataggagtgcctaaaccaatacttgggctcagagaattttagagatttagatgcatttcagatgcacccttacatttgagttattcatgtgagaattttagcctttttcagtcactgcaaaataaaaagcattgagtgaacatgaagaatgtagacctgattattcctatgtgtagatttttaaagttttttaagatttttataagagcattattagctagctatctgatttttttttcatgtaatctatacctacttgtgttagtttcctagggctgccataacaaagtaccaactagatggcttaaacaatagaaatgtattatttcatagttctgaaggctggcagtctgaaagcaaggtgttggcagggttggtttgtttcaaggactgcaagggagaacctcttccatctctctctcctagcttctggtgatttgctggtaatctttgttgttccttgcttgtagttgcattactctaaaggcattctccctgtgtttcttcacttcatttttcctctttgcatatttcatgttcaaattttccctttttatagggctaccagttatatttgattaggtcccattcaaatgacctcatttttatgtgcttagctctggaaagaccctaattccaaataaggtcacattctgaggtactgggggttaggatttaggcacatcttttcttcggggatacaattcaatgcataacattgctgttaaccacgtttagaacatgcagtcactcagaccctttctactgcatacagacccttttttttttttttttttttttagtgacaacaggacaatgcatacaaaggaaggaaagaatgggacataacactaagccagagaagtgttcactagaagtagagaacaaaagtgcaaggtagcaggcagggtccagaatctagaaggtttacataggtattgaaaagcagctcaaaggtgaaagttccaagcctacagattagactgtaggatacagaagataaaatactgagcagtattatataatctgtagaaaaatagcacattcatcttttgaggattttataatctagctatggagacaaagcataaaaaatgtaaaaaatagcagctgaaaatctgaaagattaagagatgtcatagacagaatatgtttatcagttaatttcagtcttagaagggataaagcatttttcaagttaaaattgctttgaataggaaaaaggaaaggacaaacaatgagtaaagagcaagtaaagagacttttgagtataaaggattactgtaagaaggggaaaatattcacaagaactatgaatgatctgcctttgatcactgacctttggtttcaggtagaagtgcaagaattgttaggtaaaagcacatggccagagagtggtgaagagttctatagatagccagtagtggttgagtagagcagaccagaagagtaagcctttgggagaattttagtagtgtactttgtgccttcactggtgtcctatttagtttggttctaaggtcattgcttttttataggtcactttcatctttctctgtccttttcctactcttaagaattctctttgtatttttgtcattcttttctacttcctaagtgatctcattctgttgtgtattccatcagtcccttaagcatttttagttgctctttcaaatatcttctctcgtctgtcttctaatttattcaaattgtttatattcttttacttaaacctattcttttttagtaacatgtttctccccccattgttgtcaagcagttaaatcattatcttgttttgttaccatccatttcttctgaatttgttttcacaatgttatttaaattctgatttaatttttttaattttaaatttttatgaatacataatagttgtacatatttatgggggtacatgtgatattttgatacaagcatacagtgtataatgaacaaatctgggtagtgggaatatttcatcacctcaaacacatatcatcatattggaaacattccaaatctactcttctggttattttgaaagatgcagaaaattattaactatagttgccccattgtgctatactagttcttattcctcctaactgtacttttgtacccattaaccaatccttctttattcccacttcctaccttccctactcagcttcttataaccatcatactattctctgcgtccatgagatcaatttatttagcatccacttaggagtaagaacatgtgacatttgtttttctgtgcctggcttatttcacttaacataatttcttccagttccgtctatgttgttgcaacagacaggatttcattttttatggcataataatattccattgtgtatatatttaccatttatctattgatagacacttgggttgggttccatatcttgacgattgtgaatattgctgcaataaacatgggagtgcaaatacttcttcagtatgttgatttcctctcttttggatatatacccagcagtgtgattgctggatctattttcaaatttttgaggaacctcagacactactgttttcaatagcggctctactaattcacattcccacctgcagtatatgagagttcccctgtctccacatcctcgttagcatttattttctgttttttgataatagccattttaactggggtgagatgatgtctcattgtggttttaatttgcatttctctgatggggagcagtttaaaaatatatctgttggccacctgtatgtcttcttttgagaaatgtctgtttagctcttttgcccatttttaaaatcagttttgtttttttttttttttttttttgctattaagctgtttgagttccttatatattctgattgttaatgccttgtctgttgaatagttcgtagatattttctctcattctataggttgtctcttcactgtgctgattgtttccttctttgttgtgcaggagctttttagcttaatgtgatcctatttatccatttttttgcttttgttcactgtggcttttgaggtctaactcaagaaatctttgaccagaccaatattctggcatgtttcaccagtgttttcttctagtagtgtcatagtttcaggtcttacatttaagtctttaattcattttgatttgattttttttgtatgatgagagatagaggtctagtttcattcctttacatgtggatatccagttttctcagcacaatttattgaagagactgtcctttccccaatgtatattcttggcacttttgttggaaatgagctaatagtaaatgtgtggatttatttctgggttctgtgttccgtttcattgatatttgtatctgcttttatgccaacaccatactgttttgattactatagctttgtagtagattttgcgatcagtaatgtgattcctcctgctttgtactttttggattgtacttttcaggattgatttggctcttctagttttttttttgttgttgtttgttccatatgaattttaggatttattttttctgtttctgtaaagaatgtcattggtatttagatagatagtttattgaatctgtagatcactttgggtggtatgtttagcaatatcaattcttccaattcatgaacatgagatatctttttttttttttttttttttttgagacggagtctcgctctgtcgcccaggctggagtgcagtggtgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgatatctttttatctctttgtgtcttcttcagtttccttcatcaatgtttatagctttcattgtagagatctttcactttttgtttaagtttgttcataggctttttttttggtagttattgtaaatgagatttcttgatttctttttcagtgtgtttgctgttgacacatggaaatgcctctgatttttgtatgttgagtttatgtcatgaaactgaattggttgatcagttttaatagtctttaggtttttgtaaatataatatcatattttcttcagataaggacaatttgatgacttcttttcaagtttgcatgccttttatttatgtcttttgtctaattgctttggccaggacttccagtcctgtgttgaataaaagtgttgaaagcaggcatccttgtattgttccaaatctcaggaaatgctttcagttttccccaattcagtgtattgctagctgcgggttcatcatctatggcctttattgttttcttccatacctagtttgttaagaggtatgtttttttccatacctagttttttaagagctatgttttcttccctacctagtttgttaagagtttttattatgaagagatgttgaattttattgaatgcattttcagcatctattaaaattatacagttttgtccttatgtgcatatgttgaaccatcttgtatttatctaactggatcatgatctgttcagtgtgttgttgaattctgtgtgctagtattttgttcagcatttttgcatctatgttcgtaagtgatgatggcctgtagtttcttttcgtgtagttttgtgtctttgtctggttttggtatcagggtaatgctggcctcatagaatgagtatttgaaagtattccttcctcctcaattatttggaacagtttgagtagaattggtattagttctttaaatatttgctggaattcagcagtgaaaccatcaggtcccaggcttttctctcatgggagactttttattactgcttctatctcattacttattactggtcctttcaggttttctgtttcttcttggtaggatgtatgtgtctaggaatgtatccatttcatgtcggttttccagttctttgacatatagttgctcataatctctaatccttggaagtttttggtatcagttgtaatgtctccttttctatttctgatttttttggggtcttctttctttttttcttaatttagctaaagatttgtcaattttatttttccaaagaactaactttttattttgttgatcttttgtattctttttagtctgaattttctttatttctgctccgatctttattacttatctccttctgctaactttggatttggtttattcttgcttttctagttctttaaggtacattattaggttatttggtctttctactttattaatataggtgtttattgctataaactttcctcttactactgcttttgctgtatcccataggttttggtatatcgtgtttctgtttttatttctttcaataaatgttttatttccttaatttctacattgttcaggagcatattgtttaatttccatatgttagtttccgaagttaaaggtacattattaggttatttggtctttctactttattaatatgagtgtttattgctataaactttcctcttaactactgtttttgctgtatttcataggttttggtatatcgtgtttctatttttaatgtgtttcaataaattttttatttccttaatttctacattgttcaggagcatattgtttaatttccatgtgttagtttctgaagttcctcttgttgatttctagttttattgcactgtggtcagagaagatacttgatatgatttcaattttttgaatttgttgaactttgttttgtggcctaacatatggtctctcctggagactatcccatgttctgatgagaagaataaattctgctttttaaaaatgtgggacagttaatggaactctttattgaattcatggccacagctatagctaattcctgtttatactctaaagctgataaatggtaagtaaaactccttaggcttagtttgtgataaatgtcaagtatattttgtcatcagaatattgacatcattctacctcattccttcttcttttctggtagacaaaaacaacaaaatacaaaagtctcctttgtggtgtcactgtctcattgaatagtaacatcatccacctattggtcccttgccatggtagggtttgaggtttaatttttatcctacttacaaggtgataatttactctcttactatttcatggatgctggcaagaagatatggagctcctgggtcagtgacaaaagacaaaagacttcattcactgcacagaaagcagcataggcatcagcatatatgcattatttctgctatttccctaagctctgcaggtgtggtacagaggagccaaaatgaattctgtgcatgcagtctgtttgtgttgcagataaggaacactaaatttgaggaaccctctattttatcatcagctgtaagcatacttgctctttgttccaagggagacattacctcatccctcaaatttgatagctgcaaatataaccctaagaaatggcctagagaatgagtggctcaggctttgccttcttgacatacccagcaaggtgtgtgggagcatgagacccatgcaggagtatctcccaacagccaaaatcctgaccatcatctataattctgtttcccactatatctaattatttcccagagtaaactcttttaaactaccattactcaaaaccagaccattgtaatgccgtcttattgccactactgccttctaatagatttctgcttcctttcccttcccagtcatgcttccctattttcctcactatacagagtaatctttctaaaacaaaaactggccaccacatagaacccttagtgcttcactaaaaagtttaaattctttaacgtggtatacaggctgttcaccatctggttgaatctcatgttttactatttcccttctcttctttgcactcaaactctagccgtaacaaacagtacttattctgtaggcatcccttctattcttattctctgcccttctgaaatgtgccctatccatggacatgatctgctttttgtgatttggtatcccagttgtagaatttttttccccacaacctatcttaatgattttcgtttagttctatcacttttttggccaaactacaccaatttttactatcttcagtacttttctagaatttgtcaaattaatacagtgtattatatgatccagtttttagtgaatcagtatactctaaaacctcattgaatcaacatgtgcagtacttagttttatctgattgcttcctgtgtgtgttttgtctcttaaattaggtcgaagatttcttttggtatggttaatatgacaattaattgttttacacttttgatattttaacttcagttcctttgaggttcagtgtgaatgactcatatattagacactgttttatggacattagtatttcagtttactaaataaattcttgataggaatttcaaggtagggtcactacagacaactaacacagtagatgttactgtcagtgtcacagtagatagtttaagtatctttcagtgatgcttttccccctgtaaaatgacaagtccgaagtcatttatgtttacctgaactacttttttttttttgtactttataggcatatactagtgtctcaaaggcttcacttggccttgcagatcacagagaacttggaaagatgatgaatacaataatttttcatacaaaaatggtagattccttggtggaaatgttggtggaaacatcagatctctccatattttggtatgttgtaattttctctaaatctggatttgaaagttttagtatgcgatatatgtttcttgattatttttgtgttagcatagtccttaagacagttcagtaatagatccttaagaataaagggaatagtggacttttattaaaatgtgccaacaaaaagaagtttaaccaagttgggattttatgtctgtttttaattctctaaaagagcaacttactgatgtgacttttatttcttacatttttttgaggagttgaaaacagtcactccaaattaccttaaggcccttctttgcatgattagactaaagggaaagaaatgttgtagatcaaggtcaaatagagcaagtgttggaaattaaatgcctggtaacttcacttctatgatgtaaaattaaacattaatatgaagatgatgtggtgactacctcctgcattgtgcttcattctctttttctgttagagtctttttgttatacttagtttatttttcttccctctcttcctcccagaaaatgtggtccttaatggctataatttgttttgttagtgtctgtcatagtagttatttaataaatctttgaatgaataagtcaacttagttgtgatcagattgataaacagtgtggtggccaggcgcggtggctcacgcctataatcccaacacttgggaggccgaggtgggtgaatcacctgaggtcaggagtttgagaccagcctggtcaacatagtgaaaccccatctctactgaaaatagaaaaattagtcggacgtggtggtgtgtgcctgtagtcccagctacttgggaggcttgaagcaggagaatcgcctgaacctgggaggcggaggttgcagtgagccaagatcacgccactgcactccagtctcggtgacagagtgagactgtctcataaataaataaatacataacagtggggttaggattcaaaatcaagaattctcgcctcaagctatataatatcaactctattttctgcttcttggccctttattttcctttagggaagaggactggaataacctagtatgtctcttgatttctaaaatgctgaaatgatctcagtggatagtgatagtagtttctatgtatgggatagagatcatcatgaaaagcttctcactgcatttattttggaaaatagtataatctgtgttgattttggcagtttgttaggaaagcttgaattagcagtattgcagaagaaattcaaatcaccaggtagagaaaccatgcctcttaaaggaaataatgaaacacattaggaagtatactttttagatttaggcacatcacaggtcaaatttgcaagaatttttaagattatgtggagcccaggactactgtctgtctggcacaaagtctaccttaggtagaacatgaaacattatatgtttagatattttcagctatgcaaaggatcctattccaaaagaagaatacaacaattagaaagtcatatcccctttcttggaactaaaagcactttgaataatgtttgaaatttgtaattttcagtcatacctgaattttatttatattttttcatagttgcattctatttttgcctgtcacatccaaaataaagaaatgtttactacttctgtttgtcttattactctaagatatgtagtgttttattgactcacattcttttacatttagatttaacatctttaaatgtggatgcaaattaaaactgctggcaggctgggtgccatggctcacacccgcaatttcagcaccatgggaggccgagatggaggattgcttgagcccaagaggttaaggatgcagtgaactgtgattgtgccactgcattccagcctgggcaacaaagtgtcccccgtctaaaaaaagttaaaaaaaaaaataaaattgatggcgtgtgattatttaattggcaatgttttttttttcttagtggttcataaaatatttctctctttttttaatttattttttaaaaatagagacagggtttcaccacattgcccaggctggtctcaaactcctgggctccagtgatccacctgccttggcctcccaaagtgctgagattataggtgtgagccaccacacccagccataataatggtattttttcctatttatagtgacttagctttgatgaaatttgattatgtaagaggccatagattatggtttattattttttaaaatgttgttattgttatataaataatatttttattactctgggataattattggtgtgtaaaagatactttgggggaaaaatattctcttcttaaatcagtgctaccagttatcattcattcacttgaatcaaattaactgtaaggtactatatcagaaaacttactttaaatgtaaaaattgtgattctgatttttgtttatatagtttttatagtcgtgcttttgagaagatgtttcaacagtgtttggagttaccctctcaatcaagatactcaattgcatttccactactttgcactcattttatgagttgcacgcatgaactatgtccagaagaggtaattatagtgtactactgtgagttatatggtatgcaaagtaaactagatcaaacctgtagccaaccaaatatttacagtcataattagctaacttagcttcccatcgaatacatctctatgcagaatcagaaaagtgcttgaacagatacataggtttaatatatatatagataaataaacataagtataataagaacataccataaagtcacttggaattaccttttttaagataaatggtgggtcaggtattaatatctgtggaaaagatttatatagtaattgattttgtatacttaattttcctcttaaactgtcatggaaaggactcgaaaattaaatttatggattactgaataagcataaacaagtcaaagagagattcactaacttattattactaaattgttaataaatatattaagcaaaatccagattttgtgatacttgtgggatacatacatgcatgtgcatacacacacacagttgcagagtaattgaactgcttggtagttttgttgatgccaagtatctgtgaaaaatgtactcagtgtttcttctaatctttaaagaagaaatattttctatgtgataaaaatataaagattaaataatgtatttctttattataatttaacttagtgtttagtccctttacttaaaattgcagaacttgtagaaaagaaacttagagatagcaggaacatggtcagtttctttaagcattagacaacatctgttgcagattgtatgccagtattccaggggaagccaactttgagacagaagttagcttacaggaagtttattagggaatactttcagaatttctacctatgaggatattaataccacgaattttaatagatttatgaattttttagatttaatagatttttttctcccaaacttgacacctgagatgtattattaactgtttgctcaccatcaaatttcttttcattaaattacccataaaatccttctaattttatttatatgtcatgtcttgaatccatcctctactttccattgctattgtcattattacagttcagatttacgatactcttcatatgtactctaaatggagttcatctttgcctggattacctaagtggtctctttgcttctgccattgttctcctaaactttattcttggcaccgtagccaaaggcagaggtcagataatagagagatttgtatgacatgttaaaccttagtttttctccatctcagcatttctgagctgttgaaacggagtagtgaaatcagatttgtattttaagtaagttagtatctgtaaagaacaaatttgagcagtcttaattcagtattcttttttcaggaagaattaatagcagaagatttatgtctttcagaagtcagaatttgattaaacaaaacactgtttattaattgaaatctttcctaaggtgaaccaatatttaattatatcaggttgtaaatcttttttttgatttgactttctattaaagttttacagggcattttaaataaaatacgttagatataatagatctaggaaaagttattttctatgctcaagtatttttatattttatgtattttacacttatttcatcatataaatactgtatgtaagctctacatatatgattatggaaggtcagggcaggaaaactgttaaaaattttatttctttgtaaagtattagaaatgtgtagtgcaaaaatttacagtgttttatactcaacattccagttaccatagataagaaaaaaacaatcaaacgattgcagcccactaaaactaaaaagagaatcctgtagagatggatgcatgatcagcgttttttttttttttcttcctgggagcaatagggtttgattttagagatttgaatgccttggactttctattaccaaattgatttctcaccattttatttaaacatttgagctcttctttcctgtttatacaaagttatgccacaatttatacatttatagagacacagattttaaatgaaataagattggaaacagtactctaaatctgtttgctttcacattatatgtttaatattttaacatttaagaactggatataggactttgtggaatttgaaaattaaatacatagtttttcatgttaagcaaaatactgatttttcaagactcctcccagttatacattgctttcacaatcaccaaatactttgtcatttatgttcaaatacagtatggtgagttagttgttacaagaggcaaaagcaatttttaacatctcccaccctcactattgcggaatgtacctttagcctaattttccatgtctatttagaagtctttttaattcaacgtactttctttataacttgtattattattattattctgccttcacagcgacatcatattggagatcgcagtctttccttatgtaatatgttcctagatgaaatggccaaacaagctcgaaatctcatcactgatatttgcacagaacagtgtacccttagtgaccaggtaatgatttaagtgtttccaacagataggaaattttgtgtgaaggcaagaaaatgtgcttttagccagttgttgttttactttccattctttagttcccacactattagtaaacctcaaacctctgctgtgaaactccattaacaggtataatttcttagatgtaaactttctggcaagactgtacgtactgtttgtgttctttaatcaggagtcacgtgtagtttttacatgtgtgtagtgttagcacctgattctgctatttcttgaaagttgcaaaagaactggaattaagcatatttggtgattttcaatccactgtacttataattcagattgaagctcagattgccccgtcattggctagtgggagtccttttttttttctttccaactttaagcatctatttatttatttatttattttttattatactttaagttttagggtacatgtgcacaacgtgcaggttagttacataggtatacatacgccatgttggtgtgctgcacccattaactcgtcatttaacattaggtatatctcctaatgctatccctccccaatttccccaccccacaacaggccccagtgtgtgatgttccccttcctgtgtccatgtgttctcattgttcaattcccacctatgagtgagaacatgtggtggttggttttttgtccttgcgatagtttgctgagaatgatggtttccagcttcacccatgtccctacaaaggacatgaactcattttttatggccgcatagtattccatggtgtatatgtgccacattttcttaatccagtctatcattgttggacctttgggttggttccaagtctttgctattgtgaatagtgctgcaatagacatacgtgtgcatgtgtctttatagcagcatgttttataatcctttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcttctccagcacctgttgctttctgactttttaatgatcgccattctaactggtgtaagatggtatctcattgttgtttttgatttgcatttctctgatggccagtgatgatgagcattttttcatgtgtcttttggctgcataaatgtcttcttctgagaagtgtctgtttatatccttcagccactttttgatggggttgtttgtttttcttgtatatttgtttgagttcattgtagattctggatattagccctttgtcagatgagtagattgtaaaaattttctcccattctttaggttgcctgttcactctgatggtagtttcttttgctgtgcagaagctctttagtttaattagatcccatttgtcaattttggcttttgttgctattgcttttggtgttttagacatgaagtctttgcccatgcttatgtcctgaatggtattgcctaggttttcttctagagtttttatggttttaggtctaacatgtaagtctttaatccatcttgaattaacttttgtataaggtgtaaggaagggatccagtttcagctttctacatatggctagccagttttcccagcaccatttattaaatagggaatcatttccccattgcttgtttttctcaggtttgtcaaagatcagatggttgtagatatgcggcattatttctgagggctttgttctgttccattggtctatatctctgttttggtaccagtaccatgctgttttggttactgtagccttgtaatatagtttgaagtcaggtagcgtgatgcctccggctttgttcttttggcttaggattgacttggcaatgcgggctcttttttggttccatatgaactttaaagtagttttttccaattctgtgaagaaagtcattggtagcttgatggggatggcattgaatctataaattaccttgggcagtgtagccattttcacgatattgattcttcctacccatgagcatggaatgttcttccatttgtttgtatcctcttttatttcattgagcagtgatttgtagttctccttgaagaggtccttcacgtcccttgtaagttggattcctaggcattttattctctttgaagcaattgtgaatgggagttcactcatgatttggctctctgtctgttattggtgtataagaatgcttgtgatttttgcacattgattttgtatcctgagactttgctgaagttgcctatcagcttgagattttgggctgagacaatggggttttctagatatacaatcatgtcccctgcaaacagtgacaatttgactttctcttttcctaattgaatgcgctttatttccttctcctgcctgattgccctggccagaacttccaacactgtgttgaataggagtggtgagagagggcatccctgtcttgtgctggttttcaaagggagtgcttccagtttttgcccattcagtataatattggctgtgggtttgtcatagatggctgttattattttgagatacatcctatcaatacctaatttattgagagtttttagcataaagggctgttgaattttgtcaaaggccttttgtgcatctgttgagataatcatgtggtttttgtcgttggttctgtttatatgctggattacatttattgatttgcatatgttgaaccagccttgcatcccagggatgaagcccggcttgtgggagtccttatagtcatttgagagctttcttgttatctggtgtgacaagatgtaccagcctttctagtagctctgtctcttgtgaagagtgttatagagattcaacactctggtctctttaatattgttgaagttgcaaatgtccgtagaaattttcattttaggaaggaactcctttgtcacaatagaaatgcaatgtaatttcttatgcatttttttccccaaataccaatcccatggctttagttactatctaggtataatgactaaataactttccttggcccagctctgtccaatggagatactatgtaaaccacatatgtaatttaaaattttgtagtagccatacacaaaacttagaaagaaacaggtaaagctaattttaaaaacaatgattcaaccctatataccccaaaatgttattatgtcagcatgtaatcatatgaatgaaatattgtatagtttttattatactaaatctttgaaatctggtgtttatcttataacacagctgaatttggactgggcacatttcacatgtggctactgtaatgtacagtgaagctctccttctacctaaaatgttatttcttatttctcatttgcctgctttgttacctgtcaagtgaaatcaattatttctgatttgtacctgtgtggtttttttgttttaattattggtcttaacaatgtgttaggtagaaacctctgtgtcatacttgattcctgcttctctcacacatctaagttactgaatcctttcaattttatctcagaagtctgtctcagatctgcccattaaaatttttttattacacttgcctatttcatatccctttttcatgccttgtctgaactatttctagcagctctgttacaattttcctttttcagtgttttcttctgccaatatcagagttatccttagaaaattacctcttcatggccaggcatggtggctcacgcttgtaatcccagcactttgggaggccgaggcaggtggatctcctgaggtcaggagttcgagaccagcctggccaacatggcgaaaccccatctctactaaaaatatacaaataaaattagctgggtgtggtggcagtcgactgtagtcccagcagctcaggaggctgaggcaggagaacccaggaggcagaggttgcagtgagctgagattgtgccattgcattccagcctgggcaacaagagtgaaactccttctcaaaagaaaagaaaagaaaagaaaatgtctcctcatgctgtggctattttaaaaaattgtcgctgtctttttgcctgcagtttacaatccaacctctagcttggcattcaaggcccttcctaatagttgaaacctctgtactttaccttacacgttatgctccaccacatagtagttctaactacagctctgaaccatcatatctttacacagtttttttccaaaggccatttaatccttccagtgaaatattctttttcattccttgcttgcctggtatgtttttacttgtctttttaatagtaatttaaataagcgtctatgaatttactctatgacgtgtttcttcacacaagatttacccaagatctacccgtttctgttttcaccaagctatgtgcattacccaagctagctaagtaagctctgtatctcacttatatttctgtcttttaatattgttgtgatatttgcaacacagcctggattcagctactgtttgcttgaatagttagtatgctttcagagtaattggtgtaatgtaagatttcattcttttctaaatttagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaagtaagtatccacttatattatacctttttgctccaggtaaaatatttatttcatttttttctattgacattagtactgaggaaatgctaataattgtatattcttcattttccagccattttaaaaaatatttctgagcttaattaacctgttagttgcttatttcatctcaaaatacagattttggcctttagaagaaaatatatgtaatagttgatatttgtctttttatactaagtactgaaggccaattatatgtttaaaaaattttgtgtgttacattataagcaatctgtaatttttaatttatttaaagttagatagtggagactttattttggcatgtttttgatatattagaacatacccaatgtcattattataaaacagaaataacagaccaggtagcattcagggatctttgcttgcttcattgtttggaggggaggtgtaggtgggtaataattcggtaaatattttttgtttaaagtatagttcctactttcttgctaaattgagcaagccattgcccttttatagacaactttccttctctcataacagaaagtacttcaggaattgggcgtgattatctttatgagtgcagaataagctctacctttgtatattaagtcagtatattcattactacctaaaggtagaaacaaatgacgccatctttagaatattgctcttatgtgttagttataaccttaaagattttgaactttctcagtttaggagaataaaaagtcgaattctctaagcattatctccaaataaggttgatatatttataaaattaattttgtattgcctgtgatgacatgtgaacattttaactgtttattaatttttttcagccttgataaattgcacactgcactttctgagttatgcttctctataaattatgtaccaaacatggtggtatgggaacatacctttaccccacgagaatatttgacttctcatctggaaatacgctttaccaagtaagaaagaatattgactgtttttgtttgttgactcagtaatgagtttgttatttaattatacagtgttttataaggaaaagcattagtagaactggattagtgttaagaataatgaaccgggccgggcgtggtggctcacgcctataatcccagcactttgggaggccgaggtgggcagatcacgaggtcaggagatcgagaccatcctggctaacacagtgaaaccccgtctctactaaaaatacaaaaaattagctgggcgtggtggtgggcacctgtagtcccagctactcgggaggctgaggcaagataatggcgtgaacccgggagacacacttgcagtgagccaagatcatgccactgcactccagcctgggtgacagaacaagactctgtctcaagaataatgaactgggaaatgcaaagaatagtgaactgaaaattactgaagatacccagattcttttctcatacctattagtattaactagtaacaccaggcaaaccagttaatatctctgagtcatagcttccttatatacaaagtgagaatattggagcaaatcaatgtatttcatcttgcaggtggcaacccagtaggttcatgaaatcagtttattaggttgtagtcaaagtttagagaaaagtgggagggaaagaaaggacaagaggaagaaaaaataggaaaaaaaacccagtacactgtgtgcattaaatatatatattgcttcgtgaaatgtttcagttacatgtatgcatgtgtattgacttgcagtgttaagatgcgtgtcatgcagtaggtcacagtaaaatgtttgaagacctgaggactagatgaacccttacatgttttctgaattcacatgttgctgttaaataagccaatagaattctagattcttgaattctcaattctaattagaatttcctgttatatatgaatatatattttatgtatgtatatgaaatagtgcattgataagtcagaaacctttcaactttatatatattgttttaacctttttctgaagttacatccttatttattaatatttattcatgaaaatttttatttatttgacaatttttttcttcaaagccttgaagcaatttataaaacaaaattttgccaaaaggttttcaaagtttctgtagtcattaacaggtggtgtttgtatttgcactatatgcttaacaatgtgttaagtactctaggtaataatgagataaagatagaactgtagctggtgagatgactaaaagaattagagaacagaatatgacagtatataaagtggcactaagttgagtgttaaattatcagttgacttgagaagagtctggtgatgaactgtcttttgttctccttagtaagtcaggcatcctgacagtaaaacccagaatgccctagaacttagaccaaaggggcattgtgccttgtggtgtttattattctcaagtgggttagaggtgggacattggtgggtggaagggagagttcagtgtacagctcccttgttttccttgtaaacagtctgctttgttaatccacagagaagcagttttttttttaaccaaacatctacttagtgattaggatcaaggcaaggggaacagcttgtttaccttggaaagattttttattttatttaatttatttatttatttattttgagacggagttttgttctttcgtccaggctggagtgcagtggcacaatctcagctcactgcaacctccatctcccaagttcaagcaattctcctgcctcagcctcccgagtagctgggactacaggcgtgtgccactgtgcctggttaatttttgtatttttagtagagacggggtttcgccatattggccagccagatagcttgtgaatattagtgggttggtttttgtcaatcaactgagcacagtcttaggacttagggattatacactaggatagcagttttcatcttgcgttggctcttcttggcctgtttctagtgatgggatttgtcggttgtcttttaaggattcatccttacaaatacaagtctaagatctttacagatctaatgctcagggagttttaaagaaagtgaaataggggtggtcagtgtaggataagatcatttagggaagtattttcaaaatttgtgtttcctttttagtcgtatacagtttcttgagatataaacagaactgttttatatgctatgagtgattaaagaaaataaagttgtttgttgccttattttgtttgactgtcatacagtttgtttagaggcagcactaagtcaggcagatctgcggtcaaatcctagtcataaccacttcccaacaaaaccttatcaatttatgtgagtcctgagctttatttttttcctctgggagatatagtgataagtacattgtaggtgtttattaaatgtgaggattgtaggtaatttatataaagcctcaaaaactactggcacctaacagtgtcaaataaattcaagctgtagactaaatagttcactgtccttgctacaaacaacttaccatgttaaagcaatttgtaaaaccctctttatacttaaatcacttttgttactggtatacttagaatgtttttaatcattttattcacatttcgttgtagtttttaagttttcttttttcttttttttttaagacagtctcactctgttgcccaggctggagtgcagtggtgcaatctcagctcactgcaacctctgcctgctgggttcaagcgattctcctgtctcaacctcccaagtagccaggattacaggcatgtgccaggcccagctaatttttgtatttttagtggagacaaggattcaccatgttggccaggatggtctcgaactcctgacttcaagtcatctgcccgcctcgtcctcccaaaatgctgggattacaataggcgtgaaccaccatgcccggccttcattctttttttacgctgtttcctgggaagataatgacagtaattttacagctttgtaataaattatttttaaagttaattttattgcttgtttaatattagataacagtaggttgagtggtttattttacatgaatggaaaagtcagaggcttttcttattcttctatcccttcttcccaggtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtaaggaatgcatttagaaatttgtagtagcggaaaatttgtaatgaagtacttaggaaaattaatttttttgtgaataagtacttattcatattatcagtcaacttaaaattatatgcaggaatgtatatcatgatacattctgaattaagcagtttcttccggttataagtttacgtttctccttaggtatttggaaactttgttacgacaagtcagcaatggccatatagcatattttcctgcaatgaaagcgtttgtgaacttacctacagaaaatgaattaacattcaatgcagaggaatattctgacatatcaggtgaatagtactataccacagtttagagaatgaagaacacttaattcttttgctagtgtcttgattctttagacttttgattctgttgtgactatttcattcaattatatgcgtaactgcatattgtatcttagaattacttttgcattttgtattctctctttcactctagagacttttatcaggattttacattagtttttataatgagatgttgtattgtgttaatgttcattttcttaaagtatttgctctgtcggaagtataaaattaagtatgttttctttcagaaatgaggtcattatcagaactactaggcccatatggtatgaagtttctaagtgaaagccttatgtggcatatttcatcacaagttgctgaacttaaggtaatatagtctttattaattttagcttttaaacattaattcctgaaaaacatttcagggatatgagcaacaagcctacaatgttaattattttaatccaacatgaaagtactaatatgaaaatgaaaattaaatagctagcaaggcctttttatggcatcttagtttagttttctctattttgtaggtgagaaaatggaaagcgaaaataggtgaattgacttggtaaaggggacagaacctcagagtctttggcttgtggtcaggccttcatagtattgaatcatgatgttttctttgaaataccagcttcaaaattccagccaaagttaacaatttgttcacacttgcggtttgaatgtatttgctttccatagattataatacaaaaattactgggcttattgctttttcttaggtaatcttttaaattatcttatgccctctaagttgaatgaaaaatgccttcagaatgcttaatgtttcagtaaagatgtaaaggaactgaagcaacaacattttaaatacctttttattagccttttagaaatatcctacagctacggtgatttatattaaacgaatctgtatatataataactatgtagtttttgaaagaatttgaacttgggccaccaaaacttttgaacttacaagcagaatagagaaatcatgttttaaaataaacattttcttcgtaaaagctttttggtggttacttgagtcttgatattttagtttttgtttgtttgttttttttttttttttgagatggagtctcactgtgttgcccaggctgcagtacagtggcacaatctcaactcactgcaacttccacctccgaagtagctgggactacaggcacgcaccaccaagcctggcttatttttgtatttttagtagagacggtgtttcaccgtgttggccaggctggtctcgaactcctgacctcaagagatccacccacctcggcctcccaaagtgctgggattacaggcatgagccaccgtgcctggccaatttttagtttcttaagaaaatgatagacggtagtggtaagtagcttacagttcagatgtagcacatagagttctaaatgtggttaatctgatttactgaaaattgagcaaatatatagaacaagttaatttccacaaacttaatagtattttgctgagtgaataaatagcaagagtcagtgtgactaaaagcttagtataatcaaagatttaaggagaggcaatattacccattggttaagaactcaagctttcagccaggcgtggtggctcatgcctgtaatccagcactttgggaggccgaggtgggggattgcctgaagttaggagttcaagaccagcctggccaacatggtgaaatcccccctctactgaaaatacaaaaattagctgggtgtggtggtgggcacttgtaatcccagctactagggaggctgaggcaggagaatcacttgaacccgggaggcggaggttgcagtaagctgagatcacaccactgcactcaagcctgcatgacagagtgagactctgtctcaaaaaaaagaaaaaactcaagctttcaagttagactttcctgaatttcagacctgtcacttacaagctttgatttcggacaaatgtttaagcttgtactttgagagaattttatgagatcatgcatgtcaagcttttaggtactcagcataatgtctgttattttagtattcattgtatcattatcctctcattgttatttttaaagttttctgcaattattgtataaaagtcaacttttagatggcttaaaatataaagtttataaactttatatggttgtaaatatacaaacattgaaatgctggtcttggttctttacaagcagtatcattcttatttattagactaattctgctgtaaatacataatttttttctatcctactgttctcaaataagaaatttctcatctccaattttttttcttgtgttccttcagtatgagataatagaagaattatggctctgaaattttactttagccagctattttttatttcagactgaataaactaggcacttctagaattatctgtattattttttgcttttttgttatttaatttgatggatacagtatcatggtatggtaataaaaattagcctattttgagtctctctgaattcatttatatgaacagttccttaatactgcaaggatctggccttctgcttttccttcctccttcacttttctagcatggctggcctgattgctgttgtgtcatttcaaactacccttcactaagacatggtcataacttgcctgttcgtgacattcatgtatttttcatatgtcaccgtatcagaatgtccttcctgaccaagctttctaaaatagcaaacatcactttttattctcttcattcagctgtatgtgtatcttaattgtgacctctcatgcagtgtatttgttcatgtcactctcactagagtataaatgcagttctaaactctgttaaaaccttgctgcagacctaacacatattaggcacttagtaaatatttgttggatgcaaaaataaaaatagctagctttgtttgtttatttgttggagacagagtcttgctgtgtcacccaggctggagtgcagtggtgtgatcatgactcactgccagcttggcccccctgggctcaggcgattctgtcacctcagcctcctgagtagctgggactacaggcatgtgccagcaagtacggctaattttttgtagagacagggtttcgccatattgcccaagctggtctctaactcctgggctcaaatggtccacccacctcagcctcttaaagtgctgggattacaggcacgagccactgtgcctggccccagctttcttaactctgttttattcaaggacttttctaagatcttcacttatcttattaactcctttacatctttaaaagaggtgttttccttattttacaaattaggaaagtgaggccaagaaggattaaataacttacgcacgctcacattttagtcagtggtgaaactgaaatttgaactcagtctgtctagcaccacagattatgctagtaccatgctacactgcctgtagagctgagagggatctcagtagtcatctaacctactcctatctgatgaaggagcacatgttgcatttttctagatgtattagctagtctttttgaaaatgaggccatcttatcaattactgtacatctctagtttatgttgatttagtatctaagtagtaattttttattggtccttattcttacatcaagaggcagggattgcctttgacgagatcactcttcacgtatttaaaaactgcttcccttcatgtatcatctttctcttcctcgtgtggaatatattcatattcagtctctttgccatctttctcactccttcctctgtacaaactctgttttttttgttgtcactcttagagaatagtgccctgaaccaagaatgagtttcagataaggtgtgatgagtgagagtacatttatctattctggatactgtacttactgacacagtttaagatagcatgaacacatttggtagctatgccatactgttttcacaatcaacttgcaatcagatgaattgtctctttttttcacttatgctaaccttaaaccatggctttccacatcttatattttgtgaaatttttagacctgagtgtatgctttgtagtttttcttagtagagtttatcttgttaggtattgtccattattctagggtctttttttgagtacagattttatcctagtcttttaacaattattttataaacttaactattttagccttgtctgtaagtatgaatgttatcaaatatattctcattcttgagaagaaatggaaggtgcttatgttttaacatttctctcttatattttggagtggctgtattctcgctcagatattaaaatttaaagttaggggaatgcggaacgactgtaaacaatgttgactttttaaatatccttaaccaagatggttaaggatgttaaaacattttttcttgaaaacttttgatgttagctttctagtaatctcctatgtgattcttttcttacttgacttttcattttaccttcataataacttccatattttattaatgatttaatattgtagtaatattttttggtatttgtttttacttttttgcttctcaaatactaaatcctgacttatttaaggattatgtttttcagaaggcttcctatgaaatatttatatttttaatattgtgccttcatcatttagttcttcaaaacaaggttaattgtaaggattccattttctggaattgtataatgttttatagtgattttgtttgagttctctcctaataatccagattgtttagtattcaactacttgtgtattattaagaacttgagaaggtgtttatttgtgactttgttttctcagcctctgtgtactgaggcatacttcatacgtattcttatattttattacataagaaatcctacagatcataatgatgtttcatatagataaattcagtgtgttgtatactagtctgtctcattgaaataaatctctaaaagttattctgtcagtgatgattctaatttttttagcgtcctataaaatttccttagaataacctaatttttgaaattataggaacaaaagaacttacagatttttgcttccagtattggtaggtaattcagacctccttatttccaaagaacaacttaaaaagctggagatatatatatatctctataaaataatcttctttaaagaagaactaaaaagatagtgaagtatttctaggctgacgccaaggagaacctgggaaatcagagacataagcccagctttggaagccacttttcacccaggcatgtgtactgaagcagaagtaacatttgtaaaactaagctgaattctggtggccttgtggaacaagggtgtcagtagtcaaaaacctagagtaaagccttctcaaagtagggcatgggaaggaagtctgcataatttctccccagccctctttacatagacactgtctaacttcggggtaggggtgaactggaaatgagtcacccctccccaggatttgcagccctgtttatgttatatgctttatctaaggcatctcaatccttggacctggattaatgtggtcctaggttggtagtgccccaatgtacttagcagaagctaacacagatcttctctggagaaagatatcctcatcctaggcttcagatgattcctgcaaataattcatcaagcacatgaccttcagctggagagtggaagtcttttggagattagtgcagggtggaggtaggaggttttatatatctggcaggctgccatgattaaattattgtcttgttttcagcctcaagccttcctttctgtgccattgccttcaatttctgatcccttcctcctttcctccctcttgaggtgtgatttaacttgcttctgcattttatctccattataagaacttgctaatcaaatttctcacctctccttattctttgctctagtttccatcttccaggaatttgttgacttttctcctttgatcttgttttttctgctgtttccttttttttttttttggtaggtttatgcctttatttttttacctctgacttgagtggatttctgaaaggagcagttttagacatttaaaattctctacatttaatcagcacttctacatagtttacatacttgtttgagcattttttttttctttccaacttctattttacgttcaggggtgcatgtgcaggtttgttatatgggcgaatgacatgtcatgggtttggcacacagattattttgtcacctaggtagtaagcataagtacccaataggtagtgttttgacccttaacctcctcccaccctctaccttcaagtaggccctggtgtgtgtcgctccttttttttttgtaaacagagtctcgctctgtcgcccaggctaggagtgcagtggcgtgatctcggctcactgcaagctctgcctcccaggttcacgccattctcctggctcagcctcctgagtagttgggactacaggcgccgaccgccacgcctggctaattttttgtattttttagtagagacggggtttcaccgtgttagccaggatggtctcgatctcctgacctcgtgatccacccacctcagcctcccaaaatgctgagattacaggcgtgagccactgcactatctatgtgtacttgatgtttagctcccatttttaagtgaaaatgtgaggtgtttggttttctctttctgtgttaattcccttaggataatggtctccagctctatccatgttgctgcaaaggacatgatctcattcttatttatgactgtgtagtagttcatgatatatatgtaccacattttctttattgagtctattgtcgatgggcatttaggttgattccatgtctttttgttgttgttgtgaatagtgcttcagtgaacatacacatgcatgggtctttatgttagaatgatttatattcctttgggtatatacccagtaatgagattgctgggttgagtagtaattctgttttaagttctttgagaaatctgcaaactgcttttcacagtggctggactaatttacattcccatcagcagtgcataaagcatttctttttctctgcaacctcaccagcatgtttgagcattttgataggaaacatttctaaaagtggatcaaagaatatgaacattaattttttttgatattaccaaatatccctctgaaaatattgtagttcacactctcctcagcagaacattgtgatatctctaatagcatcttagtctttttggagttagtatatacagtgttttgtgttttggggggaattgtaatattttaaagatcattctgtaatttctttgctggtttttttttctttctttcttttttaagagacagggtctccctgtcacctggtctggagtgcagttgcacgttcatagctcactgcagcctccaactcctgggcccaccctcctgagtagctgagaaatataggcgtgtaccactgtgcctactttttttttaagctttttttttgttttttattttttgagacagtctcgctcttgtcacccaggctggagtgcaatggcacaatctcagctcactacaacctctgcctcccgggttcaggcgattctcctgcctcagcctcccgagtagctgggattacaggtgcctgccaccacgccttgctaatttttgtatttttagtagaggtggtgtttcaccatgttggacaggctagtttcaaactcctgacctcaggtgatccgcccacctcggcctcccaaagtgctgagattacaggtgtgagccaccacgcccagccttttaaagttttttgtagagacgaaatattgctgtgttgcccaggctggtctcaaactcttggcttcaggtgatccatccaccttggcctcccaaagtgctaggatcacaggtgtgagtcaccatgcctggccacttctttgcttttatttccatttttaaaatatttaatctaaactgatataaactaagtatcatttgattcaatctttttctttttatcttaaaggtgatcttaattattttagttcctgttttagccgaggacctttttgttttatagggtaatttgtgtgctaattaaagaagtagagcttttttatatttgatggttgtgaataaattgtgtgtcagacataatcaacactatgtacgtgtacttatggtgaaacatgtttattcctttcaggagaagaaagcaaccgtctttttttctacgaaaattcttgggtgttttatttggggttgtgcgcgttgagtccatttctccttccagtctgccaaaagaattgttttggcattttacagatcagttcttctagttcttcatgggatcctaaaggacattttttcaaatgaagtaggaaatttaaatatgaattttgccaagaatttaacactttctttttaacacaataccaactaaattatatcaaacttttttttaaaaaaaatcttgatttatttcacttgctttgtctaaacttattctaaaccatttcattggtaattcctattattactgccagctttcagtttattcatcagtgagattaatcaataactttatagagagcaaaaatagtaagccagcaaataatttagggtaatggttcacaaattttacttctcagaccagcagaagaagcattactttggagctggttaaaaatgcaggtttttgttctctgtctcagacctgctaaatcagaaattctggggctgggacccagcaatgtgtgtttgtaaggagttctctagagaatttttatgcgcacaaaagatggggaaccatttctttagggattaagaacatggattttaaagtgagacatacccgaattcaaattccaaattaactgttgaatatcactgtaactttgggcaagttatccaacttctctgaccttagtttcctcagctgtaaacttggaatattacctaccttaattggattatagtaaatatgattataagttaccttgtataagagcttaacaaatggttataattgctcttattattaaacatatatcagtatttctgaaatggtatgtatcttatagtgttagtagttgggttttttttttccttttagtgacacatagaataaggtgcattttaaattcgatggtgttgattcactgatatgtgatacgatgtttaaagtgcatggtcactatcaggcttgggcatagagtttgagtgtgtattgaatccagttttagatttggagagttttgttttggcccagagagagcaggcagcctaatcagagaccatagaagttaaattcagcaaataaatgtgactagagcttaacttctgattagcagcataataagaaacaatctgaagtaataacatcaagcaacctaaacaaaacttatactaatgttttcaaaaaaagtatttttatggattttctgtgtagtttttttcccttaaatcagatgttatcaacctttcgtttgtaaaaaacaccatggcactttatatgcttgctgcaccttcccaaccaggtctgctgaattgaaataaccaagaatgaagcaatggatatgtgtatttggaaagagcaccacaggtgattgtgatgtgtacaagggctgagaaccattatagagaacaaaagtaaagaaaattctgatttacaagaactttgtagagatatagagatcagaaattaaattataaacttcacttacattgtgaaagaactgggaagtgtgatagtggtgaacttagtggtgaaagcagaccgcacaggtaactgcaacaaagagcagaatgtctctctcacttctctctttgttgttttagaaactcggtttattgttgtctaggcttatctctgacagaatgaaattaattacatttgtgttataatttttaaattactttgtaatgtttcttttgaggagaacattcttcaatgagttatacttttcttgaatagttatccttcacacccttcccttatttatatctcttccttcttttctcttcccttttctcagtggtctgtgaaagaggagtagatagtttatacttccattttataatttttgttgggaaacattactattatataatccccatcaagtggtaccataccataacaagtcattctccctctacttgtatgtatccagtaatactcattgtctacaggcatactctagcctgcctttggccaggtttaactttagctagtttttttgtttcagttggaatttgttgctatgtccattttagtgtctactttttattattgatgccgttcagcgtctaagtaagcataagatgattctttatcctactacttacctttgttgcttttcctgaactccttccttcttgaatttgtaaactgaagggaaacactaagcttatataaataattttcagatgcttttattgaaacaacaaaaaaatatatgtagcatagagcgtctggatttcatgaattgtgtttcctacttgccagattgtaatttccaagcatgctcttatctcattaacacaaagaggtctgtgcctgacctaggatctttcttttttttttagaaacttgtggtggagaatgttgatgtgttaacacaaatgaggaccagctttgacaaaccagaccagatggctgcactgtttaaaagattatcatgtgggtaactcatgatactttttataaacataagaagatcttgatactcagtatttagctttggctcaaaatttgtaacataaatacaagtagtaaattatgaaaagtactctttagcttatgaagagaactagaacatttttgcagtcaaaggatcatataagtgtgtgtgtggcttatctgtttcacaatttttcttaaccatactcttagtctactatgtgtcgctagttcatgaatattaccagtatcaatttggttttgaacccattaaatttaatacagtaaatctacattaatttagactaaaaggattagcttctgagcctgttaactttctaaaaatcaactttatacgtataagttacatacaataaaatgtaccatttaagcaaacggtattttggattttgacagatggatgcattcatataaccattgccacagtctagatatagaacagttccatcagtttgaaaaattgtttgctatctctttgtagttggtctcctaccccagtctctggccccaggccaaacaaccactgatcttatttctgtcactatagattaaatttgtgtctggcctctttcacttagcataatgtttttgagatttattcatccatgttgttaagtgatcagtaatttgtttctttttgttattagctaagattgatgaaaacctgaacctacaacttaaaaaaaaattgtaatgtcttcttgacattgattctttgtgggaggtatattgtgaaatcacagtgaatcttaagtattaaagtgtgttcaagcagataactgttttagatatacttgatctaatgttattttcttttgctttttttacttgaactgttaaagttacaatgaaaaattattttaaagtcatacttcttggttaatttaaaagccttctcaacactaaaaaaaaaaaatgaaatcccaaataaaatattctttgtatttgagaaagccagagaacaagtttatgttcctaaacaaaaaataatccagaagaaaactaaagccatacatgtatttaacatacttcatatttgacatttttctcttaaatgctttagagaatcactttattaggctattttatcctgtaaaacttatttaattcttattgaataaaaattaaagattaccttataggacagatctgtggttgccaggactataaagggaaagcaatgagggagatttttagggtgatgaaactgttcaccatagtggtgatacaaatctatcatatgtgtcatacgacacatatcactgtgtgttacatagtggtaacacagatctgtacatgataacatttggggctgggtgtggtggcccaggcctgtaatcccagcacattgggagccaaggcaggcagatcacttgagatcaggaattccagaccagcctggccaacatattgaaaccctgtctctactaaaaatacaaaaattagccaggcatggtggcacatgcttataatcccagctactcaggaggctgaggtaggagaattgcttgaacccgggagatggaggttgcagtcggctgagatagcaccattgcactacagcctgggcgacaagagcaaaactctatttcaaagaaaaaaaaaatggagctgtataccaaaaggaaaagaaaaggtcatttttattatatgatactttaaaaaacaaaaaaatagacgtggtagcattatagggaggagtatgaataagtaggaaattagtttttaaaactctcctgatctttcttttgttattgtacattggtttactagctacttatattttctactcctttattcttattagttttgtttttttcatgttttctcccattttttaatactcatttgacaaccccattggccttaaccctatttactttcctactaacagtcttttgactgttccatctaattagaagcaaataatccgctgcagtgttcagtactttatttaactctcatttgtggaattgaaacaatggaatttgttaaaattccaaacagaatttgcaagttttcaaaataaaattcatagtcgtttgtcaagattctgcttacttgaattttgtgtataataattaatggtgactcattacctctaactcattggccattttggaattggccaaaaccaaaatctaaattgttgaatgttaatgacccatataaatcaaatttgtctttaaatagaatttattaaatcttttctataatttggaaaaagaaacgattcacttgagagtgactcatttaggagagtagagagaactattttttcagcaattgaactgttttccaaaactttctcttttttttaattcttttgtgcttccttctccccatgtccatatccagaagtcaatgtgtttttgaaggagtttttcacagtcaacaagcacattctttttaaaagataaagcattatgattaattaaaagtaggtctgaattgggaggcaatctggaatttattagtttatttttattttattttatctatttttatttttaaattttttgagacggagccttgctctggtgcccaggctgaagtgtaatgacacagtctcagctcactgcaacctccacctcctggttcaaccaattctcctgcatcagcctcccaagtaactaggactacaggcatgcactaccacactcggctaatttttgtatttttagtaagatggggtttcacagtgttgtccaggctggtctcgaactcctgacctcaagtgatccatcctcctcgacctcctagagtgttgggattacaagcgtgagccaccgtgcctggccttattatcagttttaagacttctatgtgacttgggcaaatctccttatgtctgtttaatatttttttattctctgacattctgtttcttgggactaggttcatcgctttactgactccctaattccagactaaaaatatttctagttttcctacagcaattttttctttcgaaaactcattctattcacatacctttctgccatcatctacaaacctataagttgcctctgaagatctttactttagcagtactttggatgttattatttcctgaaattgttccaccagtaaaaatcttgaactttgaaattcaactctcagatcacagccatgtcttctagctctcccattcctttacacctattgaactccttgttctggctcattgaaacttttatgcctctcagctttcctgatcacctattcctggctttacatattttatccattctggactatgaaatttggttagtgcattctcccttatgctgtcatacccttgagtttttgctacattcattcccacaaagcagttttcctgatccctagaaagtctcctgcaccctgaaagccaagtactgcttgtgaaataacactttttaagtctgtcgttaaactggcctctttttcatcttaccacctgtcttactttgaaactttttgactagtttgtatgcactgtttgattgtcccacctgtccactcttggtgtgctgtaatatgtccactttcctgaaacctttctgaaagtttgttggtgactactcatttgcaagatttggtgctttttcctcaactctcattctgtttatttctctgtcgtgtttatctcttttattctcctttttattaaagctttattttctttatttgccaatacttttatctctactcttcgtcgtttttgcaggttcatcttttatgtagtgtcagcttgtgatatcttactcttccatttttactctgcaatactattggaaaaattttatcccaaattttctcttcccttatccaatatttatcttcagccttaactctcttctattgatctccagatgtttaataccaagtactagtttgaccggggcttctcaaagtataacccagggacatgtaacagcaccacctgggaatttgttaagcatgtaaattattgggccccacctcagacctgctgactcagatctctggggctgaggcccagcagtctgtgttttaacaagtcctcggggtcatttggaatcatacaaaagtttagaaacattgtgttaaatattttcagctatatgacccacaggtttttcacaacgtccctggaatgggaagtatctcttccatggcaggtataagtaggtggggagaaaaaacctgatgttttctttattgactattttgttacctctctcaccatctatccattgactcacactggaaaacttgggcatcctctctgattctttcactcctcatattccatgtgcagtagctatgtcttatagatgagagtttacaaattggtgtgtcacatttggtccaaaggtatacattgtttggccctatgctacattaattttttttttaatttgggtcattattttttaaatgggaagagtcatttttaaatagaattcttttcgtataactctttatattttgaaaaccctgaacaacaccctcattgcttgaaggatacagtataaactccttagcatgaccttcaaaagctattatttggattaatgaaataattgactggcattacctccctctctgtcccccactacctatttgtttgcctggtccaagacccacatagcctctgttctagagttagttccttgggaagttagtggatgttatgtggggtgaagggaagtgccagtggtcaaatggtttggcaaataatccattacacaatacattaagcagtgtttcttactgtgaagtatcttagaacttttaatgtgtcattattgtacacattcaagatgaggttgtagggtatagtctttgagaacttgattaatttctgggtaacatactttggaaaatatatggctatatcacactgaatcttgtctgttgttatttctagtgtgaatctttttttttttttttttttttttttttttgtgagacagtcttgctctgttgcctaggctcgagtgcagtggcgagatcttggctcactgcagcctccgcctcctgggttcaagacattctcctgcctcagtctcccgagtagctgggactacaagcacgtgccaccaggcttggctaatttttgtatgtttagtagagttggggtttcaccatgttgcccaggctggtcttgaactcctgacctcaagtgatccacccgcctcagccacccaacctagtctcatcttgaattaccatttaattgaatatctactggtcatctgggtatcagacactgtgctgagtgctacaggtagatgagaagattaagagtagttcctgctcacatggaatttttaataaatttgcgccttatatcattttgttaacatgacttttaattcatatttggcttatattaggcctatttgtatggtttagtgaaagatgctatggtcaaagtttaaacaagctacacagaaggtagaaagttaaaataaaacacttctctctattcctactcctcaactagtaactttaacagttactgtagtatatacatctctttccagaaatttgttatgtatatacaaatataggtctgtatatatatcttttttagtttacataaatggaattatatttcttagttttcatgacagcccatttagactgtctgctattcgaggtctaggtcattattctgtttatatttcttcttttactacacagtgtaaggctttgtatatggcgtgcaataaatgtttgttttggctttataaaatgtgaaggtattgaaccatcatattgacccttccaatcctactttgttaacagagttttatttttttttagagatggggtcttgctcctttacccaggctgatgtgcagtggcatgatcactgcaacctctgattcctgaactcaaaggatcctcccatcttagcctcccaagtactaggaccacaggctcatgcccccacacccgattgatttttttttattttttgtagagacagggtcttgctatgttgcccagggtgcttgtgaactcctgggctcaagcaatcttcccggttcagcctcctagaatgctaggattacagatgtgaaccaccatgctcagccttgaaaatctattaataatttttagaataatgctctctaaccaatatgtaagtgatcaaatctgttcagcttcagcaaactggtcctgccaaaactgcatgtgttctcaacaggcattttttgtttcttaactcaagaccttaacaatttaagaatttagcactgctgagttcctgggccgcttgaggatttaactcctgttcactctgatcagcttctttctcatctagtctcgcttcccttctttctgcccctaccttttctgaaatagggtttcagaaggtagtaatataatttatataaagttatattataaatataatttatagttagctacttgtgaaccatctaactcatatgaaagagcacaatatactccatttgatggaaactatagttacttaaaagtttaaccagtttaaatatcagctatcaacatctttctctctttaatcattattgtaatcaaattactgttaattgtgccttttatcatgggaattttattactttaataaatttagatttttttccaagtttaagaaagaatccagttcacacttttttattctcttctccttctgtttctttgaatttagctgttgacagtgtcttgaagaggatgacaataattggtgtaattttatccttccgatcattggcacaagaagcacttagagatgtaagaaaccattacaagtatatactcggtatccaaacaatcccttttaatttctcagaaatttaaagttaagtttcagattcatgcttagcaatgatataattaaaattccagttttagtagttacagaaaataacatacataaaattagttatttaagctcattttttgttttggtactgctgcttgcagagtataacttgcgtggttattgcactactttttcagtgatcttcattatcagtagagtattttcaattttgactatactggctttaatattgaattattttgaatccatttaattttcatatgtcttgaaatttttgaaaaatcactgaaagtagataaagtaaaataatttttatgaaaactaaaattaatcaattggtaatattttgtaaatttaggggttgccatttaaaaataattctgtattcttatttgttatcctgcctaggtcttatcctaccacattccttttcttgtaagttcaattgaagattttaaggatcacattccaagggaaactgatatgaaggtaataatataatttatagttggggtttacagtctctaaagcgaaatatttaaattacatatgcaagaaaatgtaataaatcctaaactactgtaaggtttctagtttagagtggttagttagcatgcttgcctttgtaattgaatctttgagagctcagcaccaaaatactacctaggcattttgaaagtcagtcttctttgatcacctatagcaatgcaaaattgactaaaaatagattttttttttccttaaatggatagctgtttatacatggtgataaagaaaattaagaaagatgaggtggccaggcacggtggctcacgcctgtaatcccagcactttgggaggccgaggctggcagatcacgaggtcaggagatcaagaccatcctggctaactcggtgaaaccccatctctactaaaaatacaaaaaaaaaaaaaaaattagccaggcgtggtggcgggtgcctgtagtcccagctactcgggaggctgagacaggagaatggtgtgaacctgggaggcggagcgtgtagcgagctgagaccttgccactacactctagcctgggcaacagaatgagactccgtctcaaaaaaaaaagaaagatgaagcaatgaaataatagtcgttttaaatacaatgaaattcaataagtttaagatagatgttaagtcatttcttataaaaggatgtaattgtaggctgtaattttaaaaagatttttagtattctattatatgtaatatatatataaaacagcaggttggcagacttctgtgagcttacagtttttgttttgaaaatctattgagccatgaaatccaactattgatctaatcctagtaatgattgaccagtggttatacatctagtaagtgatatatcggggtttacatttgtgttttctaagctgacacatttcttagagagattgtttctgtttcacatatcttgaaaaacaccgactgaaaaaaatagtgtctaaactcctttgtatgacaccaagactcttctgaaattggtgccactcaggctgggcatggtggctcaagactctaatcccagcactttgggaggccgaggtgggcagatcacctgagcaaggtgggtggatcacttgaggtcaggagttcgagaccagcccgaccaacatgaagaaaccccatctctactaaaaatacaaaattagccaggcgtgacagtgcatgcctataatcccagctactcgggagggtgaggcaggagaatctcttgaacccaggaggtgcaggttgtggtgagctgagattgcgccactgcactccagcctgggcaacaggagcaaaactcccgtctccaaaaaaaaaaaaaaaaaaatgtggtgccactcaaactttttgaggcttatcttctgccacttctttcttccttctctcactctctttcttactctgtccctctttttatatggtattctgtgagctaactagatctttctgttgcattctcacatctatctgttttaccttctaatttattctacttgaaaataccaaccttttctctttctgccttttgaaatcctgcctgtattttaaggcttgattcaattgccattttctaagaaccattcctagattctccaatgataaagaacttcttctttcttagtgttatcagagaacttgtttatctcctgtggagttgaatataatctgccttgtattataattctatttttctacttatatttataccaaatggtatatatcttgaagacccagactttgtttttttggtgttgttgctgttgtttctcttacagtgttttgtgcagaataaacatttgagatcagtgattgtcttgtgattctatgattgaaaactatgtacaaatagctcaaaatgatttcctaagtggaaacactgcagaaaaaataaagttaaggagacaaaaactaatcagttcttgagaagacactgatgtgcagaattataagaattctaattaatattctgagcaaccattcacttttcacctgacataatcatgtttagtttccagcaaactttcaatagaacttaacttttaaaaaaaaaaacaacaaaaaacaaaaacatgtttttaaacagctttattgagttataacgcacctatcagaaaatttactcatttaaaatgcacaattcagtggtttttagtgtagtgacagagttgttcaaccatcactaaagtcagttttagaacattttcatcatccccaaaaagaagccttgtacccattagcagtcactccccattccacttctcccccatccccagccctaggcaacgactaatctactttctgtttaaattagcctactttggacacttacataaatcatcatgtgtagtcttctgatactggcttctttcacttggcatattttcaggattcatacatattacagcatatatcagtactttttttaatgattgttgaataatgtttcattgtatgggtatacaacattttgtttattcacatcaattgatggacatctgggttgttttcacttcttagctattagaaacactgctactgtgaacatccgtgtacaagtttttaatgtgtgaacgtgtattatttctcttgaatatataccaggagagaattgcagggtcatatgaaaactgtatgtttagccttttgaggaactgctaaactgttttcaaattgggtgtgtcattttgcattcctaccagcattgtatgagggtttcattttttctgcatcttcactaatacttgtaattgtctgtgttcttaatcatagccatctagtgagtgtgaagtggcatctcattgtttatatttgcattttcctgatggcaaattatgttgaacatgttttcatatgtttactggttatttctatatcttctttggagaaataaccattcaaagcctttgacattttaaattgggttgtctttttctatttgtgagttcttcatatgttttggatacaagtccattaacagattcatgatttgcaaatcttttctctaattctataggttgatgatgtcttttagtttcaatgaagtccattttatctgtttttgggggtttgtttgtgcttttggtgtcagtctaagaaaccattgcctaatgcagtgtcatgatgatttgtgcctatatttttttctaagcgttttacagttttagctcttacatttaggtttatgatttattttgagttaatttttgtgtgtgaagtgagtaatagattacaaacattttaatctagaacttaatccctgccatgttcccagtttttctaagctatactattttacttcgtattttatactaaggttttttgtcgcaatatcagaggtaaccagttatatagatagctttcttctgaggttattgagcagtcagaatgccttgaatatttgaaatctatatgtgatacagaaaaattactttcgttattagaaattcccttatcagatttttaaatgaatactccttaaaaaaactattataagtaatttgctatatttatagatacgatatgattagacattgaaccactataatttttcattaaaccactatggagataaacacaggtctagtaatattgattcactttgttcatttattcatcttttctgacttgatattttatattcatgcttccaagcaaagtgataactttagaattatcctgttggaatgtgccacagaaagtatacaagttttgtttggcctagcagtaggaagttagaaccagcagcacctcacagtattcaacctacattgaatcagttgttcagtatacttagttttgctgtagtttctgcttcagccaagtttccgaaattctctggtgttcttctaggcagactctaataaacagtgagctttctcagaaatttgttagactatttattgctctgtaattcttttgtttttatcaggttgcaatgaatgtgtatgagttatcatcagctgccggattaccttgtgagattgatcctgcattggtcgtagctctttcttcacaaaaatcgggtaaaatgcattagtaaatatttaatactcttagttaaagttaccagggcagcataggtataggtatgatatttaaccatatattcaaatgcctgctttgtgttcagctttttaaatttgttattattattgctggtacttggactatatcagtgcataaaacacaaacatcacccttctggaacttaagattggttgagattactgagccatttagtgtatatagatgcagcagtgaagaggatccaggtctgagccttgagccattctaagatttaagagctcagggagaaaaggaaaaaccacgaaaaaagaaatttagagaaattgagaagaaaggaccaatgaagtagaagaaaaaccaggaaagggtagcttccaggaagatagaaaggaaatgatcagctatgtagagttaattggtggtactaacaagatcagtgtcagtgaggttttatgggcaaaaggctgagtagtgagtaagggagattaagggagaacaggaggaaaggatttggagataactagaagacaactcaaagagttctattgtaaagggaagcaaagaaataaaatctcaccagctggaggcaagagcaaagtcaagagaaggatttttttaagatggaggagattacagcatttgtatgctaatgggagatggtccagtagatagcaaaaaattgagatctaggaaagggtattctgtttttattgtactagagttattcaccatcaagagttttatataaaacatttagaaatttttaagaccagcccttagaaatgcagtactcagaatcctgtagatatttcttgatttgtctacaaagtaaatatagcatttcatctctttctactactaaaatgccccttctgcctccttgaggcagcagcatggtgtttgagttcatcagtttttttttttttttcatttaacaatgcaattttgtttcctcattcatacagtatgttacatttagtcacatggataattataattattacttgatttgctacagctgtattttttgtagtcgaccaaatctttaaaacatatttcagctcttttcttacattcaattcttaattatatctaatggtgattagtagcctaaataacccacaatttgagtgcatatcacaataaatgttttagaaagggttatgtcttgaaagctttagagcaatgctgggtatttttattcatgactagtttcttctgtcttcttctgtcttcttttattcatgactagtttcttctgtcttctaaaatagagaggttgaaaacccattccactttccacatttatgtcttttaaatagtaaatttcaaattatattcatatctctttcaaaaagtaattaagatttttttggtgattttgcagaataatttataagttttctaaattgtaaatagaactgtctcataaagtaataattcctcattagttttcaattaggaaattgtaggattgcagttatcctaactgtattttttgttctataatcttacaattaaaaaaaataaaatcttaccttactgttttatcagacgtccttgaaatatgcctaagtagttgataatagtccattgtaatataaactgtttctactttatatttttataacaaaattgtgaccaattctatagaatgctagtaaaatagtttactatttcaaaaaaaaaagtaaaccatttttaaaataaaaatctgtttagtttagattatcaaatcttaactaatcttgaagaaataccttgattttattcttaatttttgtctcttagaaaacattagtccagaagaagagtataaaattgcctgccttctcatggtgtttgtggcagtttctttgccaacactggccagtaatgtgatgtctcagtacagccctgctatagaaggtaatagtggtttaaaattgttttggcgatgaataaatcatgggttttggtattttataataaaatatgagttaagttctgccactaactggcagtggaacatggggtagtctgtttcccttttcctaaactgcagtttcctgatatatgaaatgtgtgtaagtaagctcatgtgtgcctgaatgtgtgtagaggtcggtgagggattatccaactcataggattattttaaggattgaatggtaaaatgttgtaaagcagctaagcacttcctttttatttccgagctactataaaactgatgtgtgatttcttttagatgttttcagaagtgtttgcctgtttaacatatacacgatcgtttgttactctcctgttaaactagttttaaaaacatcagtgttcatgaaagtcaaaggagagcaagtccggtcatgtcccaactctactcttaattatgcccctatttatgcagattgtgaagtcattaaagatttgccttctatgtattatttgctattttggggtctacacaaccctatttgcattttctcagggcattgcaacaacatacattgcttggccaaagccatcaaccagattgctgcagctttgtttacaattcacaaaggaagcattgaagaccgtcttaaagaatttctggcggtatgtataatcaaataacaaaactcatcacattttataaagaaaactaaaattcacaaccacaaaatgtaagaataaattctctttatttttacattttatttagtgtcctctaatggcattttgttttcaaattattttctcaggtatatgaatttcagtctccttttatttttatttgtttattttcttttttggagggagaaacaggtgaaggtggggcattaaaatcgaggagccgtccgttatttcccttagactcggaagtctctttcccaactctagagctctgcaatatgaccttttttccccaagctgatgtttggactgccctagaaattttcctaggcttgaaagagaaaaaaagcaaaggaaaattgaggccaagagagaagctattccctctaaaaagacatattttacttttttccatttctttggagaaagacaattaatggtgaaaaattcatcattaaaaatactactcactaccaagagagaggagtgctaaatgtagcctcatgaaacatggtttttagtttctctatcaatgtagttctttcttttctttattaatataaccttttccatattttatttaaacgaaagatataccatggcatactgaactctagaacatttacttctttttcagttataaatcctgtcagcttttttaaaaaataatttttaaattacaaatgcaaatatagtactaacttgaggagaaaataacttctatttcaaggaaaacactattaaaaattttaagtgtttctttccatttgcaaataattccttcactcagggtttaatgtcttaatcttacagtgtttctgtgaagtcaaatccagtgtgaaactgtcttcttccttgggaactaagaaatatagtcagtatagataatgggatgggataagagaaaataatttgaatcattttaaaaagcagacttgttctgaaaaaatcagttttaaagaccaataagaatatttgattacatttattatgttagtgtctctttgtgccttaattactctctaaattactgcttgaatgtaggctatctaagctcatcttatttaattgctcattattttatatttagcactgaatgattgaaatgtgttggaagttgaaacatacctaaaataagtaaccgatgaaccttttattaacaaactcactttatgtgtatgtatacttttaagcttgcatcctccagtctactgaaaattggccaggagacagataaaactacaacaagaaatagagaatctgtttatttactgctagatatggtaagtctcattttaatttttactaacaataaaaaagttccagtcgttcctgagaatcttttcttggcatcttagtcattgaatactttttttgatcccttttgttcacttcacgtaagccacacctttctaaaatttgcagagaagactgacatcactcatattttatcatttcggtaatatcagaagataacaatcaaaggttagcattaactgtgggtattcttttatgaacagtttttcaacctgttggaaaacactcaggccttgtatttttctagtgtattggtgtcacctctcttccagttttctgagttttctacattctaactctattctgcccatttctcgtaattttctgtaattctctgtgcctagtcacttccctctctgcagtatctgtgaaccagctcttgcttgtttctaccacgtggctctttccccacttagagttattttccttacctgcagaaattggatttatcctaatgacttagcacatcccacagctcaaatctttttccagatagtctttcttgattactttggcctacattaatctttcttctgttttgaattcttacagaatttacagctttccatttcattatagtcggtcttatgtttggttttgcttcctagcttagtctttgattgccaggtagagttgatagtacaaaaaaaaaatatttttgtattgtcttttatttctagtatatcagtgaggaaaatgaaagtgctcaatatattcctgttgattaaataaatttaattgaaaagtagctctttttaaacagtttgatatacattcactgtggcacatttacattttagattaagtaaaaggaaaataatatgtgtctattgctaataagaacaatatagaagttatgccttactggttgtcaataaatgttcccattataaataacttatgatttttgtttataaacaagttataaataacttgttttgatggattttttgaattttacagattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtacctgccataacataaaataaacactagactgtatcacacttcgattga

SEQ ID NO: 36939 - DNA, 7523 bp, Homo sapiens
tgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccggtgagtgaaagggtgtgaggaggactagttagtagcagctattatcatagagggcaggcctgtcaatttcaggtggctgaaacattttaacataaaaagtaaactactagaaaatactgtagaattttttaaaattttagcgtgggagagaagctataaagagaaagattgataaatctgaatataaaaacttaaaactgctataaagaaaaaacctcctggccgggcacagtggttcacgtctgtaatcccagcattttgggaggccaaggcaggcagatcgcttgaggtcaggagttcgagaccagactgaccaatatggtgaaaccccatctctattaaaaatacaaaaattagccaggcatggtggcaggtgcctgtaggcaggagaatcgcttgaacctggtggggcagaggttaaagtgagccaagattgcaccacagcactccagcctaggcaacagagtgaaactccatctcaaaaaaaaaaaaaaaaaaaaaaagaaagaaagaaaaaaaagaataagaaaaaaaaactccccaaaacaaagttaaactacaaaacaagcttggaaaaaatatttgccagggatgatagacaaagggttaacttccctcatgttaaaagacattacatgtcaataagatcaatatttttcaataagaaaaacaaaagggaaaatgggcaaataacaggaacagaaatgtaaaccaattataggacaaaagtgctcaaacttaaagagttaattaaaggagatactaattttacctattatactgttagggacttcttttaaggtcagtatagggttggggtgggtttaggggactggacaccaccatacacattagaagaggtaccctctttgggtggtatctgataatatcaaaatttaaaccacacatactcttttatccacatgcaaaaacttgtccatacacaagaatattaagtagaatttgtaattgcacaaactggaaataactgaaatgtctatcaataggatgctatgtaagtgagttgtcatattgtataaaggaacactgtgcagctgtcagaaagaacaagaagagttatctgtgctgatacttaaaaatccccaagggataatgtttaatgaaaacaaaaagcaatcaagccacagaatgttaggtagagcgtaggcccaccacatgcccattgtgtgaggcagggagaggagatacatatatgtgtataagttaatgggaatgacagacaagtaactattaacagtggttgcctttggggaatgggattggattcagggaaagaattacttttcattttaaacctttccgtaaagtctgtaattctttatacctgtatgtagttttcacatattacccttattatttttagctagtttaaaatcgttttatattctgaacaaagttgaagatatggatatcttaacatttgaatttactcttctgggggaaaggcatgttttgtaatccccagttttcattttttgttgagacagggtttccctctgtcacccaggctggagtgcagtggcatgatcacagctcactgcagccttgacctgctggactcaagcaatctttccgtctcagcctccccaccctcccagcagctgggactacaggcatgcaccaccacacccagctagtttttgtatttttgtagagatgaggtttcgccatgttgcccaggctggtctcaaactcctgggctcaagtggtctgcccactttggcctctcaaagtgttgggattacaggtgtgagccaccatgcccaaccatcagttttattttctaatagaggaagttcctcaggaagaaaagaacttggagatagggtttagggaaaatcatacaatcctgtcttggctcaatatcagagtagtaaataaaaaaggactgattcttatacccaaatgctgggttcttatatgctaagactgggcaccaactggcacattagtagatgttttgcttacagtgttactaatctcccaacaccgctgcaaggcaggtaattattatctcagttttccagtgccaaaaatcaattgaactcttaaagttatcacattcgtgatagtcttccttagctcctgccaagcacccactctctgctggatataacaagggaactttattacattttcatttaaccctgtcaacagtcctctaaagtacatatcttcatgttaggacaaagaaacagactcagagagattaaggaatttgcccaaagttacacagctagtagacatggctctctttaatgcaaatgcaaatattccttttttttgaaacagagtcttgctctgtcgcccaggctggtgtacagtggcatgatcttggctaactgcagcctccacctcccaggttcagtgactctccttgcctcagcctcccgagtagctgggtttacaggcacatgctaccacgcctggctaacttttatatttttagtagggatggggtttcaccatgttggccgggctggtgtccaacttctggcctcaagtgatccacccaccttggcctcccaaagtggtgggattacaggtgtgagccaccgcgcccagccaaatgcaaatgcaaatattcttaccactgtaccacagtgcttgttattggggttttcatctttctgatttcaacattgctatcactcttgctggctcttcttcctctacccatctcctaccactggggttcctttcttggtgacacaggatttttgctccttagctcagctaggtccaggttcttgtctcacattcaggaagaaataggcacgtgaacatggaagagtgagtggagtagaatttatcaagcgaaacagaaagctctcagcaaaaagaggggtcctgaaaacaggttgctggttgcccccttcgcaactgaaaagctgatggagctggattccctgtttgtaaaggcatgaattcctggtggctccaccccattcccccagcgtgcatgtggggccttagtgggctgcaggcatgtttaggcaagcccctgtgcaagttcccttatctgcacaaaacatctcatgtaaccatttgtgggactggtcagaagttcttccgggacccttccctactgtctgcctaaagcaagctggctaactcctttcattggttcatttcacttatatacactccccagcaatctcatatacctccacagttctcaaataccacatatatacagatgtttccaaatctaaacatctatcccaggtctctcttctgaccccaaaccttcatatccagccgtctactcaacagtctcctggattgctcagaggcacctcttaacatatgtaaaccagagggcaacactgacctccccaaacctgcctctcctcctttatgctgccctatcctatgaagattttttttaaaatcagggccgggcacggtagctcacgcctgtaatcccagcactttgggaggcctagacaggaggatcacttgagctcaggagttcgagaccagcctgggcaatgcggcgaaactctgtctctataaaaaaaaaaattagctgggtgtagtggtgtgcacctgttgtcccagctacttggggggctgaggcagtaggattgcttgagcccaggaggcagaggttgcagtgagctgagactgtgccactgcattccatcctgggtgacagagccaggccctgtctcaagaaataataaatgaataaataaatcaggaaattccaatttttctattcgtaacataggtcttacactgacccatataatttggggaaactccatcactaaactgaattctctctctaaactctgcctgaggagccaagactaggataactagaggaggccaagaagagtggtgcagttaccacaattttgtgaggtgactgtctggtcccttgctccttactcccctcagaggtagatatgtagaaaacttctgaagatgtccccacacataacatgtaataacatctattgtgcctgtacttgatcaacatttataaaactcctcaatgaaagcagcagttgctaattcctacaaagagtaatttacatttagcatccactgactgaataaaatacctaatgacaaaatgttaccttgaattcagtaatgattttagatgaatcagaattttcattaatcatatcacgtacatatttgtgaaaatggcacaaaaatttaaaacatggttattcagtctcaagggtgtgcttagtgtggagtgaccctcctgctcagaactctacggttctctcacaggtttgcaaggcagtgccagagaacaattttcaaaaaataaattaaaaaagcagaaatgaaaaaatccttgaaatgtttttttttttctttctttctcagggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacag

SEQ ID NO: 36940 - DNA, 83948 bp, Homo sapiens
ggttctcgggcggggcctgggacaggcagctccggggtccgcggtttcacatcggaaacaaaacagcggctggtctggaaggaacctgagctacgagccgcggcggcagcggggcggcggggaagcgtatgtgcgtgatggggagtccgggcaagccaggaaggcaccgcggacatgggcggccgcgggcagggcccggccctttgtggccgcccgggccgcgaagccggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccagagctgaggaaggggagggaagcttcaggaaggaaaaggttggcagggattttgagtgttaggcctggtgtagcagaaggaacagaagatttagagcagcgctagccaatagaaataaaatgtgaggcccggggcggtggctcacgcctgtaatcccagcactttgggaggccgcggggcggatccttgagctgaggagttcgagaccagacaacacggcgaaaccccggctctacaaaaaattagctgggcgtgggggcgcgcgcctgtagtcccagctgctcccaagcgaggctgaggcaggagaatcacttgaacccgggagaaggaggttgcagtaagccaagattatgccactgcactgcagcctgggcaaaagagtgagactgtctcaaaaaaaaaaaaaacctgttttgtttttcttttggagaaaaggcatacaaatttattagcatgcagactgggagaaccacaaggtgattatccctattttaaattttctaataaacatactattatttatttatttatttatttatttatttatttatttattttttgagacggagtctggctctgtcgcccaggctggagtgcagtggcgcgatctcagctcactgcaagctccgcctcccgggttcacgccattctcctgcctcatcctccccagcagctgggactacaggcgtccgccaccacgcccggctaatttttttgtatttttagtagacacggggtttcaccgtgttagccagtatggtctcgatctcctgacctcgtgatccgcccgcctcggcctcccagagtgctgcgattacaggcgtgagccaccctgcccggccggctatttatttttttagagatgggagcctcactatgttgcccaggctggtcttgaactcctggagtcaagtgatcctcccgccttggcctcccagagtggtgggatacaggcacaagccactgtgcctagccataaacacatttttaaaggtaaaaaaaggccgagcgcggtggctcacccctgtaatcccagcactttgggaggccgtggcgggcggatcatgaggtcaggagatcgagacatcctggctaacacggtgaaaccccatctctactaaaaaatacaaaaaaaaaaaaattagccgggcgtgatggcgggcgcctgtagtcccagctactcgggaggctgaggcaggagaatggcgtgaacccgggaggcggagcttgcagtgagcggagatcgcgccactgcactccagcctgggcgacagagccagactctgtcaagaaaaaaagaaaaaaaatgtaaaaagaggctgggtggccgggcgcagcggctcacgcctgtaaacccagcactttgggaggccgaggcgggtggataaccagatcaggagatggagaccatcctggctcacgcggtgaaaccccgtctctactaaaagtacaaaaaattagccagacatggtgccaggcacttgtagtcccagctactcgggaggctgaggcaggacaatggcgtgaacccaggaggcggagcttgcagtgagccgagatcgcgccactgcactccagcctgggcaacagagtgagacttcgttttttttttaaaaaaaggctgggcacagtggctcacacctgtaatctgccagcactttgggaggccgaggcaggtagatcacctgaggtcaggagttcgagaccagcctcgccaaaatggtgagaccctgtgtctactaaaaatacaaaaaattagccgggtgtgttggcgtgtacctgttatcccagctactcgggaggtgaggcaggagaatcgcttgaacccagaaggtggaggttgcagtgagccgagatcatgccactgcactccagactgggctacagagcgagactccataagaaaaaaagaaaaaaaaggggggcaaaaagaaacagatgaaaccaatgtgaataatttattttaacacaatatacctaacatatttttatttcaatatctaaccagtataaaaatttacttgttttgccctctagagatagtaagctccttaagtaaacagaagtaatacctgattaattagaattcccaaccctcatcaagtgtgtgcttatatagaagaaacccagtaaatgtttgttgattgaaagatattaatactcttgcttggatgagagtgaggaaaaaggtattagtattggcttttcacaacgccttgtacggtttcttgtttaagttgatcaaagcaaaagaaagactgcaggcaatgctaaatataacaagtgatttacaaattaattagacgtaaataatcatttttcattaaaaattagttgtattctgtccatttcctcagaattttagacaatgattttgaataatcatatctcccttatagagttattgaaattaaataacttattgggaaagattctttataattatacaaaggtatataggaccatagtctcatatccagagttctgaaatccgaaaactaaaaggtttttctttttttgctattcttttttttttttttttttttttttttgagacagagtctccctctgtcgcccaggctggagtgcagtggcacaatctcagctcactgcaacgtccgcctcccaggttcaagtgattcttctgcctcagcctcccgagtagctgggactacaggcgtgtgccaccacactgggctaatttttgtatttttagtagaggtggggtgtcaccatattggccaggctggtctcgaactcctgacctcgtgatccacccgcctcagcctcccaaagtgctgggattacaggtgcgagccactgcacctggccaaggttttttataactaatttaacagcaaaatctggcctagttatcgtctttattttctttttttaatgtgatttaaaactattcatttgtttcactatagcttaataatttgtttgcttttctgcttctaagaccctgtaggggcattatataacttctggcatttgcatagtacctttacaaaatccaaaaaaatctgaattctaaacacatttagtcctaaaagttacagataagggattctggacttgcgattctaagtctttgttcgtttttattgcattttctgagccaacataaccattatttaaaaacaagttgctatagtaactctacattacagacctcccccaaactcagcagttcagagcatgtattctcactcagggctctgcttccttgtaggtagatgtgtggatcggtgagggcagttcttatttgtatgccttattctggggcccaggctgaaggggcagtggctatccatgataagcttttctcaaggcaccagcagaagtacaagaagtcaaggccaactgcataagcatagttcaaatgtctggttatgccacatctgctaagattgcattgaccaaagcaagtcacatgatcatgcccaaagacttaggagtgggtagtagactgcaaccaccatgcagccaagcaaactacagagccaagcctataacatcactggagagaggtgtattcctcccttggccaggctgggggagggagtgaatattggctgaataataatctaatctaccacagatggttaacagaggtggagtgggatggaaggagaaaaaaaaaaaatcaccaaatgggatgtatcactacccttgctctttttagcgtctgctgctttcacaaagccttttatagggctggagaaatgatttgctcctagtctcttaaaaaccagaggagtcttttgaggatgtattcctaaagtttttaaattagtttaaaaattttttttattaatttcaattataggctgagcacagtggctcacgcctgtaatcccagctaaggtggtggatcacctgaggtcaggagttcgagaccagcctggccaacatgctaaatgaaacccccatctctactaaaaatacaaaaattagctgggcatggtggtgggcgtctgtaatcctagctactcaggaggctgaggcaggagaattgcttgaacccaggaggtggaagttgcagtgagccatgatcgtggcattgcattccagcctgggcgacaagagtgaaactacatcttggccgggtgccgtggctcacgcctgtaatcccagcactttgggaggcagaggctggcagatcacgaggtcaggagatcgagaccatcctggctaacacagtgaaaccccgtctctactaaaaatacaaaaaattagccaggcgtggtggcgggcacctgtagtcccagctacttgggaggctgaggcaggagaatggcctgaacctgggaggcggagcttgcagtgagctgagattgtgccactgcactccagcctgggcgacagagggagactccgtctcaaaaaaaaaaaaaagaaaagaaactacatctcaataataataataatttcaattataggttggaatttagagttcggttacatttactattggatgtgatcctttaaaaactcaagtagaggcttttccagcccattcataacattagaagttgggccgcctgtccagggagaagctttcaaagtaacactgaggctgattaaatacttttgtaaaataaagaataaatcacaagctcattggcacttgaaacttagcattgcagtgcagatgcagcagaaaatacttgtagcagttttctcagtgaaagagaaactagtcaagtagcttagagacattaaaacaagccacaagccctttgtgctagagatcatggttaaaagtcccctgaagatgtttttccacagtagaaattttgtttatatttatgtctgagagtgaaaaaagaaaatggaatcaataagtaaccatgttctgcaggagtttgaggttttgttgttacattgggatgtagtgagagaagaaaacgtattaattcttttctgttggtactttcttgaattacatttttaataaacttattgtgagattctgaacattgctcctgtgataatttctgaagtgctgatgagtagaaggttttctggttagacttctgttcagcacatctgagcttcgagattatttgtagttctcctggggcttttaaaatctctttgtatataatagataaatgctagtttcccatcagagaaggatttctttttccttttgtctgattgagcaagtgtcttgagattaagaaaatggatgtcagtgaattcaagtgttgtgctctgtcagtttgcagcaggtgaccagagagcaaaaacaccagagtagattctgtccctactcccacctactcctcaattcgggtcccatgaaagatcctcagatctgggtaactgttgttgtttttgttgttcacagggctaagaatgttcatggctaagaatgttaaaaagtctcctagtgtcttttgccacgctgcctgaacagtggggtcattgaccgccatgcaatcctcaattgttttcagctgatactggaccgaaatcaaatctagctttgcctgcccctttctttgtaccagtagcgcttgtttgttcaccaggcctgactgaagacctagccctgttgcctgcctctgcttcctaccgagccccctgtaaagagcagctctcccagggaggctcaccttgtagcattgtgatctttggaagcatcaagggaggcacaagatttctctgggtgaactggaaaagacttgggctgggcatcagaagacttgggttctgcaactggcattgtttacactctctctgtaactctgtgcaggcaaaatctttcaccttttctgagtttttttttacatgtcagtacagattcctttcctcatgaggtttctttaagactcaaatggaagaatagatgtgaaaagaactttgaagatagtattggaaaatgctaaagtgactgctgtgttattgatgatttttatgggatttgtctgagaaagctccagtgtgaccagtttgtaccagcttgtatggtttcttgtaataaccgaacagatcctgttagcatagggtaaaaatggaaactacttcttttaaaatgaccagtggctgcagtggctcaggcctgtaatcctggctagttgggagactgaagtggtagggttgcttgaggccaggcaagaccagcctgggcgatacagcaagaccctttctctaaataaaaaactagccacccatgtagtcccacctgcttgggaggctgaggtgggaggatcgactgaggccaggagttcaaggctgcagtgagctatgattgccactgtactccagcctgggtgacagagtgagaccttgtctcttaaaaaaaaaaaaaaaaaaaaaaaaaaagatttgcattatagcttatctttttttttttttttttttttttgagatggagtctcactctgtcacccaggcaggaatgcagtggcgtaatctcagctgactgcaacctctgcctcctgggttcaagcaattgtcctgcctcagcctcccgagtagctgggactacaggtgcacgtcaccatgcctggctaatttttgtattttttggtagagatcgggtttcaccatgttggccaggctggtctggaactcctgaccttgtgatctgcccaccttggcctcccaaagtgctgggattacaggcgtgagccactgcgcccagccagcttatccttttttaaaaaaacataaatactaggatattgagattattgaaaatgcttttggtgcttcagttttgaatttatacttagagcagtttttgaagtttaagatctcatttacttctaagtaatagatttactagtaatcaaaatcgcttcaaaataccgtaatcctcattgctgtaaactcctacggggcaggtttggagttttataaagaggcaatatagtgtactctgtgaattccaactcctcacttgccagatgtgaccttaagcaagtgaacttctgtgtgccacactgttttcatctgtaaaaggataaagggaatatcataaattagtttgttaagccttagtttaataatgtctctaagttttacatataagtagacagtgtctttcttgtttagtgaataatcattcttattatttaatagtatctctactaaatttattgtgtaagattatactaatcttgtttagtgcgtggtaatcacttctgctcatatttaacctataagcataatatagtttatttatataccatttatttattttattttattttttgagatgcagtcttgctctgtcacccaggctgcggtgcagtggcgcaatcttgcttcactgcaacctccacctcccaggttcaagcgattctcctgcctcagcctccttagtagctgggattacaggcacgagctaccatgcccagctaatttttgtatatttagtatggacagggcttcaccatgttggccaggctggtctcgaactcctggcctcaaatgatctgtgtgcctcagcctcccatagtgctgggattacaggcatgagccactgcgtccggcctacttaccttttatttttgcttgcattaccctttctttgccttgtttcatttggctaagactgtcttgtttacttgctttgcttctgagggattatatgagagttctatgggtttttccataatggagtgtacttttattattttattatttgtttttttgagacagggtctcactctgtcactcaggctggagtgtagtgatgcagtcactgctcactgcagctttgactttcttggctccagtgatccttccacctcagcctcctgagtagctggaaccacaggcacccaccacccacacccagccaattttttttgtatttttagtagaaacagggtttcaccatgttggccaggctagtcacgaactcctggcctcaagtagtaacacccatctcagcctcccacagtgctgggattacaggcatgagccaccgagcccggcctcatgcaatttattgactacttcactgaaagtgaacttgtatggatactcaaaaagtacagtttgtattgaatacatattgtttttgcatcatactaaagctgaacagttctaaactgaactgtcatcagggaccgtctgtattgtgaaatcttaattttgtccatattaaaagacaggaacagggctggttcgtggtggctcacacctgtaatcctagcactttgggaggctgaggtgggtggatcacttgtggtcaggagtttgagaccagcctggccaacatggtgaaacccagtctctactaaaaatacaaaaattagctggacatggtggtgcacacctgtaatcccagttattcggggggctgagacacgaaaattacttaaacccaggagttagaggttccagtgagcgagatcgtgccactacattgcagcctgggtgacagagcaagactgtgtctcaaaataaagacaggaacaaaggtatcgataactcttaagtataggttaaattcccacaaaaatctagttttaaaaaatctttttttttttttttttttttaaaaacagagtctcactctgttgcccaggctgagtacagtgacgagatcttggctcactgcagcctctaattcctggactcaagccatccccccacctcagcctcctgagcatttgggactacagatgcatcccacctgcacccagctaattatttttttgtagagatagtgttttcctatgttgcccaggctggagactgatctgcaactcctggccttaagctctttattttttaagcaaatttgcactgttttcaattaatatgaatttgcatttcgctgatctcatgctagctgacaatgggctgaaggtgaggggaggagaaagatggacatggtacataaaagcatgtatgataaagtggaatgtcaccttggttaaaaatgtgtaatgatttgaatgatacaaatataagtagttaagggttattttgaacttgatacctttgctggaggaaaaattactttatgcatttttgatgaaaaatcattagaagaaaaaaaatggaatatttagaggaaagagtatcctgatgttaaaagtgaaaatgaaataggacattgagaaaatttttttatgtaaatgtgtatatggtaatgtattaattagcgttaggtatgtacacggatttttgccttctatatttctgaaaaccttctgtgaaaaggaagagttgaaatcataaagaattggctgatggaaattaaggtagacaggcaaatgggaatgtggcccccctaggagggtgaactctgagagacacagtcatccctgtaaataaggctgcgccaagatcaaaggagaggtctgaggctgggagtcaggagtcagccattcttttttttttttttttctgcaacctccacctcctgggttcaagcttttctcctgcctcagcctcctgagtagctgggattacagatgcgcgccaccacacccggctaatttttgtatttttagtagagatggggtttcgccatgttggtcaggctggtttcgaactcctgacctcgtgatccgcccgccttggcctcccaaagtgctgggattacaggcatgagccaccgctcctggctgagtctgcgatttcttgccagctctacccagttgtgtcatcttaagcaagtcactgaacttctctggattcccttctccttttgtaaaataagcatgttatctgtccgtcctgccttgggcattgtgataaggataagatgacattatagaattttgcaaaattaaaagcgctagacaaatgattttatgaaaatataaagattaggttgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggcacggtggctcatgcctgtaatcccagcactttgggaggctgaggcgggcagatcacctgaggttaggagttcaataccagcttggccaacatggagaaaccccatctctactaacaatacaaaaattagccgggcttggtggcaggtgcctgtaatcccagctactcaggaggctgagccaggagaatcgctggaacccaggaggtggaggttacagtgagctgacgtcgcgccattgcactccagcctgggcgacgagcgaaactccatctcaaaaataaataaataaacaataaataaatagagaaaaagaaagaaaagaaaagagagagagcatggatgtcctgtgagacagttggagtatctataggatttttagaggtggacccagaatagaggaaaacacaaggccaactataagctatccagttgcactaggtgtggggtcagattttcctctgttaggaccagagagcagagctaggaacagtggtggaagttaccaggcaataaggtctggatcaataaaaagaactttctcatagcctggcatggtggtgcatgcttgtagtcccagctactcaggaactcaggaggctgaggtacgaggattgcttgtctaagagtttgagtccagcatgggcaacatagagaggttctgtgtttttttttttttaattttcccacagttatggtacatctgggctgccttgtaggcttgtgtgtacatttcactacaaacagtcacaaaaggctgaaaggccactccagcaagatctgtagaggattagtccgtgaattccgcagttgaactagagcactgaatggcgtggaacttccttttacactctgaagatttaggattcttcacttttcccatcagtaaaattaggtaatttactagataatttgaaaattctttcccagctgggaagttttgatgtgcccagaagctaggatgggcagttgtccaggtttgtttaaaactagaggttctagaacacaggactttcagttttaaaattgggacagtcctgagcagtaggatcaagtcagttgtctaccagagtataatcaaattgaaataattttggatctgactaaccaagtcttattcaattagttgacattgttgtttaacttcgagtactattacagttctatattgttatagttcaaatagaagataacatctaaagcatttctcattccaaaggttaaatcttgcctttagcttcatttcttcaactctaagcaaatactgtgacgagctgctatagcctggaaaatagttttccttttgtgggctgctgtgcataatctcattcatagtaaagggatttgaagtttgatgacagaatagtcagagagctgaagttgtgtttgtttttttagcccaaatatttatttctcaagtttttgttgtgaaatgtttctagcacatacagaaagtatggcacataatgtaataggcacccatgtacctatcacccagctttattaaaccttaacatcttatttgctgtttttttgataagctttttttgcttctattgcttattgatcctacactaaatgaaatcctaactaaacaaaacaagattttgcatttaatttgaaaagagactagttatatgacaaaaaattgcagataaaattgaagtgctcctcccccattctttttcctcttttctcaggatagttactgtcctgaattgggtatttaccatgtttaataaaattgagtattaggcttactataatatttatgtacataaatcgtatcgcattatgtaatacacttggcatgttttaaaactttaggctgggtgtggtggctcacgcctgtaatcccagcaatttgggaggccgaggctggtggatcacaaggtcaggagttcaagaccagcctggccaacatggtgaaaccctgtctctactaaaaaaaaatgcaaaatttagccaggcgtgatggcaggcacctgtaatcccagctactccagaaactgaggcagagaattgcttgaactctggaggtggaggttgcagtgagccaagattgcaccactgcactccagcttgggcaacagagtaagactctgtctcaaaaaaaaaaaaaaaaaaaaaaaagccaggtgcggtggctcacgcctgtaatcccaacactttgggaggccgaggagggcggatcacgaggtcaagagacagaccatcctggtcaacatggtgaaaccccgtctctactaaaaaaatacaaaaattagctgggcgtggtgacacgcgcctgtagtcccagctacttgggaggctgaggcaggagaatggcatgaacctgggaggcggagcttgcagtgagccgagattgcaccactgcactccagcctgggcgacagagtgagactccatctaaaaaaaaaaacaaaaaaaaactttatgtggtttatgtctgaaagttgaagagaatttccacatatatgttagtatatgttgcaaaagagacattcctatgtagaattttgggcattcatgtatatgtagatgcatgtagctctagcatttgttttctcttgtgaatatataaaaataattctgtttacaaacatttggtaggttccagtttttcacaataactgacagtgctgcagtgacatactaattcattagtctgtgtgcacttgtgtgagtttctcaaagatagttgctgtgattggatatatggatcttagaactattttagagattgctaggattcttccaaagtgtatattgcaggccaggcatggtggttcacggctgtattacatctatctcagaaaaataagagaagaaaagcatgggtgatcttggtgatttccccctttcattttctaaatgttctataatacagttatttaataatttaaaaagctattttgaaaaagtaatctcacgctgtcaccaaagctggagtgcagtggtgcaatctaaactcactgcaacctcgacctccttgagaccagggtggtctcaagtgatcctgccacctcagcctcccaagtagctgggaccacaggctcatgccaccacacctggctaatttcttgtatttttggcagaaatgaggtttcaccgtgttgcacagtctggtcctgaactcctgagctcaagtgatccacatgtcttggcctcccaaagtgctgggattacaggtgtgagctactgcgcccaacctaaaatattttatatatatatatatatttttttttttttttttttttttttttttttttttgagacggagtctcgctctgttgcccaggctggagtgcagtggcacgatctcggctcactgcaagttctgcatcccgggttcacgccattctcctgcctcagcctcccaagtagctgggactacaggcgcccgccaccatgcctggctaattttttgtatttttcatagaggcggggtttcaccgtgttagccaggatggtctcggatctcctgacctcgtgattcgcccgtctcggcctcccaaagtttttttatattttttaatgtgaggaaaggtcacaaaagaatagtatgctacctgaggaatatctctggaaagggatcaagcattcgaggttttctgtgatgactgactaaagtcatggagttagaacagctgatacaaaagaaaccaaaaaaggccaggcatggtggctcacacatgtaatcccagcactttgggaggccgaggcaggtggtcaggagtttgagaccagcctggccaacatggtgaaaccccatttctactaagaaaaaaaaaaaaaaaaagtcaatgggtgtggtggcatgtacctgtagtcccagctactcaggagactgaagcacgagaattgcttgaacccaggactcagaggttgcagtgagctgagattgtgccactgcaccccagtgcagtgtgacagagtgaggctgtctcaaaaaaagaaaaaaaaaacccacaaaagctcggtagcatgagatctttgagagcattcttatgttcttattggtaattggagtttatattatgcccttgtcatcaataatagcttcagttatgtttcttagtctccatttgaaaaaagaaatattcgctgggcatggtggctcacgcctgtaatcccagcactttgggaggccaaggtgggtggattacttgaggccaggagttccagaccagcctggccatcacggtgaaaccctgtctctattaaaaatacaaaaattagccaggtgtggtggtgcgcccttgtaatcccagctacctgggaggctgaagcaagaggattggtttcaaggttcacctgggaggtcaaagctgcattcagccaagatcacaccattgtactccagcctaggtgacaaagtgataccctgtctcaaataaatacatagacaaaaagcaaacctatgagctatttaaaggaccttgaggagaaaaaaaataaatgaaatgggtgatctaaatttaaatagaatctgcagctctggttagcctttgacagtgttgttgtatcattatagttatgaatttgttttctcagttgtgttaaagtggagtaaggcaaaaaagaacttgaaatctcaacgacctccagagaaacatgctagcttttgcatgagtaaaatctcttaggcacaaatattaataatatgttaagaaactttaggcttaagcctaacataacagccccataagtgttcagtattatctctaaccagttatgtcaactgtttgtggaaatgacagcctttcttggcattagaggaatggttaaacctctgactccagggaatcacaaagcttggtcagatgctgaatggaattatgtgtgttgttggaagcatgttccctatgattaataaatgttttcaagttttccacttaacttgccagttctttggttaagccactcttctagtcctgtcctacagagcaggcttagagccccacatttgtcattgtagaaattcaaacaatatccattaagtcattttttttttttttgcccattaagtcttaaaggattaatacattttctttccttttttttttttttttgaaacggagcctccctctgtcgcccaggctggagttcagttgtgcgatctcggctcactgcagcctctgcctcccaggttcaagcgattctcctgccttagtctcccgagtagttgggattaacagggttgtgccaccacacctggctaattttagtattttagatagagatggggtttcaccatgttggtcaggctggtctcgaactcctgacctcaagtgatctgaccacctaggcctctcaaagtgttgggattacaggcatgaaccaccgtgcctgccaatacattttcttacaaatattaattattgaaaaaatgtattttaagtaaatattcagactataaatatatcagcataattgaatacattataaccacgtaggcatgttaactgcttacatgcgtgcatgaaatattaagggaaaagggcagaatataatatttgtaaacacaactatgtatacctgtgtgtatatattgaaaaacgttagcatttggggtgtcgtaaaaataagtttctgttttctttataaaattacctaaattcatattcaactacacacaattataaacttaattgcagagctaggtgtggtggctcatgtctgtattcctagtactttgggaggctgaggcaggaggatcccttgaggccaggagtttgagactagcttgggtaacatagcacgatcttgtctctacaaaaaaaaaagtgaaaattagtggggtgtggtagtgtgcttctatggtcccagctacttgggaagctgaggcaggaggattgcttgagactaggaggtcgaggctgcagtgagctgtaatcatgccactgcacttcaacctgggcagcaaagtgagaccctgcctcaaaaaaagaaaaaaatgtgtggcaaaaactgccatgaacaaagtccaaaacaaactaggacaaaggcttgaaatatatgacagatatatcccaatatacatagaattcttatgaaattaaaaggaacatgaacaacttaactcagtagcaaaggttacaagcaatatttatggagtaagaaatagaaatggcaataaatatatgaaaagcctagttgatcagccttactaatagggataaaaattaaaacttcacttcttacctatcagtgagttaaaattgatacactgctgctgaggttgtagggaaataggctttcttgtatgctgtgttctttggagttaagttagtatttatttggaggcaagctcttaattgaatctacagatacacatgccttttggaaataatttagcaattaaatctaacctaatctgatctcacctagcatttcacttctgaaagtttatcctataaaaatattaccatagaagtgccaagaatttttattgaagttttatttataacagtgagaatgtggcagtaatctcaatctttatcattaattgcttatggtttacccagttagtagtgtaaaggtactagttaacagtagggtctcttgactaaacagttggactttgaatctccattctagaacttcttagcattatgatctttggcaaattaactggcctcgctaaacttcagtttctttatctgttaaatgaagtttatagcaattaacttagagttttatttaaattaaatgagataaactgaatgattagtacactacctagcacatacttgttcaataaatattaacatttcttatcaaaattgccatatttaagaatgaggtatatttatatgtctagcatagaatcaaatatatattatcattattattttttttttgagacagggtctccttctatcacccaggctggagtatagtggtgtgatcatagctcagtgcagcctgtaagtcctgggctcaagtgattctcccatctcagccttgtgaatagctgggagtacaggtgtgtgccaccatgcctggctaattttttttgctgttagtttcactttttttgtagagctggggtctcgttatgttgcccaggccggtcttgaactcctgggctcaagcgattctcccgtctcggcctcctgaagcatacagattttttagggcagtgaatctattctgtatgatactgtaatcatggaaacctgtcattatctgtttatacaaacccatagactgtataacaccaaaaagtgaaccctaaggtaaactgtggactgtcaatgtaggttcatctgttgtaacggtttaccacagtggtgcaggatgttgatagaggctgttggaggggttatgtgggaactctgtgtactttctgctcagttttgctgtggatctaagtttgcatttaaaaatattttatggcttggtggctcatacttgtaatcctagcactttggaaggctgaggcgggtggatcacttgagttcaggagtttgagaccagcctgggcaacatggtgaaaccccatctctatgaaataaaaaaaaaagtaaataatactaatagtaattaactgggtgtggtggcatgtgcctatagtcccaggtacttgggaggctgaggtcggaggatgacttgagcctgtgaagtggaagttgcagtgagcagtgatcatgccactgcactccagcctgggcaacacagccagactcggtctcaaaaaataataataataaaataaataatataaataaaaataatattttgaaagaaaagagctatcaagccacaaatgcaaaaggcttcaagttcctatcttttagaaatacatactaaaatatttatgaaggaaatgatatatctaagatttgcctcaaaataatactggagtggcaaagtgagcgggggagtagatgaaacaagattagcatgagttcataattattgaagttgaataaattgcacatgggcttcattgtacatttctgacagtatttgtttgaactttttccataataaaaagttttgtttgtttttttttttgagatggagtcttgctctgtcacccaggctggagtgcagtggcatgatctcggctcactgcaagctccgcctcccaggttcacgccattctcctgcctcagcctccagagtagctgcgactacaggcgtccgccaccatgcccagctaattttttgtaattttagtagagatggggtttcactgtgttagccaggatgatctcgatctcctgaccttgtgatccgcccgcctgggactcccaaagtgctgggattacaggcatgagccaccacgcctggccttttttttaaaatggtcttacaggtaataccatgcatgcttaagtcatcattctcatatttagctaccaagatttttcctttcggaaatccctcagtattctagtaccactttcctctcatttgacacttttcaaagcacctacacactcccttgagaaagatacctttttttttttttgcgagggagtttcactcttttgttgcccaggctggagtgcagtggcatgatcttggctcactgcaacgtctgcctcctgggttcaagcgattctcctgcctcagcctcctgagtagctgggattacaggcacgcaccaccacacccagctaatttttttgtatacttttttttttttaagtacagatggggtttcaccgtgttggccaggctgggctcaaacttctgacttcagatgatccgcctgcctcgatctcccaaagtgctgggattacaggcgtgagtcaccacgcccagcccaagaaagatacatttttaaaaacagctttattgtggtataattgacgtaaaatgtacatacttaaagtatacagtgtgatgttttgatatatatgtatactcttgaaaccaccaccacagttaaaataatgaaaatgtccattacctccagaagtttcttcatgttttgttgtaatctctccttctcctccctgattcctccccatccccaggcaaccatgttttgtcaccgcgcgcagccatttactattatgatactattttatataaatagtatcatacaggccgggcacggtggctcatgcctgtaatcccagcactttgggaggtcgaggtgggcgatgacttgaggccacctggccaacatgaaaccccttctctattaaaaatgcaaaaattagccaggggtggtggcgtgcacctgtaatctcagctcctcaggaggctgagacatgaggattgcttgaacccaggaggcagaggttgcagtgagctgagattgtgccactgcactccagcctgggcaacagagtgagtctctgtctaaaaaaaaaacaaaacatacagactcttgtctggcttctttctttcagcataattattttgaaattcgtccatgttatgtggttcctttttattgctgagttgtataccacagtttttgatctatttacttgttggtagatatttggattttcagttctgaagcattacagatagtggctgttacggatattcatgtacagatctttctttgtatgggcatatgctttaatttatcttgggcaaatacctaggagtagaatatgatccaatatggtaggtgtatatttaacttttttttctatctatctatctatctatctatctatctatctatctatctatctatctatttttaagacggagttttgctccatctggagcaaaggctggagtgcagtggcatgatcttggctcactgcaacctctgcctcctgggttcaagtgattctcctgtcccagcctccccagtagctgggattacaggcgcctgccaccacacccagctaatttttgtatttgtagtagaggctaggtttcttcatgttggccaggctggtcttgaactactgatctcaagtgatctgcctcggccccccaaagtgttgggattacaggcgtgagccatcacacctggccagtttttatttatattttttatagaagatggagtcttcctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcagtatgagttccagttcctccacatcctgtcagtacttgatactgtcagtcttttaaattttttagctcttataaaaaggtatatagttacatctcattttggttttaatttacatttctctattgagtaatgatgttgagtttcttttcatgtgcttgtcatcctgatatctttggtgacttgtctgttcaaatctcttgcccatttaaaaattgctttcttaatggattttaagaattatttacatagtctggatacaagtcctctgtaatatatataatttgcaagtgttttctcccagactgtggcttttctttttattaacagtgctttttgaagggcagatttttttttttttttttaaagagacagagtcttgccctgtcacccaggctggagtatagtggtgtgattatagctcactgcagcctcaaactcctgagctcaaagaattcttctgcctcattcttccaaacagctaggactacagatgtgtgccactgcacccagctaattccgtttgtatttcattgattgtgtttttggtgtcacatcttaagaaactttggcctacttcaagttctcaggagttttttcctgcattttcttctggaagctttatagtttcatgttttacattaggtctgtgatccttttgaagttgattgttatacgtggtccaaggtatggatcaaagttcatttttctgcatatggatattcaattgtttcagcactgttttttaaaaaagactattttctccactgaagtgcctttgtacctttgcaaaaatcagttgtccatatatgtgtcaatctgttccatcagtcatgggtcaaaggctgttctcatggggaggcttttgaatttgaaaaactgaaactctatactcattggacaactttatacccattgaacaactccccattttccatttctctcagcccgtggcaatatgctttctgtttctataacatggactacttgagtttttttcttttttttgatgacaagatctcactccgttgcccaggctagagtgcagtggcatgatcttggctcatggcagccttcacctcctgggctcaagctgtcttcccacctcagcctcctgagtaactggaactacaggtgcactctatcatgcctcgctaattttttaatttttttgtagagacgagttctcgccatattggccaggctgatctcaaactcctgggctcaagtaatcctcccactttggcctcccaaaatacagagattatgggtgtgagccatcatgcccagctggctagatatttcatgtaagtggaatcatacattatttctcttttagtgacttgcttattttgcttagcataatgtcctcaaggttcatctatattgtagcatgtgacaagatttcctttttaagggctgaataatattctgtgttatgtatataccacatatctgtgagtagacatttgggttacttccacttcgtggctatactgaataatgctatggtgaaagtggctatgcacatatctgtttgaggtcttgtttgtaattcagttcgtttttatatatactcattggtatttatataaatgggattgctgggtcatatggtagtttaattttttgaggaacctccatattgttttccatggtggctgcaccattttacattcccaccaacaatgcatagtggttccaatttcttcacaactttaccaccgcttgttactttctgttttttggtagtggccatcctaacgggtgtagtttttttttgcatttttctaatgattagtgatgttgagcatcttttcttttttccccccatattacacagatgtagagcatcttttcatgtgcttgttggctatttgtatatcttctttgaagaaatatctgttcaagtcctttgcccatctaaaaaaatctgatgatttgtttttttccaattgtttaattgtaggacttttttttttttttttttttttgagatggagtctcgctctgtcgcccatcctggaatgcagtggcgcgatcttggctcactgcaagctccacctgccgggttcatgctattgtaggactttttaatgtattctggatattaatctcttaccagatatatgatttgctttttttttttttttttttcgatacaaggttttactgtgtcacccaggctggagtaaagtagtgatgtaatctgggctcactgcaacttccgcctcccaggctcaagcagtccttccacctcagcctcctgagtagctggaactataggcactcgccaccatacccacctaatttttgtattttttgtagagacggagtttcaccatgttgcccaggctggccttgaactcccaggctcaagcaatccacctgccttagcctcccaaactgctggggttgtagatgtgagctaccacacccagcctgatttgcagatattttctccagttctgtaggttgccttttcactctgatgactgcttcctgtggtgtgtagaaatttggtgtaggcccatttgtctatttttgtttttgttctttaatttctcttagcaatattttgtaagtttcattgtacaggatatttggggatctgtaagacaaccctcaggttcagtaatttgctagaaagactcaactcagagaatgttttatactcaaattatagtttagtacattgaaatgatatggattaaatttagcaacagaaaaagacacatagggcagggtccaggagacaccccaggctcaagctgtcaatagtcctctcccagtggagttgtgcacacagtgcttaatttttccagcaacagtgtatgacaacacacgtggaatattggcaaccagggaagctggctgagccttggtgtccgggtcacacatggctgacctcagttctctggccccttcagaggccaagctgatactgtgtgacacaaggccctcaccgtagatcacattattagcggaaacttgttggcatgacccaatgcctcatgtaaacagcgcagtggctgtttataggccgggcgcagtggctcacgcctgtaatcccagcactttgggaggctgaggcgggcggatcacctgaggtcaggagtttgagaccagcctggctaacatggcgaaaccccgtttccactaaaaaaaaaaaaaaaaaaaaaaaatagaaaaagaaaccaaaccaggtgtggtgataagtgcctgtaatcccagctactcgggagactgaggcaggagaatcactctaacctgggaggccaaggttgcagtgagccaagattgcgccactgcactccagcctgggcaacaggagcaaaactccatctcaaaaaaaaaaaaaagttaaatagaaaaaggacataaatgaaaaagcactcaaccatcctgataataagagaaatagatattaaatttatgccaagattccatatttctcccatcagattggtaaaaatctaagcacttgctaacataaggtgttagcaacagtgtggtaaagtaggcaatctcttgcattgctgattctctaaattggtgcaatccacagggagggcaatttggcatgctctcgttctctctctcgctcgctcgcgcgctctctctctctctctccatgagaaggagagagagagagagagagagcacgcgaacaagcgattgagtgagagagagagcacgtatctgcagtctcagctgctcaggaggctgaggtgggaggattgcttgagcctaggaggtcaacgctgtggtaagctgttgactatgccactgcactgcagcctagtgacagagaatctgtctcaaagataagaagaatgaggatattctttatgtactgatgtgtagaaaaatctctaagatacatagttaagtggagaaaacaaaatgctgcatggtgcatttactgtactaccatttgtgtgaaaagggggagtaagagtatgtgtttgtatttgcttgcatatgtagaaagaaactttgaaaggattcaccaaataacagtagtaagcagggggattaggaaactaggtatatattaagagggagcttttgtactctataccttttaatactttctttgagaccatgtgaatgttttacctatgtatttatttatttttaatttttgctttgcctgcttttaaacaaataaattgtactttttttgaagagctctatttttatttcctttcgattatcatctgtagattcttatgtcacattttactttaacagcacatttagacagaatacagtctttaaatggaagccgacaattgatttccctggaaaatttttgaagtacaataacatttgattgattgaactttatttagtaagaattcttagcaaaattccctcccaggcacacctacatggtgcttcattttcagtgaactacaaatctctgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaatagtcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcagagcaaggaccaaaccattttagacttcatgagcctaagaagttttgattttgttatgagcatgacaagaagccattgtaatcgagttttaaacaaaggaatgacatgatctcattttgtttaaaaaaaaaaaatcatcctggctgtagtgtggagaatggactaggggagcataaaagcagaaagaccaattggaagcctattaacagtaatccaaatgatagataatagtggtttgaaccacaaagattatggacatagaaagaagcagatagatccaggagatgttttggaggtattctggcagaatttgctggctgactagacagaggtactaaggaaaagaatcaagaataattcctagattcgggacttcctagaaactgggagaatggtgctgctgtttattgagataaatggagaagacagaggagaagcttagaatagagttctaggagaggtcagagatggagatcaacatttgggagacagaattttctaattccatagtgccgacgattttctattgatagactaaaaatgtctggaattttatatgcagtttcatctggacaataccctaagaggagatcagttataccttggcacctgctaatagccataggaatatgtatatgtagaataaatggtaaaactactgaatgcttaatatgtgccagacaccgtgagatacgtctttgaagtactatcccagtagaatttacaacaaccctatcaggagatactttttttatcaccattttacagatgaagacactgaagttcaaagaggttaaataactcgccccaaatcacactatatagaagagaaatctaaatcctggtagtctgaccccagaacttgggctaattaccactatataatacagtgtcactggggtaaacccaagatatgataacataagttagagacttttaaattccaaatttcacacactatgatttcacccataaaatgtagtgattcagccatagtcttctgattagttggagtaccctatgcaatactttaggaacttgcttcttttattttcatatatatatatgttcattcataaattaaatctggacagccagtgaatctgccatttttgtctctaaccaacacttctgtcacaaaattgtacttttttttgtttttttttgagacggagtctcattctgtcacccaggttggagtacagtggcacgatcttggctcactgcaacctctgcttcccgggttcaaacgattcgcctgcctcagcctcccaagtagctgagattacaggtgcccgccaccacactggctaatttttgtatttttaatagagacagggtttcaccatgttggccaggctggtcttgaactcctgacctcgggtgatccgcccgcctcagcctcccagagtgctgggattacaggcatgagccaccacgcccggcccaaactgtgctttttttaaataaagaaattaaaacagtatttttttccttaaagatggtgtctcactacattccctggctcaaacgattctggctcaaacgaattcctaggctcaaacgattctcctgcgttagcctcctgagtacctgggactataggtatgtgccactattcctgaaaacataatcagttttgaaggtagtgtctgggctgggcgcagtggctcacgccttcaatcccagcactttgggaggccgaggtgggcggatcacctgaggtcaggagttcgagaccagcctgaccaacatggataagactccatctctactaaaaatacaaaaaattagccaggcatggtggcgcatgcctgtaatcccagctactcaggaggctgaggcaggagaattgcttgaacctaggaagcagaggctgtggtgagccgagatcgcaccattgcactccagcctgggcaacaagagtgaaactccgtcttaaaaaaaaaaaaaaaaaggtagtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcgggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgcccctttcatgctagacttagctaattaaactgttcatatgacctaaaaggatggctgtggtgccatagaaagaaaacaagttttgaggcaagagactttagtttgattcctacctctgctgttttctggttgtgagatttttggatcagttgcttttgtgttcatttaccaaaacttctcaagacaaaaagaataaatgagataatgtgacagtgccttgtaaataccaaatactatatagagatagctattattacttgtatgtttattgtgaacattaatcagccaatcaagttgttcagacttgtactgctgaacatcaattgcagatataacattcttggcagatgacttagtcacctccttctgtggaagaatagaagatagacagctccttgctgtctatcacagtatgttctggtcccgttggcctcaccttccatataatcatttccattctactgggctttagccactctggtgacttgagttcagcaaaaataatctttcttgatgggtggtatatatatttctaccttttatgctttagaatagtttcctttccatttctcatagggtttggatcttcataactgtttgaagagaaatcctgacctccagactgaaggaaagcacaccatgcctttataacgccagcctcggtcttttttttgttcccctctgtcttagttccttttgtattgctataacagaataccgcagactgggtgatttatttatttatttattttgttgttgtcatttgttttcttcttttttgtatcttttgaaattcttttcattgttgttgttgttttgagactgggtgatttgtttattcagctcatggttcttgaggctggaaagcccaagagtatatggtaccagcagcacctgattatgccatggtggatagacagaacggcaagagagagcttgcttttgtaacaaagtcactcccatgataactaacctactcctgtgataacgacattgcaggttcagtatccctgatttgaaagtctgaaattcaaagtgctcccaaatctgaagctttctgagtatcaatgtgatgctcaaaggaaatgcttattggagtgttttagattttggatttttagatttggtatgttcaacctgtaagtataatggaaatattccaaaatgcaaaatctgaaacacttctggtcccaaacatttcagataaaggatactgaacctttaatccattcatgaaggcagagtcctcatgacccagtcacctcctaaaggcctcacctcttgatactaccacaatggcaaccaggtttccagtacatgaatttttagggggatcattcaaactatagcaccctcctttatcccttaccctattccattagttttaatccccactttgtctcttcctctaatcttcagtctacactgtgacatgataggtatgctcaagtctctaacagctctaaaataacgttttctgtttttttttttgtcttcatttctggtggggttggataagaaaagtttttcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggctgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtcatctttttactgtatttttccctccacagctatttcatccatttctgaggcctgagatttcatccatttctgaggctatagagaccagtgacttcctctgactcttctgagcttgaaattcctattggtaactgccattggacttaactgcctggttatatctctaactaaagtacttctctcttccagcctgtttatcttattgtgttccattgtgttccttatctctaccaatgctagttccttatgctagaaatctcattcattgccactcaatcaagtttgctaaaaacgaaacatctgattgtgtcacttattcaaccttaccaatttttttttttttttgagccttgctttgtcacccatagtggcacgatctctgctcactgcagcctccaccacccaggttcaggtgattctcctgccgtagcctcatgagtagctgggattacaggcatgtgccaccatgcccgactaatttttatatttttagtagagacggggtttcaccatgttggccaggctggtctcaaactcctgacctcaagtgatctgcccaccttggcctcccaaagtgctgggatttcaggcgcctggcctgttacttgattatatgctaaacaaggggtggattattcatgagttttctgggaaagaggtgggcaattcccggaactgaggatccctcccctttttagaccatacaaggtaacttccggacgttgccatggcatctgtaaactgtcatggtgttggcggggagtgtcttttagcatgctaatgtattataattagcgtatagtgagcagtgaggataaccagaggtcactctcctcaccatcttggttttggtgggttttggccagcttctttattgcaaccagttttatcagcaagatctttatgagctgtatcttgtgctgacttcctatctcatcccgtaactaagagtacctaacctcctgcaaatgcagcccagtaggtcttggccttattttacccagcccctattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaagaagtagcactcgaatataaaattttccttttaattctcagcaaggcaagttacttctatatagaagggtgcacccttacagatggaacaatggcaagcgcacatttggacaagggaggggaaagggttcttatccctgacacacgtggtccctgctgctgtgttcttcccctactgactagggttagactgcacaggctaaactaattccaattggctaatttaaagagaatgatggggtgagtgctttggcaggagtcagggaagagcaggtagcaggtaactggaatgagggtggagcaggtaatggaaaaacattgctttacgaggaagttaagtttaaaagtagaaggcaaagaattgaacatactggcgtattaattctttgaaatttagaactcacatctaacattggcttaaatgttaaatcctcaaagataacattcctgtttctcctaacacgattaagtccttcttggtatcttttctcatagcaacttgtcctttctcacttgtcacaatttgcaaatatatatttatttacattgtttatttaatgcctaatttccttctttattgcaaggcctgtgagggtactgagtctccagggtgaggtgtataataaatggccaaacgaattgttaattgaaaggatgaacaactaattcaagccagcactctctagactcctggggggctatcatgtgggttccctggtgctgctgatgtcagcccttggcctccaagaaaaatgcttgattcaaatgtcatctagttccatctctacgactctcatggggtccaaagaagagttttaattgagttttagaatttgaagttgtgaagtgtctgaaaaactacatggtgttctgaaagccaaacttttagccttttgggagagcatctaagacagcaggtgaagggcaggggttagaactagagggattgaagaatattatccatataggttagggttaggtttggcaacgtattatagaacaaacattggcaagctacagccacaggccagatctgtctgctacctttccacaaaggtgtaataacaaagttattcacaaatttgtgaataaactttcattggaaagtgaccacgctccttggtttatacattgtctgtggctgctttcacactacagtagcacagttgagtgtttgcactggagaccatatgacccatagagcttaaaatattcagtctggctttttacagagatgtttctgactttgttaatagaaaatcaaaacaactggtttaaataatgcacatactttctctctcatagagtagtgcagaggtaggcagtccagattagtacggtggcttcacgttcatcaaggactcaatctccttctttcttctttagcttctaacctctagcttacttcagggtccaggctggagccctagccttcattctgacagtaggaaggagtaggggagaaaagaacataggacatgtcagcagaattctctccttagaagttccatacacaacacatctccctagaagtcattgcccttacttgttctcatagccatcctaaatataagggagtcagaagtaaagtctttttggctgggaatattggcacctggaataaaaatgtttttctgtgaatgagaaacaaggggaagatggatatgtgacattatcttaagacaactccagttgcaattactctgcagatgagaggcactaattataagccatattacctttcttctgacaaccacttgtcagcccacgtggtttctgtggcagaatctggttctataacaagttcctaataagctgtagccaaaaaaatttgatgaggtattataattatttcaatataaagcacccactagatggagccagtgtctgcttcacatgttaagtccttctttccatatgttagacattttctttgaagcaattttagagtgtagctgtttttctcaggttaaaaattcttagctagattggtgagttggggaaaagtgacttataagatacgaattgaattaagaaaaagaaaattctgtgttggaggtggtaatgtggttggtgatctccattaacactgacctagggcttttgtgtttgttttattgtagaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcacttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataatagcacaatctaagtgggtttttgtttgtttgtttgtttgttgaagcagggccttgccctgtcacccaggctggagtgaagtgcagtggcacgattttggctcactgcagactcaacccaccagtttcaagcgattctcctgcctctgcctcccaaatagctgggattacaggtgtgtgccaccacactcggctaatttttgtatttttagtagagacagggtttcaccatgttgaccacactggtctcgaactcctggcctcaagtgatctgcccaccttggtctcccaaagtgctgggattacaggcatgagccactgcgcccggccctaagtggttttaatattttgattgacagtatactgaagaaatatactctaagacctttatgaatctcctcattcacaaataacactgtaggatataatggtccctataaaatacggtataactaaaatcagatttttatattggagtacagaacaataaagccatcttcagatgctggtattaaactcactggtgactggtcacaccttgcctaaactggtagccaccatgcatcctctcaccatctccactgtactacttccttccttgggaagtcgggcgctgggaggttgtacaggaaagatacagacccacccttctcagcctctcctcccctagctcgctcttttgccaaagtgacctactgctgagtttcaaagtgacctactgctgagtttcagccaactagcacgtttcagattcataccttagaaaaaattacacattatcacaagtcatgcaccttttaaggtcattttcaaataatagaaattataagtgttcggccaggcatggtggctcatgcctgtaatcccagcactttgggaggccaaggcaggaggattgcttgaggtcaggagttttttttgtttttttgtttttttccccgagacgaagtctcgctcttgtcccgcaggctggagtgtgacagcgcgatcttggctcactgcaagctgtgcctcctgggttcaagcgattcttctgcctcagccccccgagtagctgggattacaggcgcctgccaccacacccggctaatttttgtatttttagtagagactgggttttaccgtgttggccaggctggtctagaactcctgacctcaggtgatccacccacctcggcctcgcaagggctgggattacaggcgtgagccaccatacctggccgaggtcaggggtttgagaccagcctgagcaacatagtaagacctatctctaccaaaaaaaaaaaaaattaactttccaaatgtaggagtctactctgtttccttctagtatttatttctgtatacttttctaacatggttaaaatgtgtaatcaatatgtgtccttttactttggtgtgaacattttttctattataaattcttagaaaatatttctatggctatgagatatttgattcaagtgccttgtaatttacttctcaaatgtccctgatgttggacatttgtttctagtgtttcactattttaaaaaacagtaatatctgtctttatgcttagagctttttcagtttttcaaattatttccttagggtaaaatcctagaagtagaatttttggggcaaattatctacatatttataactgtcttggtattcaaaatctcgttttcaaaaagcttatatcaatttgtacttaacaccagtagtgaatgagagtatctgtcgtaccccaccagtgctgaatttcttttttaaaactgtgctggtttttataggtaaagaaaatgtcttaatttgcatttagttggttactagtaatatcacataccttttcaatgcttgtgaactttaagcttatacagagtttaaccttgcatgttgaacatttgagtgagtggaagtgttaagtgatggccatctgtataatctattagtaatgtatggagaccattaaagatgacaggtatgtgtgatgatgacaggttgttaccaacactcagaaggccaaaaagcaagtgatataaacccatgctgggaagcattcacctcccccactttaaaaatgctagtttcttaattccttttctttatccctttttttgtctgcacgtgtttacttgcctttagtttccctgctttagtaggctgaccttgtgacttttaccaggatcccattatacttttgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaacccctactattatcccagttttatggatgaggcactgaggcaggggtcacacagctagtgtgggtcagaacctaatgggtcagaatggacatttgagtccagagtttggcctggattgacacacatagctattacgtaagattcctctcaaattcagtcctcagctccctgaagtgtgggttctcttttcatgcctccatggaaactgcgtatcatgtggttaccagtttttcctttggtcgtatctgctgacctttttgaacctaattttttctggaccttattgccatttgacttatttattgcctcccacttgacactgattctggcttttgcttttcttcctactttggtcctttttgcagttttctaaagctaaccagccatgactctcagatgatggactttttcgtctctcccattacttcttgggaaattatattttaatctcatggtttaaattttcatccttaaatataacttttaatgtagtatttttagcccagaagggcccatggttggtttgttttctcctttgcatatctcttctactcagatacctggtagcatataaatcaaatgaattatccttcataccatttcattatcatcagtaggactgctttgctggggtttttttgtgtgtgtgtttttgtttttgtttttgtttttgttttgagataaagtcttgctttgtcacctaggcaagagtgctaggattacaggcgtgagccgctatgccaggacagccgttttcttctagtattatttgccctctgtctgaacatcttcctttagtaatgcttttagagcaaggcagctggcctcaatttgttttaatttttcttccccttaggatgttttaattttacctttattactgaaggatattgttactgggcagaaaattgtcttgatattccccttttcagcatttaaaaaatgctcttctgctttctttcagcctccatggtttctcataaaaatcagtcattcgaatcactgttcttctaaaagtaatacattgttttgttctggtcactttcaaaattttctttttcttttcagcagtttaattatgggactgtgtgaggatttctttgttcattctgtttggagttcactgagctttttgaatctctaggtttatgtcttttaccaaatttggaaaatttttcaaccattatttcttcaaaatttttctgtaccacattctttactctttttttttttgaaacagagtggcgcactgcaacctctgccttcccggttcaagtgattctcctgcctcagcctcccaaagtgctgggattacgggtgcctgccaccatgcctggctgattttgttaatttttagtagagacggggttttaccacattgaccaggctggtcttgaactcctggccttaagtattccgcctgcctgggcctcccaaagtgctgggttacaggtgtgagccaccacacccggcccttttttttttttttttttgagaccgagtctcgctttgtcacccaggctggagtgcagtgatgtgattttggctcactgcagcctcagcctcccaagtacctgggattacagagatgtgccaccatgcccagctaatttttgtatttttattagagatggggtttcaccatgttggccaggctggtcttaaacccctggcctcaagtgatccgtctgcctcagcctcccaaagtgctgggattacagacgtgagccaccatgcctggctctttaccctcttctgggagtgacaacacaaataactttttattccacaggtttctgaggctctgtttattttccaatttttttcactattgttctggttagataatttctattgatctgtcttcaagtttcctgaaatttgcattttgttggtaaacctattcagtaaaatgtttttggttattttatttttagttctaaaattcctatatagcccgtctttacatttttttattctgaaacttaaaactttcctttcattttaagagtgtttgcccttacttcttggagcatttttatgctccaaggattttgatatttttgttttattggccaattgatctgattgggctaggtccagccagccttgtcaaagcctttgcagtgttgctcagatctgccccatgtatatgccacccagtcaccagtctgggactggtatagtggtgttctatttgtaattcggttgtcagggtcggtgtgtactgttgaggatcatatccatactcactcaccttgggaatggacccacaagtttataaacagctttaagagattgctttcatgagtttctttctttctgtgatctccatgtggtttcttgggcttcccttttccattcctgcagccaaaagtggactttatcttcctaaagtcagggccaaaatgtgggaggagagagagaaataaagcaagggctatttgccccactctctcgggactgacattcttccagtcagagtaaggattccctccctctgaattttaggcttctgccacccacattaccatcaccacaggattgtgtgaggactgggcatacgagaatggagaaaagcggaaaagaatgccgggtgtggtggctcacgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtattgcttgaacccgggaggcagaggttgcagtgagccaagatcgtgccactgcactccagcctgagctacagtgcgagactctgtctccaaaaaaaaggaagaaaaactggatttttacactgtctgggtgttaggagacctctttcctgatcctcaagccagaactagaggtcttctggagctcccattgtcttgctaatgcccactcatgttgtaatgagcacaggtggaggaaaaaaagtggtcagctcactgctagtacttctaattccccagcccacctacctctcattacttttcatcttttgcaaccagctgctgcctgctttctgcccaggttttgtaactgtattcagtgggatagagagagtggaaggtacttactccatcttatctggaacctttcttaatatattttttgtcgcatttgtacatcttttatccatccttcattttattttatttttttttttgagacggagtctcagtctctcgcccaggctggagtgtagtggcatgatcttggctcactgcaacctccgcctcctgggttcaagtgattctcctgcctcagcctcccaagtagttgggattactgggacacgccaccatgcctgggtaatttttgcatttttagtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattgagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttttgcaagatgagaaaggcctgttgaaatgtgtgtgtataacatagtaataaaagaaatgcatatgaaaataacaaattaacatatttgacatattgactttgtcaagattagtcttttttgtcaagtaactaagccagtgtgtattaattaaatcagtaattagaaaaagtttgtacactttgatttagtaattttgcttttatgatatattctaaagaaggaattagaaatgcagaaaaatatttgtgaagtaggatgttcattttaatgtaaattaaaattggggaaagaaagggaaaacaatacagattccatgcataaggcaaaggttcaattgtgggtttatccgtatgagtagactattattttgtcatttaaaaatcatagtttcagctgggcgtggtggctcacgcatgtaatcccagcactttaggaggctgaggtgggcggatcacctgaggtcagaagatcgagaccagcctgaccaacatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaaatcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataatatttggtggcatgagaatatgtttgtaataaaagattacatttgtgaaagcagaatgtaaacagtacactagttgattctcactgttaaggtctttacacacgcctatacgtgcagatagaaaacatgtctgaaagggaaacggttttattttgtttcgtatttttttttgagacaatgtctcactttgtcagtcaggctggaatgtagtggcactgtctcggctcactgcaccctatacctcctgggttcaagcaatcctcccacctcaacctccatggtagctgggactacaggcacctgccaccacgcctagctaatgttcgtatttttagtagagacggggttttggcatgttggtcaggctggtcttgaactcctgacctcaggcaatccacctgtctcagcctcccaaactgctgggataacaggcgtgagccactgtgcctggcctgaaagggaaatgttggtattaattttggttgtcactggcctttagaatagttttcttcttttagtgtttctgtgtttcttaagtgttacaagcatatgttacttttgattcagaaaaatgctatttttaaaataagcaagactgggcacggtgactctcaccagtatggctgagaccagaggatcacttgaagccaggagttcaaaaccagcttgggcaacagagtgagacccccacctctacaaaaagaaaaaaaaaaaattaaaaaattagccaggcatggtggtgtacccacgcctatagtcctaggtactagggaggctgaggtgggagtatggcttgagcccagtggttcgagattgcagtgagctacgatcatgccactgtaccccagcctgggcaacacagtgaggccctatctcaaaaaataattaaaaaaaaaatatttgggggctcctagaaggtacagttaaaaaaattaaaattaggccgggcatggtggctcacgcctataatcccagcactgtgggaggctaaggagggtggatcacttgagatcaggagttcaagaccagcttggccaacatggtgaaacttcatctctaatacaaaaatcacctgggcgttggtggtgggtgcctgtaatcccagctactcgggaggctaaggcaggagaattgcttgaatctgggaggtggaggttgcagtgagccaagaccatgctactgcactccagcctgggcgacaaagtgaggcttcatctcccaaaaataaataaataaaattaaaaaaagaaataaataagaacatctccttcttcctttgccaaaaaaccgaggtgaaaagcatctctcaagaatgatgagaatttcaattatttaatatttactctggtccttaatttaaagcttaatatggaatcccagtgtacatctcccactggtattgtttgtcttggccaagacagacaagttttaaagagtgagataaaatttaggctaaagttgaagtatttggagggaaatgtacagatgttctcagcttaccttttttgtttttttgagatggagtctcgctctgttgctcaggctggagtgcaatggtgcgatctcagctctccacaacctccgcctctcaggttgaagtgattctcctgcctcagcctcccaaatagctgggactgcaggtgtgtgccactatgtctggctaatttttgtattttttttttttaatttattttttattgataattcttgggtgtttctcacagagggggatttggcagggtcataggacaatagtggagggaaggtcagtagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaaacacatcttgcaccgcccttaatccattcaaccctgagtggacacagcacatgtttcagagagcacagggttgggggtaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggtgcccctcacctcccgggcggggcggctggccgggcggggggctgacccccccacctccctcccggacggggcggctggccgggcagaggggctcctcacttcccagtaggagcggccgggcagaggcgcccctcacctcccggacggggcggctggccaggcggggggctgatccccccacctccctcccagacggggcggctggccgggcggggggctgacccccccccacctccctcccggacagggcggctggccggccggggggctgacccccccacctccctcccggacggggcggctggccgggcggggggctgacccccccacctccctcccggacggggcggctggccgggcggggggctgacccccccacctccctcccggacggggcggctggccgggcggggggctgacccccccacctccctcccggacggggcggctggccgggcagaggcgcccctcacctcccggacggggcggctggccgggcggggggctgacccccccacctccctctccgacggggcggctggcctggcagaggggctcctcacttcccagtaggggcggccgggcagaggcgcccctcacctcccggacggggcggctggccgggcggggggctgacccccccacctccctctcggacagggcggctggcctggcagaggggctcctcacttcccagtaggggcggccgggcagaggcgcccctcacctcccggacggggcggctggccgggcggggggctgacccccccacctccctcccggacggagcggctggcggggcggggggctgacccccccacctccctcccggatggggcggctggcctggcggggggctgaccccccccacctccctcccggacggggtggctgccgggcggagacgctcctcacttcccagacggggcggctgccgggcggaggggctcctcacttcccagacggggcggctgccgggcggaggggctcctcacttctcagacggggcggccgggcagagatgctcctcacctcccagacggggtcgcggccgggcagaggtgctcctcacatcccagacggggcggcggggcagaggcgctccccacatctcagacgatgggcggccgggcagagacgctcctcacttcctagatgtgatggcagccgggcagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctacaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgtgagtctgcaatcgcaggcactcggcaggctgagtcaggagaatcaggcagggaggttgcagtgagccgagatggcagcagtacagtccagcttcggctcagcatgagagggagaccgtggaaagagagggagagggagaccgtggggagagagagggagagggagagggagagcgcttaaaacaatttttaagatgtatttcttttctcatagttccagaggccagaagtcccaagtcaagggttggaagcaatttttgtatttttagtagagatggggttcaccatattggccaggctggtcttgaactcctggcctcatgatccgcctgccgtggcctcccaaagtgctgggattacaggcatgagtcactgcgcccgatctctcagtttactttgatatgtattaataataacaaagactaatggatgaggagctagacagaaattttataaaccaagtactgcaaaatatgaatggtagactctaggtgatatatgggtgttcactgtaaaattaattaaattttgctgtgtgttcgaacatttttgtaacaaaatgttggaaaatttttgtggaagaacaccagaaacaactttgttgtatctggatataatttagaatattcaaatgttggctaggtgcggtggcaacctgtaatcctagcactttgggaggccaaggcaggtggatcacctcaggtcgggagttcgagaccagcctgaccaacatggagaaactgtgtctctactaaaaatacagaattagccaggtgtggtggcacatgtctgtaatcccagctacttggggggctgaggcaggagaattgcttgaaccctggaggcggaggttgcggtgagccgagattgcgccattgcactccattctgggcaacaagagcgaaactccgtctcagaaaaaaaaaaagaatattcaaatgtccaaggagtaccaatatctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagcctagcgtggtggcgcgcacgcgtggttccacctactcaggaggcttaagcacgagaattgcttgaacccaggaggcagaggttgtggtgagctgagatcgtgccactgcactccagtctgggcgacaaagtgagaccctgtctcaaaaaagaaaaaaaaaatctgtactttttaagggttgtgggacctgttaattatattgaaatgctttcttttctaggtcatccatgcctggcttattatatcatctctattgttgctgttctttttttcattcatttacttggggtaagttgtgaaatttttggtctgtctttcagaattaactacctttgtgctgtgtagctatcatttaaagccatgtactttgttgatgaattactctgaagttttaattgtttccacatataggtcatacttggtatataaaagactagtcagtattactaattgagacattcttctgttgctccttgcttataataagtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaataaataaattggagagttatttctttggtagaggattaagggaaataaccacagacagaagaagcaaatatgagaatctatgtgaaatggatgatattctagaaaaaaaattatcaaaactgacccctaaagagagaatatctaaacagagtaaagaagaggtacagaaagttactgaagaagtttccaccccacctgcacaaataacaatagtaccaggccccagtggattaatggggaaattctgttaaacctttaaggaatggtaactctaatactaagtgttccgaacatataaaaagaaaaaaagcttccagattaattttatgaagccagcataacattaataactaaagccctgcaagttatcaagtaaaagaaaactattggtcggttatatttattgatttcaaaagcataacagaatattaagagaattcagcaatagatgaaaagaataatactttttttttttgagtctcacgctgttgcccaggctggagtgcagtggcatgatctcggctcactgcaacccccacctcctggattcaagcgattctcctgcctcagccccctgagtaaccgggactacaggtgcgcaccaccatgcccagctaatttttgcatttttagtagagacagagtttcaccatgttggccaggatggtctcgatctcctgacctcgtgatccgcccgccttggcctcccaaagtgctggaattaacaggcctgagccaccgcaccctgccataataatacatttgaccaagtggagtttgtttgcagaatcgttcattataagttgccatattactagatcatcatctctgtatgtgctaaaaggcatttgataagattcctgttcttgatcagattccttaataaatagacggggtcgggtgtggtggctcatgtttataatctcaatactctgggaggctaaggtaggaggatagcttgaggttgaaagttggataccaacctgcgcaacataacaagactttgcctctacaaaaaataaattagccagttgtggtgtgtgcatgtagttctagctgcatgggagactaaggcgggaggatggcttcagcccaggaattcaaggctgcagtgagctatgattgcaccactgcaccccaggctgggtgactcagtctctaaaaataaataaataactaaatctctaacattataaaatgtatgcatctcattctaaaggccaatgtcatcctcatagggaagctagaagcttgcctattaaggtcaggaatgagatggaggttttcttttctttcttttgtttgtttgttttttgttttgttttttctgagatagagtctcactctgtcatccaggctggagtgcaatggtgtgatctcggctcacaggaacttctgcctcctgggttcaagcgattctcctgcatcaaggcctcccaagtagctgggattacaggcacctgccactatgcccggctaatttttgcatttttagtagagcaggggtttcaccatgttggccaggctgttctcaaactcttgacctcaggtgatccacctgcctccgcctcccaaaatgctgggattacaggcgtgagccactgtgcctggctgagatgaaggttttctttatcaccaattatctagcattgctctggagggactagcaaacacaattaaacaggagaaagaaatacgaactatataatttggaaaagaaggttaaattaccaatatttggagataaaatgattgtttactttgttttagaactaactgaaaaccaattcaaattactaagtaagtttggtaaggcaattaattgattacaaaattaaacaaaagtcccctgtctgggtgccgtggctcatgcctgtaatcccagcactttgggaggccgaggcgggtggttcacctgaggttaggagtttgagaccagcctggccaacgtggtgaaaacccacctctactaaaaatacaaaaaattagccgggcgtggtggtgggtgcctgtaattccagctactctggaggctgaggcaggagagtggcgtgaacctgggagatggaggttgctgtgagccgagatcgcaccattgcactcccacctgggcaacaagagtgaaactccatttcaaaaaaataaagtgaaaacacaaatcaataaccttcacataaacaactagttagaaaacataataaaaggataagtcccatttatgatagcagcaaaaaagattaaatatctacgagtaaacaagaattgtgcaagccctggacactggtgaagcagagatgccagctgaggtcctgcccccagctccccttaagctgagcagtgtggagaacatcttgcacaggctgctgactgccttccaagaagcccttgacctttaccatgtgttggtctcccttgaccgggtgggcactgagcagtagcaggtgtagactgagctggcctctaacttcctttggatccacagccagttgtaggccaacaacggggtggaggggtctgatgtggctccaggccctctccagctcaggttacccctccttatgtacattgtactcagagctgctagtgcaggctgtgcagaggaaggcaggggacactgaggtccagcagtccctgctcctgcttctgaagaaatagatattttaagtgaataaactgacagcttagaggggtaaaaaagataatatgcaagatctattgagaattttaaggctgggtgtggtggctcacacttgtaatctcacctatttgggaggccgaggtgggaggatcctttgagcccaggggttctagaccatcctgggcaacatggttgaaactccatctctacaaaaaatacaaaacttagccaggcgtggtggtgcatgcctgtagccccagctgcttgggaggctgagtcaggaggatcacttgagccaaggactttggggctgcagtgaactgtggttgtgccctctatccagggtgacagtcagaccttgtctctatttaaaaaaaaaaaaaaaaaaaattaaaatatgctatcatttgtgtcaagtagaaaagtatatatatgacatgtatagactttctggaaggatgtacatgaaattaatagtagtgctttccaatcaggcacggtggctcacacctgtaatctcaacatttttggaggtggagacaggaggactgcttgagcctaggagttcatagccagcctgggcaacatagcaagaccccatctcaagaaaaagtagtgctttcctctaaagaggggaaccatggggcacagtggggagaaaacctacttttcacagtatctgttgtgaattttatatcttattcatgtgttacctggccaaagattaataaatagattgtttttgtttttgttttttagtttgaggatactggaaatgcttaatataaatatctacatcgtccagaaatttcaatgtttactctattttggaatttcaaagtgggagaggaatcatctttttggatggtacctgaaactgaaagtttatgcctaaaggcgtgcttgctttctcctcagttacctcaggcatcttctacagttgcaatctctttgttgttagatggtggattttgcctccccagaattaaaatagcattttcttcattataaaaatacttaacattcattgtttttttaaaaaagacattatataagattataaagaagaaaaatgaccagattcccaccacctaaagataagtcctgtcatcctttcaggaattaatatatcaatttctcatctactcttctctcacactactttgcataaatgggatcataaatgggatcctatattttttcaagcaacagtgtgttatgcctatactccatgtttatatgtgtgtattaaaaaatgtatttgtatatatgtgtatgtataagtgtgtgtgtgtgtatgatgattcttctcccgctttgaaggtgaaagaaagcacacctttatttaagcataaactttgggtttcagatactgtctggaaaaatgatttatctcccactttgaaattccaaaatacgtacatatattttttttttcttttcttttttagttttagggtcttgctgtgttgcccaggctggagtgcagtagtgtgatcatagctcacacagcctctaactcccaggctcaagctatcttcctgccccagcctcctgagtagctgggactgcaggcatgtgccatcaactttagctaattttaaaatttttttgtagtgatagagtctcactgtgttgcccaggctcgtctggaattcctggcctcaagtgatcctctcacctcagcctcccaaattgctgggattagagtgtgagccactgtgcctagcctgcatatatctatttttaatgactgctaaatctcattgtatgaaaatttatgtcctagctataaaatttgttagcacatgtttaattttttctaatttcagatgttttaaactaatatttcccaaagtatagtatggcattttaggtatgatatgatcttttttcctcttcgtactcatttttatagttatggcctgtgcaactggtttcccatttatatgaatgatacagagcttcctattaagaaaaagttcagcttgggaaaaaaaaagtgaattgttcaacttgagggaaaaaagtgaattaattggccaggcaccgtggctcatgcttgtaatcccagcactttgggaggctgagacgggtggattgcttgaacccaggagttttagaccaacctgggcaacatgttgaaaccctatctgtacaaaaaaaattagaaaaattagctgggcatagtggcacacacctgttgtcccagctacttaggaggctgagctgggaagaccacctgatctccggaggtaaagactgcagtgagccgtgattgcaccactttactccagcctgggcaacaaaatgagaccctggctcaaaaacaaaaacaaaaacaaaaaaagagtaaattaatttaaagggaagtattaaataaataatagcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatggtaaaacccaagactgataatttgtttgtcacaggaatgccccactggagtgttttctttcctcatctctttatcttgatttagagaaaatggtaacgtgtacatcccataactcttcagtaaatcattaattagctatagtaactttttcatttgaagatttcggctgggcatggtagctcatgcctgtaatcttagcactttgggaggctgaggcgggcagatcacctaagcccagagttcaagaccagcctgggcaacatggcaaaacctcgtatctacagaaaatacaaaaattagccgggcatggtggtgcacacctgtagttccagctacttaggaggctgaggtgggaggatcgattgagcccaggaggtcaaggctgcagtgagccatgattgcatcactgtattccagcctgggtgatagaacaagaccttgtctcaaaaaaaatttggtttttcaagctttttgaggttttgacaagctggccaatatggtgaaaccccgtctctactaaaaatacaaaaattagctgggtgtggtggcgtacccttgtattcccagctacttgagaggctgaggcaggagaattatttgaacccaggaagtgaagtggaggttgcagtgagccgagatggtgccactgcactctagcctgggtgacagagcgagactctgtctcaaaaaaaaaaaaaaagcaaaaaaaaaaaagcacaagcagagtggtagacacacaaaatgctcaattcattttttaaacgatttttttcctttatatcttactgcagaagcttttttcttttttttgagacaaagtcttgctgtgtcacccaggctggggtgcagtggcacagtcatagctcactgcaaccttgaactccctggctcatgcgatcctcccacttcagcctctcaagtagctagaactacaggtgtgcaccaccatgcctgactaacttgtttattttttgtagagagaacgtcttgctatattgcctaggctggtcttgaactcttgggctcaagcaatcctcctaccttggcctctcaaggtattgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtcctgaacagttagaacatactccagccattaacccaggcagctttcaggtacgtactctgtggctgttgccttgtatgaaagccaaaaagagatccattttcagagattaatatgtgaccccttctatattataaggccatggccatactcttttttttttctttttgtttttttcttccaaagacaggatctctctctgtcatccacgctagagtacagtggcatgaacgtggcttactgcagcctcaaacccttgtcctgggctcaaacaatcctcccacctcagccttcaaagtagatagaactacaggcatgcactaccatgcctaattttttaaaaaaaaattttttttcagagatgagatctcactgtgtttcccaggcttgtccggaactcctggcctcaagcgatcctcccaccttggcctgccaaagtgttgggattacaggcatgagccaccatgcctggccatacactttttttttttttttttttcaagacggagtctggctctgtcgcccagactggagtgcagtggcgtgatcttggctcactgcaagcttcgcctcccaggttcatgccgttctcctgcctcagcctcccaagtagctgggactacaggcatctgccaccacgcccggctatttttttgtatttgtagtagagacggggtttcaccatgttagccaggatgatctcgatctcctgacctcatgattcacctgcctcggcctcccaaagtgttgggattacaggcatgagccaccgtgcccggcctggccatacacttttgtcattatttacatacttactaaaatgtttggtggcctgtaataggaaacatcatcctcatttgattgacgaagaagtctgtggaaataggattgaactggttctgttcttgtatttgagtaatcagttgtggaactatagaagtcatatactctctctgactttcataattaccttatgttgtatagtacttgatggtttgcaaagtaaccatctattcttgcttagctgtgagtaagaatgccaggtctggagacagaatgtctgggttcaaattctactcatcactttttatttttattttttttgagatagagtctcgctttgttgcccaggctggagtgcagtggcgtgatctcagctcactacaacctctccctcccgggatcaagcgattctcctgcctcagccttccgagtagctgggactacaagtgcgcaccaccacgcccagctaatttttgtatttttagtagagacgaggttttgccatgttggccaggctggtctcaaactcctgacctcaagtgatctgcctgcctcagcctcccagagtgctgggattacaggcttgaaccactgcgcccagcctactcatcacttactagctatttgaccacacaagttactcaactcctatgtcagttatgaagattaaattaaatgatccatttaatacaataatacacttagaacaatgtctatcagtaaatttttttctgttttaagaaacaggatctcactctgtctcccaggctggagtgaagtggcacgattatagctcactgtagcttcaaaagcctgggctcaagcagtcctcctgtctcagcctcccgagtagataagactacaggcacaggttggtgttgacctcctagcttcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagtagctgggactataggcacctgccaccatgagctgctaattttttgtatttttggtagagacggggttttgccatcttggccaggctggtctcaaactcctgagcacaagtgatctgctgcctcagcctccccaaagtgctggaattacaagcataagccactgtgcctggcaagacatgaaatttttaaatgtaaatgcatttaagtgacaataatgtgaatacaagttatcaattcttcctttacaagtttagctatacctgttttatatttttcagtgtttaaaattatttttatatttttatattctgaattttctttctttctttcttttttttttttttttttgagacggagtctcgctgtattgcccaggctggagtgcagtggcgcaatctcggcgcactgcaagctccgcttcccgggttcacgccgttctcctgcctcagcctcccgagtagctgggactacaggcacgcgccaccacacccagctaattttttgtattttttagtagagacagggtttcaccgtgttagccaggatggtcttgatctcctgaccttgtgatccgcccacctcggcctcccaaagtgctgggattgcaggcgtgagccactgcgcccggcctatatgctgaattttcatgacagagaatgaaagaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgcaaagagttattattgtgttttatttaaatttactgccctcttacttcaagtacttctcagtagtacgtaatactgcttttaaaaaggagaagggatgaatttcttctactctgctcttcatattttgaaaagttcagtcaaatcccctttattaaattcatctcagagtaatctttttaatttgtagttcatatccgtgattagtttagaagtgacttctccctgtttctgctcactgtaggttgacaactgcttaaaatagtctatctcatcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctgtaagtatttgagaaggatattgaattagtaatcagtgtagaatttatcggaactgaagcacatgtaactatggtcattttcatggtacttgttctcatcttaaatgcacagcattcctggaactcctgcagatctctttgtttccttgcaagcaattgtcttctacctgatgttgattcaagagagttttcaatatgaatagaaagaaagaaaatgtttagatattggggaaccagcattcccattttaaaacctgttaggagttgttgattagggcaagctcaaggattcctttgagtgactggtttagatgtctttctgctattcggtgaccactggggaactgagattgttgagcagaagggtaatgtgagcagagccgtgcctttgtaagctggcagcactgtgtgagatgaattggtgggttggatactgagatcatgagaggcatactaagcataattaagatgatattgccatgatctaggtggaaagtaatgggggtttgaattatggtagtggcagtagcaatcaagggaaagagttgatcagaggattcagaggtagaatcaatagttctagcaactgaggagagaagttgtaagcttgaaggaaaggtgatgaagaaaaaatgctttcctgtgttttcttgttgttgttgttgagatagggtctcactcccatccaggatggagtacagtagtgtgatcatggctcactgcagcctcgacctcccaggctcaggtgatccacccacctcagcctcccgagtagctgtgactacaggcacgcactaccaggcctggctaatttttttgtgttgtgtgtagagactgggttttgccatgtgcccaggctggtcttgaactcctcggcttaagcgatcctcctgccttgacttcacaaagtgcttgagttacaggtgtgagctaccacgcctggccatgttttcttgtgtgaaggatctgtttagttttatatctttctgtggctcatatctaatttagttgacagtacctgtgggtcactaggtagacattgctagcagacgtttagaaatgaaatactagagcttgggaaaaagttgatatttgagatagagacttgaagaacattagcagagagttggtagttaaggtctgtgagctggtgagcaattcaaataaaagcagaagagaagaggaagacaagggtcaaactttgtcaactactgtgtttagagaatgagacaagagaggatactacaggaagtagaggaaaatagtggaaaattgggcaagccagtatttttcacttaagaatatcattactgttttttgatgtcagcacatgaaatggctgcatagtgttctcttacgtagatattcagtggtgggtatcctcattgatagacatttagatcatttccatttattttctatcacagacagcacttacagagtgcatccatgaacttatgaatattattataaaatgtattcttacagtagaattgctaagtcaaaggatgtatttaaattttgatagtttgccatattgcctcctaaaaaagctgtgcctgtttacattcccttcagtaatatgaaagtatcaatttccttacccctttggtgttttggtttgttttgttttggagactgagtctcgctctgtcatgcaggctggagtgcagtggtgcgatctcggctcactgcaacctccgcctcctgggttcaagcagttctcctgcctcagcctccggagtggctgggattacaggcgtgtgccaccacacccagctaattttttgtatttttagtggagacacggtttcaccatgttgaccaggctggtctcgaactcctgacttcaggtgatccgcctgcctaggcctcccaaaatgccaggattatagctgtgagccaccatgcccggccactgctttgttaatgcttgcctgtgtctgtgcatacatgcatgtgtgtgtgtctgagagagaaagagatctaataggcaaaaaaataacatcttgttttattttttattgtttgtctaatgctttgggtgattatttgaactttttttcatgtgtttcttagttacagatctgaatttattttgtaactggcttggtataatctttttcatatttgtgaaattaatcttttttgtgtgtgtgtgagacagtctctctctgtcacccaagctggagtacagtggcgcaatctcaactcactgcaacctccatctcccaggttcaagcaattctcctctctcagcctcccaagtagctggaattacaggcgcatgccaccacgcctggctgatttttgtatttttagtagagacgggatttcaccacgttggccaggctggtctcaagtgatccaactgcctcagactcccaaagcattagtattacaggtgtgagccactgctcccagccctgtaaaattaatcttaattatacaagtaattcattatccttgaaaaaggataaacattacagataaaaataaatttcacggtaactatcatctctaatcttaatgccttatcaagtacttacccctgttgtcagtttgttgtatatccttgtagattttttttgccaatttttctgttgagttactggaaaagcagtttcaagaaggagagaggctgggcgtggtggctaacacctgtaatcccagcactttgggaggcctaggtgggcggatcacttgaggtcaggagtttgaaaccagcctggccaacatggtgaaactctgtctttactaaaaatataaaaatcagctgggtgtggtggtgcacacttgtaatcccagttacttgggaggctgaggtgggaggatcacttgaacccaggaggcggaggttacagtgagccatgatcgtgccactgcactccagcctgagtgacagcaaggcttcatccccaccctcccaaaaaaagagaatatctttttgtttgtttgtttgtttgtttgtttgtttgtggcagagtcttgctgtgtcgcccaggctggagttcagtggggcgatctcggctcactgcaagctccgcctcctgggttcagccattctcctgcctcagcctccccagcagctgggactacaggcacacgccgccacgcccggctaatttttgtatttttagtagcaacggggtttcaccatgttagccaggatggtctcgatctcctgaccttgtgatccgcccgcctcggcctcccaaagtgctgggattacaggcgtgagccaccgcgcctggccgagaatatcattttttataaagaagtcaaaggtaatgaggactaagtaaaaccatacagtatttgctgtctaagatgtcattagtgacattgaagagagcagtttcagtagagtgatagaaccagaagcagtactccaaagggaaggtgcgtatgtgtgcatgcatgtctctgtgttttgccagtgctggcagtggaagtgatggtgtaggcagagaatgggtggtgaagaaggagaggtatagtaaatgtcatgtactacatcaaagattcctgtctcacaggcagagcaggtggtgacctgacaggagaacaggtttcaggaaaggtgtttcaaggagagggaaggttccattttattttatttatttattttttttgaaacagagtcttgctctgttgctcgggctagagtgcagtggtgtgatcttggctcactgcaacccccgcctcccaagttcaagcaatggtcctgtctcagcctccggagtagctgggattataggcacccaccaccacatccggctaatgtttgtatttttagtagagttggggtttcgccacattggccaggctggccttgaactccccacctcaagtgatccacctgcctcggcctcccaaagtgctgggattacagacgtgagccactgcacccgacctgttttattttatttttgaggtaagtcttgctctgttgcccaggctggagtgcagtggcgcaatctcagctcactgcaacctccatctcctgggttcaggcaattctcctgcctcagcctcccgagtagttgagattacaagcatgcgccactatacctggctaattttttttttccatatttttagttgagccacaggttgggagaagggaaaatacattctactcaaagtgagtccgtggcaaaagtgtgagtacagagatgggtgaggaattaggaccagactttcagtctgcagcaacattaaacatgtatgttaatttaatactcagaaagaagcatttactctgttttaaaatatctatcacatactatatatatatatatatatatatatatatatatatatatatatattttttttttttttttttttttttttttttgagacagtcttgctctgtcacccaggctggagtgcagtagcgtgatctcgactcactgcaagctccacctcccgggttcacgccattctcctgcctcagcctcccgagtagctgggactctaggcgcccgccaccatgcctggctaattttttgtatttttagtagagacggggtttcaccgtgttagccaggattgtctcgatctcttgacctcgtaatctgccctcctcggcctcccaaagtgctgggattacaggcgtgagccaccgtgcccagcctatcatatataatatttttaaaactcaacgtctgtgctcgctttagcagcacataatagtaaaattggaatgatacagatgatttgcatgtatttttttaaaagttctcaagtctatttaataaccacagaatatgagacattctgagatgttttagaaacagttcaacatatgtgggaaaataggagtataaacccttacctcctgtgtagatcaggtaggttcaagattgcatctgttcttttgtaatactaaatgtctggtgaagatttgaggattttatataaatcattgagtttgagaggtttttttgtttttgtttttgagatggagtttcactcttgttgcccaggctgaagtgcaatggcacaatctcggctcactgcaacctccgcctcccaggttcaagcgattctcctgcctcggcctcctgagtagctgggattacagacgcctgccaccacgcccagctaattttttgtatttttgtatttttagtagagagagggtttcaccatgttggccaggctggtctcaaacttgtgacctcaggtgatctacccgcctcaccctcccaaagtgctgggattacaggcatgagccaccgcacctggccttcgttttgttttttcaacagaatgtaagaattttttcttacatttttcttacatttttaacagaatgtaagaaaaccacaacgcaatgccgatgagtactttttccctgaagtggatataagcatgaatataaaaagttttaaatcagtcatcctggctatttgttctctaaaaatcaataaataattctttcatgcattttaatactgtctcccagttaagggtattcagtttgcaaaatgctcttactgacaggaaatgtatgagcatttttgttttttacttctgtcgtttgacagaaaaaatatacacctactctttgagctaatttattcttacctagtggtcattagtagaagtggttcactctgggagcttaactagaagggaaactaacaattccttgaggtagatcattttatctaaagctttttgatttcatatcagttgggggcgggtatattatgttaatttttaaatctgcatattttccagccaggcatgactataatcccaggactttgggaggtagaagcaggaggattgcttgagcccaggaattcaagaccaccctagactacattaaaaaacatatttttttgtatttattttttattttatttttttgagacagagtttcgctctcattgcccaggctggagtgcaatggcacgatctcggctcaccacagcctccgcctcctggattcaagcaattctcctgcctcagcctcccgagtcgccgggattatagacatgcaccaccacaccgggctaattttgtatttttagtagagacagggtttctccatgttggtcaggctggtcttgaactcctgacctcaggtgatccacccacctccgactcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatatggcccatggcttgtttttgtacagcttataagctaaaaatgctttttacatttaaaaaaaaaaaaaaagaacaaggaagaatatgtgacacacaaaacctgaaatgtttactccctggccatttacagaaaaagttagctggacattgattttcatgttactattaactgctaaaacaaaggagcttgtagctatattttttcatacttgcataaagaaagaaaacctaataaatcgctggtggcttcatttccaaaaggctatggaaatccataaacaggctgggtgcagtggctcatgcctgtaatcctagcactttgggaggctgaggcgggaggattgcttgagcccaggagtttgagtctggcctgggcaacgtagtgagaccctgtttttagaaaaaatgaagataaaaaactaatccataaacctcatacttggtggttgcccttcagtttttcttctttagatctggatttagttaaacagtgtattgcctgcctggtttctgttaacttttgatcatttggttgggttatcctataatgaaacttggttgacctcagaaataacaaggtggtcgttcagcttctttgattgtgtgtttctttcataagttcttcaagaagcctgagtattagaaacatggataaaattattgtgataaaaagccagagagacataaatgtcaagtatcttgtttaaaattactgtgaccaggccgggcgtggtggctcacgcctgtaatcccagcactttgggaggctgaggcgggcggatcacgaggtcaggagatcgagaccatcctggctaacacagtgaaaccccacctctactaaaaaaaatacaaaaaattagccaggcatggtggcgggcgcctgtagtcccagctactcgggaggctgaggcaggagaatggcgtgaacccaggagacggagcttgcagtgagccgagatcatgccactgtactccagcctgggtgacagagcaagactctgtctcaaaaaaaaaaaaaaaaaaaaaaattactgtgaccagattggactcagcttgctgctggcatttggttcccaccataacctcatatgtcatgtgtttgcttatatgtacttttgtgttattgttggtgtatcttcaggataagttccaaaatgtaatattgctgggttaaaggattaatgcacatgtagttttattagatgttaccaaatttccctccagtggggattataccatttttcattcctgcctgaaatatatgagagaagcaccattttaaagttttcacaatgtctctgaactaaaatgtggtagagatgcacatgtgtatatctagatctagattgatatattgatatacatgtatttttgtagaaggggcacagaggaggcctcttgactatccctattatgtttattgcttttaacgttttttctcacgccgggtttaaaacatggtttagcattattgaacattctaaaaatgagacataatatgaaggaaatttactctgtgcatcttttgaattataatcaccatctgaggcttttgtgagctccagtttgtcctggaatttagaacattcaactagtccagctattgtttcagtggaatcttgctggcctgaacagttttccttctggttccttttcagggactaaaaatgatgaagagttttgtgatagcaggtgcagtttgagtactacagtaaacattcagtttcagaacttcttctcttacctgctaaaaccaaagagaaccttttttttatttttacttctgattgttgaacagtcttaaggcagcattaggaagactggcgatttgtgtggagaaatgatggcttgttgttgtctatgcatactttgtgtgtccagtgcttacctggaattttgtctttcccaacagcaacaatggtgtggttggtgaatatggcagaaggagacccggaagctcaaaggagagtatccaaaaattccaagtataatgcagaaagtaggtaacttttattagataatatcttgatttttcagggtcactgttataagctaacagtatagcaatgtttttatcgtctttctttggtcatagactcctttgagaatctcttgagaactatgataatgcccagtaaatacacagataagtatttaaggagttcagatactcaaaacccaacaatacagtcaaagcatcctaggttaagacacctcccattaaatacagaataccagcatggaaaggttcaggctgaggttatgattttgtttttgttttttgtttgttttttataagtcatgattttaaaaagaaaaaataaactctctccaaacatgtaaaagtaagaatctcctaaaagaaacaaaaaagaaacagacaataaaggaaaaataagtaaacaaaaaaagcaaaatataaacaacataaaaatgagaacctcttgtctaacatggccagaataactgaaatatgatttgagatgtgctgatgtgtatactgagaagatcaaatattctaggtggatatgactttttagaagaggataagaatgacttaggatgagctgggtgcagtgatgtgtgcctgtagtcccagctacatggccaaggcaagaggatcacttgagctaaggagttccggattaccctgggcaacttataccttacctcaaaaataataataataatgaataataataatgacttaggataagagagtgaaaggccctctaaggatactacagaacatattaaggagaacacaagttagaagttgttattagatggagttgagggggagctttcattcagttttctggaatggaggctaccttcccacacacactaaaaaaaaaaagaaagggttgaggaataacagcacaatataaatagtctaaaaaaagggctaacttttatgaggaatctgaaaaacaacaggcacagtaaatattggtgaggaaaaaaaggccttaattgagttgctgtttgtcaggaaagggagagtttatgttttataaagccaggaaatctacagagttagcatttaggcaactgcaaggaagatactttcaaccaggaattcctatttggaactcagagatgtgagtctttattatacagtaagcaaggcagcagaacaaggtcatgttagactctcacgggatccttagggtgtgactttgctagccagaaacctctgtggctggtggcaccttttcctgagatttgctcaggcccactgggctcattccacctactcagcctagctggctatgcttggctttctctaccagctggaccccatgcctgccaaaggcaagccaggcatggagcagcgaggagtgcatgagcaagtgagtgcagggtccagccactgcacacagccaggcatgctggctgcagcagggcaggcagcctcaggtactagctccctgctgcagctagaccaggcattacctaagcagctttgactacaggccactaccactagtaaacctgatagaaaagtaagaaatatactggaaagaattgccacaagcctggctcttgtgttaaccttgtgttaacctggggaacacaggggcacccagaagcttggagatgccaggaactgcagaaccccaaagaggggggtcatagccctggcttagggaactcctgagtctggactccccgaagggccacatctcttcactcctctcttctctccttctcgccacctgcaacgtggcaagtggggggcacgtttcagccctgtttgtcttacggttctttcaatcctgccattcaatgggtcccaagttcttgtcctgcatccaggaagaatgaagtacgtggacagctggagggagagcaagatgaaaaggtgctttattgagcaacagtacagctctcaggagaccctatctgcaggcaggtcgtcccattgtctctgcagctctcagtggagaggagacctggagtgggtagctcctgtctgcaggcaggtcatcctgatgtctgtaatcctcagtggagaggagacccggaatgggtatctcctatccacaagcaggtcatcccatcatctctgcagccctcagtggagaggagacccggagtgggtagcttctttctgcaggcaggttgtcccttcatctgcccaagtctgactgagtctggggtttttatgggcttcagaggggaggaagtacatgctgatgggtccatgggtggccatgagcaggcccagaaaatgcaccataagttctcactgtggtctgtggaactgggagcttggcctccaggcttcaggctttccctgacttgaggtggtgcttcaccagggaacttcccctttccgcctaggagcctgtctgcctcctgctgccatcaacctgctgtctatagctcccatggcacccaggctgttcatgccaaagggtgcctgcaggcccacggtaagctgccttcagcccctcctcagtctccctcccatgcttgtcagcacccaaagtccagagggggccaaggtggcagggggctggcatgtcagtgctgccccaagcgcccgcacacccggccaggtcatgacagcacccagcctcagccacaactttgctctgaaatcggagcctgcagacgcaaggggcttcctggacccctgagagcacagggatgcccaggtctacagccacagctgggaagctgcagctgtgggagtgcgggacttctgccccaccaactcagaagggggcaggactcccgcctgttcctggctcctgccagctcacagagcatgctgccccagctgcacctcccctgctgcagctgccatctttgcagcagccactccagatgggccgctgctgccatcaagaccactagtaaacctgatagaaaagtaagaaatatactggaaagaattgccacaagcctggctcttgtgttaacctgtgttaagctaaagaaaatcaaatgattgtctgtgagcatgtaggtatatatgtatgtgagtgagtgatacaacagaatttcattcattttacagatgttgactgagcacctgactatgtgctaggccctggggatatagcactgaacaagatttcccctgcccttgtggagcttatagtctatttggagagatagatggtcaacaaattattacataaataattcatacagttgtgataggtactacaaagaagacgtataagttgctatgaaagtttataataggggaattttacgtatcctggaaagtcaaggggtgcttccctgaggaagtggtaataggggacggcccgctgaaggatggaggaagagctttccaagagagggacaacatgagcaagggctttgaaatgagaaggctggatgaactgcaggcttcctcagtgagaatgctgctggtattttggggggcacagttctttgtgggactttccctcatattgcaagatatttaacatccctggcccctcacccactaaatgccaataatggctttaaggctttgcaataatcaaaaactcctccatcctagttatttccaaacactccccggaagggaggtgctatccctagttgaaaaatcactgtgttaacggaactagaagttacattggaacaaaagggcatagggctccaagagggatatctgtgtaaggaaaaaacaaacaaaagaactgagagattacctgatgtggttgagctctgtcagagcatttcaggataaattagtcatagataataatataaaattcatcagtggaaaaaaatgaggcagttttccaaagaaaacaaaaacttgctcaaaaaagcaaatgtaattatagtatattctggctatagcaaagtagtttagttgtgaatattatttgcatagtgagaatataaagctgaatttaatataaggttatggcactgggaagacaggaagagttacatttgcgtgcactaaaggatgagacctaatgctttatcttctctataggaggtgaataagtacctcaaattaaaacatcaagttatggcacaatgagcatgctacttataattaattatggaggtaaataccaaaagggatggctaaaagagtttaaggtaggaatgagtatcagaagtgaggagggagggggtagaaaagggactgctgttttcatttataaatcttattcttatattatttcataaactccaaaccagagaagattcaggtttttggagatctggataataaaaagaatacaaaactatcaatacaaaattgtgagggctctcccagaggaagccatgcaaggaagggccctgaagcttacaagctttacttattcatggcaaatctacttctgctctgaacatgtattacttttataaaaaatgaaggaagaataaaagtactttgaacttcacttatatattttaattatttttaatgtatggaagttttttaagactatcatgctcaccattttcaatgagattgatagtcattataatgaaatgactggcccataaagacattcactccccgctcctttcccaatccaccctccagaatgaagccacttttataattttgtcaccaaatccagggatgagtgccaacagttaggaagctttcagttgcaaaagataaaaagcccaactcagttgccttaaacaaagaagaaatttattctttcacgtgacaggaaggcctgaggtgtaggcatttgaaatttgtagggttggttaatttggtggctcagggatgttttcaagtagcccaacttcctactctaccatcactagtttataggcttggtcttcagcccactgctcttcgtggtcatgacagctgtagttctaggcatcatgtctagataaggcaacattcaggggtagaaggggactgtttattttttcctttagtctctcttaaagagtgagaaaaattttcccaggaatcccggtggactttgcttcaccactcataggttcataccaagttacaaccccacaaccttagagcttttgttaggaagaggcttggtgggattaccgtgcttggcttggcttggtcaggattcaccaccagagtcatgtgggagggggtgggaacccaaacaattcaggattctgccctcaggaaataaaggagaaaatagctgttggataaactaccagcaggcactgctacagcccatgctttgtggtttaagggccagctagttacaatgacagctagttactgtttccatgtaattttcttaaaggtattaaatttttctaaatattagagctgtaacttccactttctcttgaaggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaagtatgtgcatttctctatgttgcaaagtcatggattcctttaggtagctacattatcaacctttttgagaataaaatgaattgagagtgttacagtctaattctatatcacatgtaacttttatttggatatatcagtaatagtgctttttttttttttttttttttttttttttttttttttttttgagacagagtctcgctctgtcgccaggttggagtgcaatggtgcgatcttggctcactgcaagctccacctcccgggttcaagtgattctcctgcctcagcctcccaagtagctgggactacaggcgtgcgccaccacgcctggataatttttgtatttttagtagagatggggtttcaccatcttgggcaggctggtcttgaactcctgacatcatgatctgcctgccttagcctcccaaagtgctgggattacaggcgtgagccactgtacctggcctcccttcagactttttaagttggcattttacagcctgaccttttggcatttattttataaagtaaaagatttgtttttttaattgttccagtaagccttcatggccgtaatacatttgtctacaaaaattttattaatatgtctcactctgctgtagagagatctgtggatttgcatgatacaaccttgtacattattattccttttgttgacaagtgctatattttattttaaagaaaatcaaagggatttaggatattggcagaaatgcaagtatttcttcagtgtctaagatgtgttgccacttgatggatttaagttaacacttagggcttcttaggaacattatcagccactaaagccctttggttagggctcagtcatctcttcagttagtcttagagatgtggttcattgaataagactttagcatattttccaaccaagttatttttggttgtcttgtttttgcaagagtgaaacttgattaaaacattacaacaagaatattaagtagttttaaggaaacaaacacctaggttccttagcatctttaatcattagtcactaattattatgaccttgacatatccatcagtttgaggagaacactttttacaccttgtcctcagttttttaactgagtcagaactttcactgggcatgttcatgactttactgcttggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctcctcctcttcgtctccaacttttaaaaaaaaaaaagtgaaactatcaagtattgctcctgctaacttcagatcagtattttctttctctgaagccaatgcaaagtaataacggacgtgcttcatcatcttagcattcagcacacgtgtcaccatctctgatggtgtgagcatgttaaaccagacttgtgggtacttaccaaaaggttcagttgacactataggtcagttgctaaaaggcacaaatgtcttctaaagcaatctgttaaaagtcaacatttaacatttaattagaaaactgatcaaaggatctgaatgtttagttctcccaagaaaatgtaaaaatgatctgtaaacacataaaaagatactcagcatcattagccatcaaggaaatgcaaatcaaaaccacttcatactcactagattggctataataaaaaagatagacaataacaggtgttggtgaggatgcgaagaaactggaatcctcatacactgctggtgggaatgtaaaatagtatagtgattttggaaaacagttcggtagttctttgaaagattaaatatgacccggtaattctactcctaggtatatactcaagagaattttaaaacatatgtcaacacaaagacacatatacaatggtcatagtaatattgttcataacaggtaaaaacagaaacaacccacatgtctattaactgataagtggataataaatgtggtatattcatacaatggaatattacttggttataaaaagaaacaatctatcattagtacacttaggatgagcttgttactggcatgttggctgtgggaagtatatcttgaaattcactaaaagaccaactattgctgggcgcagtggctcaagcacctgtaatcccagcactttggaaggccaaggcaggcggaccacctgagatcaggagttcgagaccagcccaaccaacatggagaaaccccacctctactaaaaatacaaaattagcccattgtggtggcacatgcctgtagtcccagctactcaggaggctgaggcaggagaatcacttgaacctgggaggtggaggttgcagtgagctgagatcataccattgcactccagcctgggcaacaagagcgaaactccatctcaaaaaaaaaaaaaaaaagaccaactaccttcacaataaataaaaatgtcttacatttctaattaaaatttttgttcagttttattattcagctttaaaaaggaagggaattctgacatgttacaacatgaataaatcttgagtactttgtgctaagtgaaataagctagttacaaaaagaaaaatactgtatgattccacttacatcagagtagtcagaaagtagactggtggttgccaggggttaaggggaggggaaatgaagggtcgtttaatgggtgtagagtttcagttttacaagatgaaaagagttctgtggatggacgatggtaatggtagcacaatgatacgattatacctagtgtctttgaacggtgaacttaaaaagggttaagatgttaaacttgatgggtatcttaccacagttaaatttttattatttttttattttttgagacaatttcgctcgttgcctagggtggagtgcagtgctgggatctcagctcactgcaactctgcctcccaggttcaagcgatactcctgcctcagcctcccgagtagctgggactacaggcacacatcaccatacccggctaatttttatatttttagtagagacaaggtttcaccatgttggccaggctggtcttgaactcctgacctcaagtgatctgcccacctcagcctcccagagtgctgggattacaggtgtgagccactgtgcccggccaaaaaaattttttttaaataccgttaagaagtggaaaataaggccaggtgtggtggctcacacctgtaatcccagcactttgggagaccaaggttggtggatcacctgaggtttggagtttgagaccagcctggccaacatggtaaaacctcatatctactaaaaatacaaaattagccgggcgtggtggcgcatgtctgtaatcccagctattcgagaggctgcggcaggataattgcttgaaatcgggaggtggaggtttcagtgagccgagatcacttaaaaaaaaaaaggaaaataagctaccagctgagagaaaatatatgcaaatcatattgaagtcctgttaaaggacttgtatttaggatatataaaggatgcttacaacttaatacgaagacgatagcccaaatttaagatagggaaatgctttgactagacattctaccaaaagagatatataatggctaaaaagcacatgaaaagatgctcaacatcattaatcagagtggctagaatgaaaaaggctaacaataccaagagctggtgaggatgtgaaaaaactggaactctcaattgttgctggtggaaattcagactggtacagccagtgtggaatgtgatttggcagtttattaaaaagctaaaaacctaaacttacatagcccagcaattgcacccccaggagtctacccaatggaaatgaaaacagtccgtccccacagagacatggacataaatgttcatagcagcattattcagaatagccccaaattgaaaacaatccagatgtccatcaactggtaaatggataagcaaaccatataatggaaaaccattcagcttccaataacttccaagaaactgtagacacatgcagtatcatggttaaacctcaaaaacattatattaagtaaaataggcgaggcatgtattgtatgagtcatatgaaatgtctagaaaaggcaaatttattgagatagaaagcagatcactggttgcttaaggcctagggtaggagtggggattaactgtaaacgggtacaaggtacctgactggggcaatggacatgtggattgtgatgatagttaaattgtacagctctctctatatatagttgtacagctctattaattttccacaatcattgaatcatgtcttccagttttatgaggtaaatcatagtccaatgaagcttttttaaaaataagatgataggccatgtgtggtggctcacgtctgtaatcccagcactttgggaggccaaggtgggtggatcatgaggtcaggagttcgagaccagcctgaccaacatggtgaaaccctgtctccatcaaaaataaaaaaattagccaggcatggtggcatgcgcctgtaatcccacctactcaggaggctgagacaggaaagtcgcttgaacctgggcggcagagtctgcagtgagccgagatcatgctgctgtactccagcctgggccacagagcaaaactccatctcaaaaaaaaaaaaaatattaattaatatgataaaatgatgcctatctcagaattcttgtaaggatttcttagtacaagtgctgggtataaactatatattcaatagatgacgattattacttattattgttattgataaataacagcagcatctacagttaagactccagagtcagtcacatagaatctggaactcctattgtagaaaaccaaaaaagaaagaaaacacagctgaagcctaattttgtatatcatttactgacttctctcattcattgtggggttgagtagggcagtgatatttttgaattgtgaaatcatagcaaagagtgaccaactttttaatatttgtaacctttcctttttagggggagtaaaacttggattgggagatttcattttctacagtgttctggttggtaaagcctcagcaacagccagtggagactggaacacaaccatagcctgtttcgtagccatattaattgtaagtatacactaataagaatgtgtcagagctcttaatgtcaaaactttgattacacagtccctttaaggcagttctgttttaaccccaggtgggttaaatattccagctatctgaggagctttttgataattggacctcaccttagtagttctctaccctggccacacattagaatcacttgggagcttttaaaactgtaagctctgccctgagatattcttactcaatttaattgtgtagtttttaaaattccccaggaaattctggtatttctgtttaggaaccgctgcctcaagcctagcagcacagatatgtaggaaattagctctgtaaggttggtcttacagggataaacagatccttccttagtccctggacttaatcactgagagtttggtggtggttttgcatttaatgacacaacctgtagcatgcagtgttacttaagacagcaagcatctagtgagaggagctggtgccatgcatgaccccacatagatcttgctgatagtgctacagcatgaaccctgaagctttcaaaactatgattttttttttttttttttttgagacggagtctctgtcacccaggctggagtggtgcaatctcggctcattgcaacctctgcctcccagatttaagtgattctctgcctcagcctcccgagtagctgggattacaggtgcctgccaccacgcccggctaatttttgtatttttagtagaaacagggtttcaccatgttggccaggctcctcttgaactcctgacctcaagtgatgtgcctgcctcggcctcccaaagtgctgggattacaggcgtgagccaccgcacctggcttttttttttttttttttttttggagacagagtcttgctctgtcgcccaaactagagtgcagtgacattagctcactgcaacttctgcctcctaggttcaagcgatcctcctgtctcagcctcccaagtagctggaattacatgtgtgcaccaccatgcctggctaatttttgtatttttagtggagatgaggttttgccacattgcccaggctggtctcaaacttctgacctcaactgatctgcctgcctcagccgcataaagtgctgggattacaggcatgagccactgtgcccaacctgaaaactatgatttaagtaaacaacccataaaatatttcttgctatttttactaaagatgtgttatcttggccgggtgaagactttctagtgtttccgtaactagggtaaaaaatgaactctattatatggcttgtacatgtgtttacaagaaagcagtgtactcctcataaataaacttttagtttattttattttttaaacactgcagcctcatcatgcttcacggaggagcctgtgcgggaagaatgctcccacacagcataaagaatgctcccgcacagcatagagaatgcccccgcacagcatagagaagcccccgcacagcatagagaatgcccccgcacagcatagagaagcccccgcacagcatagagaatgctcttcacctctgggtttttaaccagccaaactaaaatcacagaggccaacacatcatttaagatagaaatttctgtatcttttaatttttttcaaagtagttttacttattttcagattctatttctttactagaattaagggataaaataacaatgtgtgcataatgaaccctatgaaacaaacaaaagctaggtttttttcatagctcttcttccagattgaatgaacgtctgttctaaaatttaaccccaaaaggaaaatattcagttaactatgttaaaaaccaagacttgtgattgagttttgcctgaaaatgctttcataattatgtgtgaatgtgtgtctttcccatcttctccacagggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagc

SEQ ID NO: 36941 - DNA, 16961 bp, Homo sapiens
ctggaaaccactggtaagtgataactcctttatttcaaggtgaacattatttatttcaaggtgaacaacacatttataccttatcaatgataaagtgatatattcgtatattttatctacaattttccaaagtttattgataacttttaatgagagtaattatcttaatatattcattttaagctgagaagctaatacatagacagctttattattccaaaagcacttttatccagtttgaaatttaaataaatttttacctttcattctaaagtaatataactaattcccatgtctatgacttgtggaaacaattgtactagaactatttttaatagaaaaatgaaaaactatgaatatatgtgtgtgcatactttcacatcagtaacttttactaatattaaaacatacagctatatgggatgccatagcaaaagttttaaattggtcaaaacaaaattatagcactgatctcaagattaaaaagtattttattaaagaccatcaacataaaatgcaatttacctcatgaaatgcactcagatcaaaaacaaaaaaaaaaggcttttagaagtttttcagtcaaaagtcagtctactcagtcatgtttatgtaggtaatttaaatataatatctatcgtgcatatttcatctaaggaagcaatttccacatacggctttatcttccgtagcatattagaagtgattctgaagagtcagatagtaggagaccacagaactacctaatgacaacatgaaaggggttatttaccactagacagaagattttaaagtaaaatgcttttcttccctgtggctaaatgctatccaggaaactctgggagtatttgcaatagccatagaagatccggtgttgcctcttctgctagttaaaaccaaatctagaatgtctgcctgtatgactaagacctctgaaagtggatcaaaagaaattaaattgatgacaagtttcaagcctgggagttaccctacattgataagttatgaggtaaattggggcttctgatttgtaacaggcagggatgaattgggaggaagagtgtcagaattctcaagtaatgtaaatctgataattgctatgaatttcagttacgttatttattgaattcaagtaaaagggagggaattcatccttgaaaaaaaagtgcttctcaagaaatgcaagacagctattcttatttggatatctttacgaatttcttacttgatgaagtctagcagttttgcaaactttgcatattggcataggctgctttctgtatcacagatacataataagatgaaagaaagtgatcagaataaagattaactattaaattttaagtaagaaaatattgcatcaaatacttttctgtgctgtgactagtttataaatgtgtctatacctatagtgcacacattatactcacatgtgttaatgcttttgacatcttttctaatccacgtaatcctttaaaatatttctatagtctgttcttcctcctttgctttttaatgttacgatgtttggtctgtctcttaagttttgtattttcctccaccagttgatttatctgttcctacaataatattaaatttttgtcaacaaatgtttgaagtctatcttaataactaatatgaaaagataacccaattaattctttcttttttttctttttcttttcttcttccttttttttttttttttttttgagatggagtcttgctctgtcgcccaggctggagtgcagtggcacactctcggctcgctgcaacctccacctcctagtttcaagcaattctcctgcctcagcctccccagtagctgggattacagacatgcaccaccatgcccggctaacttttgtagttttagtagagacgaggtttcaccatgttacgcagggtggtctcaaactcctgagctcaggcaacccaccctccttggcctcccaaagtgctaggattacaggcatgagccactgcgcccaagcaattcttcttttaaaagtttactcagttattcataagccacttaaaatttgtattggaattaaagtaaacaattatcaggttagtttaggattgatatctttatgctaacatgtaccatttaaaagcattacaaaactctcaatttattcagaacttctgctatgttctttattaaagttttaagattttttccaaaaaggatttttaaatttgttttgttgtttcccagatactgtatagtttttttaactgttataagtgtttcttaaatcttatattctagttgagtgtttccagtaatagaaatggtatttttgtaagttgatagtgcatctagcaaaattgttaattttggtgtgttctccagatagatgatcttatcatttgaaaacaataacaattttacgtcttctcttacaaaagttacaaatattttatatataataatatattttatattattatatataacataaaatgtatacattacattacttgtatatattatatatatatatatgtatatactttcttttcttatggctttgattaggatctctccagtactgtgttaaataaaagtgttagtcattcttttcttgttcccaatattaaatgaaatgcacctagaatttctccaataaccattatattgggtatagatttgcagtatatgcttcctaccaaagtaatgatctcttctattttttctttaaaaaaaaaaaaaaaaaaaaaaactacatacaggggttgaatttaatgacgtattttttgtcatattactttgctttagtctgttaatgtgatgaattttaccaatgaattttctaattttgaattattcttgcagtcctcatataattttacttggtcatgatatttttaatatatttttgaaattgatgagttaatattttgttaggattcttgcaattcatttatgaagtgggcttatgtattatttactattattcttacgtcttttatgagtcaatcccggaattatatccactcctcagattacatttcaggaaaaaacagcattgggaggaagtagtcaagctaatttgaaccatacaacactagggagtaagaaggcgtgagtataagagcactggagagtgctatcacacatgaccttattatcattggttcttcacacaggatggtactttcgttttttgtttttttttttttggtggtttttttttgtttgttttttttgtttgtttgttttttgttttttgttttttttgagacggagtctcgctctgtcgcccagggcagtggcgcgatctcggctcactgcaagctctgcctcccgagttcacgccattctcctgcctcagcctcccgagtagctgggactacaggctctcgccaccatgcccggctaattttttgtatttttagtagagatggggtttcaccgtgctagccaggatggtctcgatctcttgacctcgtgatctgctcacctcggcctcccaaagtcctgggattacaggcattagccaccgcatccagccccacacaggatgggtcttacagttcttcgatgctactttgctgacacatagcactagagcaagcgtttttctgttgttgcagaattttgcaaataaagaggaatcgattgttttgaggcaagagtagaaactaacaggcattactttagaccaaccactgctgttggatgcagcactcccctctccttcacattcactatacacaacacacacacacacacacacacacacacacacacacacatccatatacacattctagaagtcatgagagactttattctcctcagattttctcactatcttttcagtattttcttggaatccctgtttccctcttgcttctataattttttcagagttaattttggggtggcagcaagaagcttgcttattttgatattgtgcctgaaataaaagccaaaggcttgctttataaatagaccatttgattaattcttctcttagcactaagcaaatttgtcctacttcctaatttgcaaatccttatttccacaaaatggactgttaaagccagatatgcctatagaagtttttgtagatatatgttgtcagtcaatatgcagtgatatcaggtcatttgataaaatgatttccttttccaagggagtgtttcaaacataccagtggtcctaacatcagtgtgaagaaggcacagtatgttacagtttaattgtattatatacatttatgcttcagaaagacacaatttgctctgctgtagatctggaattagtagcaaaccatcactatttgaaatcataaatctttgaaatccagggacttggtttttctctaatcacacttgagataaattattaatttctttgaaaaaggaaaaccagaacagaacagaaaaccatataaaaggtaggactcagtgacttacacatagcaaaataactctttcaagtgaaatgaattaagagaaatctactgcttatttccaaggaatagtagaaaataatgtataactaatacacttagaaattgcttcatggaagtgaatgacaggagaggctatttttttttcattctttctagtaccttctatgtgacgctactactaaatggaattgcaaacaaatcattttccacttgcacctgctatttacagtagtcccttgggaggagaggtggggatggagtgaaatattacagcgactctctgtcaccattattggtcttaaagctgatgttacatctttatcatatttatctcattcaagttgtttactccctgagccctgaattgtgctagattcttccccatctctctccataaagcattggaatggatcactgtaaaaggaaataaaattttactctcctcttttgcacacatgagaaaattcaaccagctccccctctgggtacttgaatgatgagctcccgtaattatataccaggactctgagggcaagaaccaagtcttgttcacttgatcatgtgcagcaatattataacatgttatcctgaatagagtgtacaaaacttgataaatgtctcctaaaggaaagaagaatacctaattgtctttgacttacaaatgaaaataagaatctgtttttcctcttttgctctcaaattctgcaggagacgcactagagggcccatctctaaatacagcacactaggagttagggcatcaacatattgatttagaagtggaagcagggccaggttaagttatttctgagtgagtttcaaggtctataacactagtagtttgaaatcttctggagctccagatctgcattctggcaacatcatttttcgtggattctttttttttttcagacttcaagtgtatttattaatgcattggacaaaataaaaccacacttgttatcaaaagtatatctcccctgctcccattttcttgttcttccattggaaatatctttgaaaaagtgatacaaatggataccagcaaagtcccatatttgcggggtgattgtggggcgatgctgggacgagatggtttgtgacattgactttaatagcatgaaaatgggttttgcaagtgtatatcaggctgcatcccaatacttagattcacagtgggcggggtggtggggtgcagaggtgctggttaggagaaggaaagctgaatttagtgctgggaaccagtctggggtggaaagctcttcctctgggagttctgtggggatttggtgttagctaagttcatagtctaagggagacccagtcccagcccccagagctgaggttcaggaggaaccagtgaataactaagaaggaagagcttttgtaggatgagtcactacttctattaacgttcagtccaaatcagaaggctaaggatctaccatatactatttgttctgctttcttgtttttaaacttaacactgaagcataagcttcttctctgaggttacaaaacaaccataaatgtatagtggtttttatgtctaatatactgccataagaggatgtattctcatttacttagacattatatctccctattgctaggcatgtaattaatttacaatgttttaacccttataaatgataacatgatgaaaattttatgcttaaaactttttagtatagtttataatttcagtagaattctaagaagttgaattagtgagataaagaatgtgaacatattaaggatattaatacagatagggtgagtaatcccttaaacatgagaatcaaattattacctttttgttttaagatccagaggaaaaaaatgttgcctttttaaatttgaggcatggtattaaagaaagttttgagaggaaaggagttaggatgctggctgcatgggtaaacttgaagagagtagtttaaaggtatgcataaaaagcatatacgtagaggactttctagggtttgaagaatggcaagtatatgagccagatccctgacggaaaagaactggcacatgctaacttttaatttgaagaaatgttaataaggttatatttataaaagtgtagacagcacttaaggaaatcagcaagggctaatgcagtagtatcccagtaataaacacagttggaagctactgaattgttattgtgaagaatccactcctacaacctaaagacagtagttacacagagaagactgcggagctgcggaagaaggaggtagaaagtccttagcatttataggcatgcttcaagggcttcagtcgggaattttggtttgttctttatagtcccagttgaatgcatactttgaaagctgaatccactgtcattctgctggctccatgtgacaagtcttctcctgttacattaataatgaatttgggataatggaggtcattacgtttctcccacccccatgttactcaacagcatgtaccaatcattttaatgcagatccctgttccaccggttttgttttcccagcaatgacattattcccagtgctgttgttcctggttgctgggctgcttccatcttttccagcaaatgaagataaggtatggttgaagtcaaaaatcttcagaaaaattcaggcaaccatgagggatggcaagctactagatcaatcttcaaaagtgaaaaggtctagagtgtctggtacatcataaagtactcattagtagctcaaggtagttaacataattatgtttaaagctgtggtgatcaatatggtagcccctagccacatgagggtattgaagttcattaattaaatgactttgctccaccccgcaaattgccttggagattttttttaatgtggtaaaactatcttttgagtgatcccataatatttgctacgtaatacataaaactcttttactagagtattgcatgttacacatgcacttaggctgagcctaagcattttttctaaataccagacaccatttcaggcagaaattccccctagagtcttagggtaaatcatatgcctcaatctttacaacttctttgctgcagcctgagtgtgaatgtcttaataattactatcatgtacccttgtcactataagatgttatcactcatatatttagaaaaatcacattaagacctctcttaacccagaaattggtatttgtggcctcagaggagattttagtttgtcatgccatgaattatatccccattctgaaaactttcatctaatacttttccattaaaaagtcatagctttggcagtcattgacaatgtttacctagcattggcaacactttttaaaaatggtctttgttcccttgaactaacatagttactattatgtgcaatttccaacaatgttaaaagataattgtaattttattttcccttaggatcccgcttttactgctttgttaaccacccaaacacaagtgcaaagggagattgtgaataagcacaatgaactgaggagagcagtatctccccctgccagaaacatgctgaagatggtaagaggtgatattgcaaaggagaggggtgtgaacaagctgtggaaggagtaggcggctggcaactaatatctcttaataactttgaagtttacaaagttctctctgtatttttttgtttcatttgagctgtgtaatgggcagagctgaatttcttaacttctctttataatggttgcataacgtcaaattcatagggctatttaaattatggaggcagaattaaaacctaatctttggacatacggtgaaaagccattatgtttttctgctccttatcttatctgtcctaatctgagatcagaaagaccttttccttttaagataaatgccatgtagggtaaataacaatctacttttctgggccctgtaccaaaggccacatgtctcccgaacatattcagtgagggggaaaaaaagaaaaaaagaactggaaatgaagtaagccagctaattacttcattgttggaaaagcaatctcagcacctccacatgtttatcaatatttagaacaggaccattacaaaaaatctttaggtgtttctgatgtcctgtgataaataattggaccataaacctagattttttgattacttagggtaggcatattacctatatttctttgtggagcagataaaagcacataaaaaatatatacatttgattactataaaaatcagaagatgcttgtacagaaattttatgatgatgtaaatcaacctataacctgattataaagcttatgctcctttgaggtttgagacattaagtggatatcttttttctgtccttgtttcaggaatggaacaaagaggctgcagcaaatgcccaaaagtgggcaaaccagtgcaattacagacacagtaacccaaaggatcgaatgacaagtatgtaaattaggaaatatttgttgaataaatcaacaagtaaaataataaaccatgttatgatgttgcattaagaaaagtttgtaaataaatattgcttctaatgctacctttttcaatatggactatctacatgtagagataactctgagaagcaccatctgtgcttactgttttaaataaattttacaaaaaccgtctcacacagtatcatatttttacctctcaatcagctcaggagtaaagcaggttacagatcatctctttcccaattacagagattagaaaatcaacagcctggaagaaaatgatgattggcaattaatgtcatatataggaaatttggaattagaatttctggcttctaaatcagtaccctttttagtgacaatatgcagcctatttgtgttttgaaacctacttaattttttttctataaaatattttaaattttgtcaaactgttcctgaattttatgaaaaacgtatttaacattagcattaacttttattattttcttttgaatttttgatgacagtaagccatgtcttttatattttctggatgtttacaatgcatactatattaaactaaaaaaatgacctgcaagacataacctatacatcaataaatataaaaacaattagataaaatatcatatggatgagctatcagataaaatacttattaaattatcaaaaataacataggtaaaggcaaaccaaatttacaagtggtaaataactggcttgttttgaaaataggacagccactgttatctatatttttgatataaaactataataaatttatgaaagggggtaactatggtcacgagaagattgaaagaaatggtcttgaaaatcccaatctattgttaaaatcttagcttctttctttccctctcaaaggagctatacaaaggtagtttatactctctttaagtagcatgtagacattccttgttaagccatccaaatataaatattaattttagggcttgaaaaagtgttgaagtatttctgggctgcaaggcacttttttccttattttttgaccagagtgtggcctgtgatgttctgatttgctaagaggaggcctgtaacctgtgaaaatattgtcttttatggtgtcatttgcttcatgtttagggctcttaaagactgagcataagactttttaaaaaattcacacaaaataataattctaaccacttattcagattcctatatatgaaaatctctggtgagtatgggctagagcaggagaggaattactaagttgatctctgtcttcagcaagctcacattacaaagctgaaagctcataaggcacacacatgtgaagaattcaatgtgtaaataaatgaatccagggagagcagacattaaagaaaaaaggcttctccatctactcaaagttttgcatgttgagaccagcctcaagtattgggcaaatctggcttctattcagcttatagctgataaggatctgaggcaccctccttatgtattagtcaatattcattaacggtgggtactggggactgtatttaaaaaacagggattctgctgtgtgtagtgtgtgtgtgtttgtgtgtattttgccattgcatgctttattgctttcctcatgagtggtctgttccttcttaggtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggtaaggagaagaaatgaaaaaccatctcctttataagtgccctaaaaaaaaaggattcttcaaattttgactgattccaagttgaatttggggaaaatttcaagtgaatatagaatagtctggcatttggtgagtatttcagctgtgaactgtcatttttcagtagactgcaggatcatggtagggaagcataatctttgtccaacggtctcaaaaaggaatgtacatggaaatgtaatattttaaagtgttttagtttgattcaataatttaactaaatatagccataaggtatatgaaaacaaaatatgtcggtaacattcttctccattttgtatttcctactatttgttttttggtatttccttcttctctaatgtgctctcatatcttcacttattggtttataggttgtttggtactcttcatacctcgttggatgtggaaatgcctactgtcccaatcaaaaagttctaaaatactactatgtttgccaatattgtcctgcgtaagtatatattttagcgtttattgtcaataatgctaaatacaatttaacatttaataaaaaaaaactaaaaagcatatttaagtaaaggtgaaggagattaatctttagaaatgttttctaaagttgagacacattcaaccaacttctcagaaagataaagttttcagttccagttccaagtattattgaacagggagctgtctttcctcatgcctaaaataatttgtctcctctctcaattgccttttgctatgctcacggttacttcataagtacatgtagtgtgtagttatctaaatataattttatcagttcatgctaagtttacacacgagaaactggaagcttgataattagtccagggataaagtaaggtaacaaacaaataaggaatgacccattttagcaatatcagtcctttctgctcaaatgctcttactcctgcttatcagaaaatttcacattatacattaagaaatgattaaatcttggacctcaaagacttttaagagatccccaatatatttcaaatagccaagaaaagataatgtcttaaatttttgcttcttagaatttaccacaaaaaaaatttcatggaaccttccattaagatcctaatttcttaattatctcgggttttctgcagaaagtccacttttttttctcaagcaatatagttgacctactcacgaaaaaaaatctgtggatatattgaagatatattcacaacatatctattagctttaatttccttttaatatttgaagttgttcaccactagtgggaggggttttccccaaactcagctttctgcatggcttattttgaggctgtagatatcccaggtgatgtaggattccagtctgagaaatatgacctgtaaggtcatttttcagcaaagaattatcattgttaatacagaaaattgaaagaccctgggagactgcctccaaatgcctggtcattagaggagagcatctggagtcagcatctgaagtgagagttggaattagtaatgagagaaaacagggaaaagagaacttccagaacactttgatatctatttcacattttcttaagtgctcacacaccaacagctatattctgtgaagaaaggctgagattcagctacatagccttggaccgttagcctacttagtgcaattaagactttgactttcttgtattttcagatgataattaccgataggaaaataatcatcaatgatgtacaggctagtcactgtaagatgaacacacagaggagattagtattaattaaatctttttttccctaacattcccattcttggcaaacataaacatctcatacacaccacctgtagacattcccaaacctttccaagcccaataccctttcacaaacatacagcaaaaaccatgtgaaaatcaccactccacctagaagccaaaatttacgctgaaactgtacttaccctacctcatattgtagaaattatggtttttttttatttttaattataagttacatttaacattaaatgttatttttcatattgcaaccttctgtgcttcaggaacttttcttatctctctaggggatatgttttaccccttgccagcaccttgtggtacatcatcttagcaatttgacgaagtctgttgggagatgaagtgtgttgccacattgaaatatactttaaaaactttagactttaattatcctatttcagtttctcaggttgcaagattatggtcaggaaagtgaatgaatgtgtgaattattctcttaatttgcattattgtctgaatatactctgagattatatttttaattatttgacataattaaaaacatttaataaatactcatgtatatttggtgactgatactaaccttggaacataaacgaaacataaaaatgaaaaatatttgacatttttatttcaaatttcagtggtaattgggctaatagactatatgtcccttatgaacaaggagcaccttgtgccagttgcccagataactgtgacgatggactatgcagtaagtttgaagtgattaacttgataataaaataaaatgatctgacatttcttctaagaattgggaaatctgaagacaaccaacttaagcaatgccttcatgcaaaggacaaaaaggaaaaaaaagtctgtctggctctgtcgcccaggctggagtgcagtggtgccatctcggctcactgcaacctccgcttgcagggatcaagtgattcttgtgcctcagcctcctgagtagctgggactacaggcacgtgccaccacacctgattaatttttgtactttttgtagagacaggattttgccatgttggccacactggtctcgaacttctggccatcaagcgatctgcccacctcagccacccgaagtgctgggattacaggtgtgagccatcacacccagccttacagagcatttttaagtgaaaattttacactgttcagtatctatgtatcatttgcaatgtaaaatttggcctgttatcatatgtaacctgttgaaacacttaccatccatgttacatattggcatatatgaaaatgtgtctgtggaaataacattgtaattaaataggaagtttattctcatcaaagtttatatcattatacaaaatacagcattattttaaaaaaggaaaacaaatatacatctaagagtatgagaccatagaatatggctcaatccagacagggactccaaatactgcaattcctcatatgctaatgaacttatcatactaacttcctcatttttgccatagtgtagttacaatcatcaagtttagtataataatcacttgcacttctgcttgctaataattttgtatacatttttaaagtcaaaatcaaatctgtatgtagtattagtttgcagaagcctcaaaaatattttagcaaaaaggagtaaataaatttatatctcatacaatttcattttgtgcttttataaataaaagtacaaagagatgatatttttgtttaactaggatatgttactaaaattattactgacaatgcagttgacccattcattgagatttttacctttcaaatgcattcacctgactgaattgtaacattttttttctgactgaattgtgtagctataattcagaatactgataataccaaagctataaatcaactaaagaaggaaaatccaaatatttccagcactgccaaatgctgttttctaagaagcttgaaatttatcttattagtaataatcagccaactgaaagattttaaacagaagaatgataagatctgaactgtgttttctaaagagctcccgacagtagtaggaagaagcaattggatgaaagtcagctaggagactgttggaaaaacacacactcaaaaacaaatgggtatcttcactgcattagggcaaaatgaatgaaaaaatagacaggtatgaaaaataggaagaaaatagaacagtcggttgttacctggtattgttgagtattgattacaaaaaaaaaccaaaaaatagaaacaagttccagttgattcctggatcctggcttgaattgtttaatagttgggagtgtcatttctctgaaactgggtgaacgaagtgaacagttgttgggaaataataaggaaatgtcaagcttgtagataggatgatgaatttagtttgagatttattgagtttgtggccactgaaggacatccaagtagaaatgtccaataatcataatgacattctctccaccttttacattatacatttacatcttcctataataattacctagacctgagagaaagactgggggcattagagtctagaacaactgtgtccaatataactttctacagtgatgaagatgttcaatattcctataaagtagcccttagacacatggctactgaacacttgatataactggtgttgttgaggaaagacctgaaattttaattttatttgattttatttttatttaattttaattaatttaagtttaaacaaccgcatgacaaatatctaccattttggatgttgcagttctagagaaattcatttaaattaattttactctgctcacttgttgagtgaggaaaatatgtcagttcatcttagaaacatttccaaaagctcgaatttaaaaaagaatcagcgtgtttacctaagtgaccttatgtgtccctcaagatataaaatggccatcttagtgtaataatctcaacttgtttgctcacttccctactctccgttcatatagaatgttttgtttgtgttgctgttatgaaagaaaatgataatgaagtgactaatttctttgtttttattccagccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttcaaagacgttttcccatatgctgtcttaattcttttcactcattcacccttcttcccaatcatctggctggcatcctcacaattgagttgaagctgttcctcctaaaacaatcctgacttttattttgccaaaatcaatacaatcctttgaattttttatctgcataaattttacagtagaatatgatcaaaccttcatttttaaacctctcttctctttgacaaaacttccttaaaaaagaatacaagataatataggtaaataccctccactcaaggaggtagaactcagtcctctcccttgtgagtcttcactaaaatcagtgactcacttccaaagagtggagtatggaaagggaaacatagtaactttacaggggagaaaaatgacaaatgacgtcttcaccaagtgatcaaaattaacgtcaccagtgataagtcattcagatttgttctagataatctttctaaaaattcataatcccaatctaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgataaatatagcagggtaatgtaagatgataacgttagagaaactgaaactgggtgagggctatctaggaattctctgtactatcttaccaaattttcggtaagtctaagaaagcaatgcaaaataaaaagtgtcttga

SEQ ID NO: 36942 - DNA, 512515 bp, Homo sapiens
  misc_feature (259594)..(409593): n is a, c, g, or t
gttaacggcatggagaacagtcaccccccccaccaccaccaccagcagcccccgccgcagcccggcccttcgggcgagaggaggaaccaccattggagaagttacaagttgatgattgacccggctctgaaaaaggggcatcataaactgtaccgctacgatgggcagcatttcagcctggcggtgagtagccggcgcgcccccccagccgtgccccgcgtcgtgtccggggagacgcgcctagcggccagggaccccccgcccgatcccccggccaactgtcagacggggccccagccctggagtttgacaagtgcctcgagaaaggggtctgcccatggggagggggaccagttctctcatcccggccccccaatttctccccacagatgtccagcaaccgcccggtggaaattgtcgaagatccccgggtcgtcgggatctggaccaaaaacaaggagctggagctgtcggtgcccaaattcaaggtaggacccctccccactgccccgccgtccctcccccacctccccgagttcgaaaataacgccagtcctgaccgagcccagccggattcccagttcccgccgtccggggccagggaagttttggcggggaggggtagagcgctggcgagagggtgtcccctctcagctactgaaaacaaaataacactgggtgaaactgtaatcacggcgcagatacagtgtcctgcacgccccgcggggggctcggctccgagactctcccctctcgctagcccactacaggacaacttcttaagcctgaggggtcgcccctgacccggcagcaggaagagaaggccagaaaggggggtggggaaagagaaactgtttctttttcccctttccttccgaacccagaggacttccacgttccaaacgatttaatcctccgcttcccgggcccgcccgcgtgcattttttttttccaaaaaaaattttttttttttttttaatttttagtttttttaccctttattgttttcaacgggtgggcgagttgcgggcggggcgggggggatgttgtgttttcccttaggtttaaacgttcttcaaactcccttccccctcggcccctgccagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggtgagcctggcaggggaggagcgtggggagacctgtcagcccgaccctttccctccccacccttcctgcagcgtggggaggaccccccctcactcttccttgggatccccccccacaaccttatttcttagccccctcctgagggtagagtcgcgtggagctaaatgtgttgtctgttgctaggagacagtctgtaatttaccaaatgtgccggtccttggccaccgcacccctagggaccacccggaggcttccccaccgctgacacccccgcgggccccctctctgagccctggtggcttgggtttagacagtccccagtgttgcctgtgttaggggaggagacagagtttgtttacttgtgggggactgaggaagtgccactaggatgccttgaaatacatcaagagaaggtctgaaaactgaaaagagagtcctctaaggatccagggtgtccccccacctccttgctgccccttcccctctggaagtggcagccaatctggggccaggagtgttgtttcattgataaggttctcgacagagccgccggggaagagcagagccgggaagagggaagagccaggcaggcggctctgggtgctcaagggttgacactgtgtcttccctcctctctcttaaagagaccgcagcacctcccctgctctggaatcagctaggtgctctctggagctggctggggaggccatacctcccaccctgtgggtcttcggaggcccctgcaggaccaaggggcttggaggactcgagggcattccccaaagtgtgcctgaggcctctttagggaagctcccacctataaaagaaggtgccgagtgctttgagggccagccagcttgtggggagatgtcattcggtccctagcccaccggggtcccctgggaaaccctgcctgggagggcaaaagtgcagcttccaggaattttgtgagcatggcgttcagggacaactgggacacaccaaacccaaggcaggaaaatcagaacttttctttttttgcgtttaatgattaaaatgtattgaccgagctctaagccggtgccggggggtggtggcagttattccacgcacacttgccgagcctgtgcccggttctgttcctcctctcagggcacagccctctttttctgtccagtccacagtccctcccacccctttccctagcttctcagtctctgggggttgggggggcagtgaggaccttgggtggctgcagcacgatttctccctgataattgaattgaacatggtaacccctttcctatcacgtgcccacattttaaggagcagccaggtctcaacaaaatttcaattctgtaaaaaaaaaaaaaaaaagaaaagaaaagaaaagaaaaaaaacacaaaagccctcagagactgccaactaagtttgtatttcaagaaagagaccagtaaagtgtagctccaggaacgtgtcttttttgcatatgtaagcagctgcctctgaggctctataaatatcgataacccctgggccctggtctataaaagcctccttctgctgaggggtggagggttcaagcccaaggtagtccccaggccaccctggggccctcagcctggtcagggcctgtggagttcacagtaatgtgctactagagcgtgttgcaaactctgctgctcacctggccccagatatttaacaaactctggcttctgtgtcacgggcttcccttcctcttactgcaagcccctgggtattgagcagaaaggggaagacctggctctgtgggtgccatggcccaggtaatgcaggggtgggggggggctgggcgtcgcgggtggcacctctgggtttgggtttgggggagtctcagccccaggagacatgagcttctggatctcaggatcagaaaaatggtgcagctcagcagctttgttgaagaggtggggaccctgagcgaggtgcagaggggtgggaactcagggccacacagcctccctaggactggggtctcgggcacaagggacccaccagggtgccacacaggttggaatccttgtgggggctgccccatcctggaacctcactgagttccccctttcctgcccatctacaggggaaacccgaatgcggttctatgaactgttggtcactggccgatacaccccccagaccctcccagtgggcgagctggacgctgtctctccaatcgtgaatgagaccctgcaggtgggtttatggccgtcagtctgccccatcgccagctctttgatgtgccccccacctctggaaagcctcaccaactctcttatgggacccccagcctacccccacctcactccagctttggagaccaaggcctaggagggtgtgaagcctggccacgccccccacaattgggagcagggcctagagccccattttcccaagtgctcctgcagtagggctccatgggattggttctgtttcctgtggcttctcccctccccagcacaggctgtgattcccacagacccagagcctgccctggcccgcttttccacgttgatgccaaacattgctgtttccggggtccttagtgtctggtgtcctgggcatgccactacccctaaacccagaaaccagagttcatgccctgccttccagagcaaggctgactccttccaaaccactgccttccaggacacagggacaactctcgcgtggggcgagtctcatgccagctcctccctggcatcaggctgactagctgccactggcctgttcatcactttttttttgttttatttatttttttgagacagagtctcagtctgtccccaggctggagtgcagtggtgcgatctcagctcactgcaagctccacctcctgggctcaagtgattctcttgcctcagcctcctgagtagctgggattacaggcacacgccaccacacctggctaatttttatatttttggttagtagaggtggggtttcaccatgttgtccaggctggtcttgaactcctgacctcaagtgatccacctgcctcggcttcccaaagtgctggggttacagtcatgagccaccacgcctggcctctgtttatcactttaaatcctaaagcactgggtgactaggaggacaaagcccttggccatcctctcgtgcacaagattgtagttcttggtcataatcctgcctggaaggtctttgatttctgacagcctgaggcagaaagaaaatcccagcctaaaccaagatgttacagtcttcttttttctctgcctcctctggaattaggaatgaccctcaaggttccctgaacatatttggctacccctaagattagagaaaaagttagtaccatcctgacactcctcctcaatctcccccacttccattccttatgctgcagttctagagcagtttggctctgagcttcccagcagccagagtgagaagggaaaatagccctgttccattgcatgttttcccccagtggtctgacatctctgtctctccttagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaagtctgctttctctccgtatcagaccccagtggcccacttccctccacccccggaagagcccaccgccacagccgcttttggggcccgcgacagtggggagttccggagggcaccggcgcccccacccctgccacctgctgagcctctggccaaggagaagccaggcacgccacccggcccgccgccccccgacaccaacagcatggagctgggcggccggcccaccttcggctggagtcctgagccctgtgacagccctggcacgcccacgctggagtcgtcccctgcagggccagagaaaccccacgacagcctggactcgcgcatcgagatgctgctgaaggagcagcgcaccaagctgctcttcctgagggagccggactcggacaccgagctgcagatggagggcagccccatctcctcctcctcctcccagctctccccactggccccctttggcaccaactcccagccaggcttccggggccccacgcccccctcgtcacgcccctccagcaccggcctggaggatatcagcccaacacccctcccagactccgacgaggacgaggagctcgacctgggccttgggcctcggcctccacctgagccaggccccccggaccctgctgggcttctgagccagacagctgaggtggccttggacctggttggagacagaaccccgacctcagagaagatggatgaggtaccaccgtgtctgtccatctgtctgggactggttttgtctatcttgtatctccctttcccccttcaagcatttagcatgactagctaagatgcggaagcaatggggctaggaaagccaatataacaggtggaacttacagaataaaaaggggatgcagaaaacaccaggggctgtgattgagcaattggtttggcaatgagctccctagcagccgtggagagaaggaaagcatggcctagttctgatgctctccttgttaggtaagaagtcagcttttcctagggataaattctggcctgagctgctttggtaggcgtttgctgagagttcagagagtatgagctgtggggatggctcttggtccccttgtctgttgcgtggcttgggaatgatcagggagagtcctggccctcaggcagaggggaggagagagattggccagaatactgtgctgggctaagtggggtgaagccccggagcattgtctcctagagcctggtgccctctgaagagggggaaaccatggcagacagggagggtgctggtttcccttcttctcccactggctccagggatgaaggagttaagagctaacttggggtgggggtggggtgccatgtagccagaaaaaggcaaagttgaccatcccccaccctctcctcaggtcatggggtctcgttgcctaaacctccagcctcaggaagtcccgcccaggggttgggggtgagggtgccacgtgccaggttcccctgggagggtgttgggtcatcttccttggctccactcctccttctcggtccaggcacctgccttggagccgtagtcccggtgggcatgggcagtcaggggcttagacagagctctgcgtccctgtgggcggaggggaggaggactgcccccttcttgggccctttgattaggcgggtctggctgcatcagggaggaacgagaggaacttggcttgcctgggagggtgctgcaggtggctggggctccagggggcctccaagcagttctggggaagtggtttctggcatcaaggggtccaggcagggggccttggcagggggcgttgacaggtgtgcagctgtaggggggccgccggccctggcacccgtctcctccgctccgtctaggctgcctggggtgaggagtgtttaccatgctgaccacggtccagggctgagaggcccgcagtggctggagcgaaaggcaggctgaggccccgggagcgagggtctgggactgcccggccgccagcgcagggagtcgccgagtgccgggaagctccgggccggcccgcgggcgccccctgctggcgccggggaatagcgcctgggctttctgcggccgcgcgcagtgcggggagctggaccccgtcccatcctaggtgggggagcggcgcaggcggggccagccgagggtgcagggggggcttttcttctaaacagtggctggtcgttaaaagttcaggctcaagttcttgagtcctgccaagtcacttactggttatgtgaccctggaaaaggcacttttgcctttctgagtctcagtttcgtcatctgccaaatgggcctgtgagagtccctgcagcacaggacctcagcttaagtgaggtgccgcacaggatgctcccggcaccgccaggcctgctggactcccagttctcagcaaattcctgccgcttctcaccccgagactgctgggcagagggaggggcagggccggccggggctggagcgcaggatctgcctccctgtgattggctggcggcggcggcccgggttaaccctctgtgtgccgcggcgcgctgtgctcggctctgtccaggactgatctggggagtgctctctgaggatccacccgagcccgtctgtctcttcttgatgtgcatggggatcctgagaaggagagtgtgtgcgtgcgtgcgtgtgtgtgtgtgtatgtgtgcacagaggggacctggtaaagtccagagcttcctgccgctgccttagtttgggtagtctccgtcctcctaccccgctacctgcagttttcctctgaggccttcctcacctgtagtctgacctctgatcttgcaacttgcacagactccacctccacccccactccccctcagccttcaaaggtccccccaccccaagtccagacctgtccactcggctccctaaagccccacgcccatccttgacacctcccacatttacccctcaccaccgccctggatcccagctgcagccccgcactgggcaggtcctgggctccagaccttcttctgactggctgtgccgcggggccacggctgaggctctgagtgtgtttattaactgtcaaatgggtcggagcagagccccccgccctgtgaggttatctttcggataaaaaatgaggcagccgtctgcagcgcttagccccacgcgggcccacactgattgtgcagtcacgagactaggtgaaaagagtaatcaaggaaaaataaataacaacacacttcctgtttatgggccttagtgctgctaaacccccgctccaatgtcacctttcctgcctggccgtctgccgcagagtgaggacagcagggtgactgagagcacaggctgcagaaccacttcctggttcaaatcccggctccatctcttcttggctgtgtggccttgggcaggttacttaaattctctgtgccccagtttcctcgtggggcaaaaatggagttgaaaatagggctgttctgaggattagctgagttaataaatgtggagcgtttagaaaggccctggcacataagagacactatggaagtggcaactatttctgcacacaagttgcaacagaatctctgaaattgcaacagtttcatcctctgtgccccacccgtctccctgccttctttctctccctcacgtttcccgtattcaccctcatcatccttttgccttttcctgctggctccgctccacaagagtaagatgtttgcctgcctcttcaactttgtgtccccagcacctagaccagtgcctggcacacaggtactgagcaaatgtttgttgaattggaatgaatgaatgaattctagtggtaactccatgaggcagggactatgatgcccattttgcaaatgaagacgctgaggcttggagaggctgaatggcttgcactgggtcacacagctgggagtgccactgattgctagtcttgcagaggggactccgagagccccttggccttccagactcacctcactgtctctccctgctctctctgcagggccagcagtcctcaggcgaggacatggagatctcggatgacgagatgccctcggcccccatcaccagcgctgactgccccaagcccatggtggtgaccccaggagcggcagccgtggcagccccttctgtgctagccccaaccctgccgctgcccccgccacctggcttccccccgctgccccccccaccaccaccacccccaccgcagcctggcttccccatgcccccaccgctgcccccaccgccgcccccaccccctccagcccaccctgctgtgacagtgcccccaccacccttgccagcgccgcctggagtcccgcccccacccatcctgccaccactgcccccctttccgccgggcctgttccctgtgatgcaggtggacatgagccacgtgctgggtggccagtggggcggcatgcccatgtccttccagatgcaaacgcaggtgctcagccggctgatgacgggccagggcgcctgcccctacccgcccttcatggccgctgcggccgccgctgcctcagctgggctccagtttgtcaacctgccgccctaccggggccccttctccctgagcaactccggcccaggccgcgggcagcactggccaccactgcccaagtttgacccgtcagtgcctccaccaggctacatgccacgccaggaggacccacacaaagccacggtggatggcgtcctgctggtggtcctcaaagaactcaaggccatcatgaagcgtgacctgaaccgcaagatggtggaagtggtggctttccgggcctttgacgagtggtgggacaagaaggagcggatggccaaggtgggtgggtgggtgcagggctctgcagggtggctgtggaggggggcaggtccccagccgggcacctcctctttccctgagactgttaactggaaacgctgccgtggaccccactatgggagctccatttcatgtggccactttcaaagttccgcaaactgtgctccacttcagcagccactagatgcacacggctctttgaatttaaatgagtggccaggcatggtggcgtacacctttaatcccagcactttgggaggctgaggtgggaggattgcttgagcctaggagttcaagatcagcctgagcagtatagcaagagcccatctctaaaaataaatgtgcaaattaacttaaatgaattaaaacagagtaaaattaaaactcctcctttgtacatgccacatttcaagtgctcgggagccacaggtgcctagtggtagtacacaggatagctggtgcagactgccccccccgcccattgcagacagctcacagctgcgactccctttgaacttgactcccctcacctcccctcatgccgccttttacacggagccctgtcttggaccacttttttcctttttttgtttttttgagacagggtctcgctgtatcgtccaggctggagtgtagtggcgcaatcatagctcactgcaccctcaacctccctgtgctcaagggatcctctcacctcagcctccaagtagctgggactacaggcatgtaccaccacacccagctaatttgtgtgtttttctgtaaagacagagtttcaccacgttgcccaggctggtcttgaactcctaggctcaagtgatcctctgccttttgggctgggattatatgcgtcagccaccgctcctggcctacttactattttcttttctttcttttttttttttttttttttcggagatggagtctcactctgtcaccctggctggagtgcaatggcgtgatctcagccctctgcagcctccacctcctgggttcaagcgattctcctgcctcagtgtcctaagtagctgggactataggcacccactaccatgcctggctgatttttgtatttttagtagagatggggtttcaccttgttggccaggctggtctcgaactcctgacctcaagtgatccacctgcttcagcctaccaaagtgctgggattacagatgtgagccactatgcctggtctcttttttcctttttaacatattatttgcctgtttgcaatcttacaggtaatctaaaattacttattttctccataagagagaactttttcttgaatactttaaactccccttaatccctcccctccaccccattcccccctgctcccctccctcgaccgtggttatgagtttgagtgtcccctggagcctgctttgggaaatgcttgctttctgccacagaggtaagcagcacttgtcagagcctgtttgtcatccgtttaactgggcagtaaaattagaatgaaccgtctgaaatcactgatacacagctctttatggttcagccaaattatactgaccctacagtaacagctaatagctattccattcacaatttgaataaaaagagccaccaggcctcatgtgccctgcaccttgcaaagctcttcatgtggctcgttttgttaattctcacagcatccctttgaaggcagagcatttcagaaccacaggggcaaccccttagtgagcagtgaaataaagccagtaggtcctgtttttaatgcatgggaagagaagagaaaatgggatagtgtaaatcttaccttgtgaaggtggtgttgcacagatgtgtccctatggtgtagtttttggattgtctgcaaagtgcaaaggccactgttgtaaggaaggcaggtacagtagtcctattctacaggggaggacattgagatctatgaggcagagcggtgctctagagcctcgtgggtaacggcatagtgtggccaggtgtgtagggaatgaggatgcagttacctgtggtggctgttactgccgagtggaaggcaggtagcctggggagggctccctgcaagggttggtggtgccagaagcggtgacggtcccctcctgtctccaccccaggcctcgctgaccccggtgaagtcgggcgagcacaaggacgaggacaggccgaagcccaaggaccgcatcgcctcgtgcctgctggagtcatggggcaagggcgagggcctgggctacgagggcctgggcctgggcattgggctgcgtggggccattcgcctgccctccttcaaggtcaagaggaaggagccaccagacaccacctcatctggcgaccagaagcggctgcggccctcgacctctgtggatgaggaagatgaaggttcgtgctctgggtgctggggtccccttcttccgcatccccccagcccagctctgactccctcccttcctgcagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattgtcggcgtcctcgtcctcatccgcgtcatcatcctcggggtcctcaaccacctcaccctcgtcctcggcctccgacaaggaggaggaacaggagagcaccgaggaggaagaggaggcggaggaggaggaggaggaggaagtccccaggagccagctctcctcctcctcaacctcatccacatcagataaggtgcctagcaggccaggaagcctcagggggccgggccaggcgacgagggccagacccttcggctcacctgtccccactcttccttctcccccaggatgacgacgatgacgacagtgatgaccgggacgagtctgagaacgatgacgaggacacagccctgtcagaggcgagtgagaaggacgaaggggactcggatgaaggtgagcagggaggccgtggctgcctggccctcccggagtccctctttccccggggcagagcctgagcaattgtcagaaatacttctgagccaaaatgttgtgcttttgagacgttaccttgttaaaacacacacacagggtggcgtacggttccatcttcagggagtgccgtgaacataatggcatgtccatagaaatagaaagcaggtctgtggtccttagggctggggagcccggtgttcaggggggcttgctcagcctacatggcttccttttcaactgataaaaatacttagggaccagatcgaggtggtggttgtgcaacattacaaatgtactaaatgctgctggaattatcactttgtaacgagcagttggccggacgcagtggcttacacctgtaatcccagcactttgagaggcctaggcgagtggatcacctgaggttaggagttcgagaccagcctggccaacatggtgaaaccccgtctctactaaaaatgcaaaaaatagccaggcgtggtggtgggcacctgtaatcccagctacttgggaggctgaggcaggagaattgcttgaatccaggaggcagaggttgcagtgagctgagatcatgccactgcactccagcctgggtgacagagtgacactccacctcaaaaaaaataataaataaaattttttttacaaagtgagcagtttttggctgggcgcagtggctcacgcctgtaatcccagcactttgggaggccaaggcaagtggatcacgaggtcaacagatcgagaccatcctggctaacacggtgaaaccccgtctctaataaaaatacaaaaaattagccgggcatggtggcaggtgcctgtagtcctagctactcaggaggctgaggcaggagaatggcgtgaacccaggaggcggagcttgcagtgagccgggatcgccccactgcactccaccctgggcgacagagcgagactccgtctcaaaaaaaaaaaaaaaaagtgagcagttttctgttatgttaattttacctcagtttttaaaagcgactactagcggccgggtgtggtggctcactcctttaatcccagcactttgggaggctgaggcaagtggatcacctgaggtcaggagtttgaaaccagcctggctaacatggtgaaaccctgtctctactaaaagtacaaaattagccgggcgtggtggtgcatgcctgtaatcccagctacttgggaggctgaggcaggagaatcgcttgaacccaggaagtggaggttgcagtgagccgagatcgtgccactgcactccagtctgggcaacaagagcaaaactcaaaaaaaagaaaaaaaagactcctagtgaacacatgccccacacacatatctgagggccgtgttcagcctgggtgccaccagtttgaggccattggtgaggggtctggtgggggctggggcacagcgggtcctcaggcagcccctcgtctgtgtcccccatccagaggagacagtgagcattgtaacctccaaggccgaagccacgtcgtccagtgagagttccgagtcttctgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccaggtaacacctgcaaccccctgggagggtggtgggagggaggcaggaagtcctcactgtcagaatcagcccgggcttcctggggtagatcgctgaccgtccccagcctcagtttcccgtgtaaaacgagatcagccggttgtgcctccctcgagcgagatgaggtgttgggtgccagcactgagcctggcactgcatggatcaacccaaaggggaacgactgctatttttcagtcctcactgccagcgtttccctggtggcttggtccttggaccatcagtcccatgagatgctccccaaaaggaggatgggtgtccatggtcacttgagtgacaagtcggtggggtaggccctggggtgctgggccaggtgagggctgcaggcattgccccctccggcatcgtgatgctgctgcacagagcatatgagaactctaactgcatggccagtagaactttccacagtgatggcagcgttctcaggctgtgctgtccagcactgtagccttcagacacaatgttgctaccaaactcttgaaacgtggccagtggcacagtggaactgaatttataatagtgttcaatttattttggcttacatagatagctgcatgtggttagcacctacctctttttttatttttatttttattttttttgagacatagtcccgctctgtcacccaggctggagtgcagtggcacgatctcggctcaccgcaagctccgcctcccaggttcacgccattctcctgcctcagcctccagagtagctgggactacaggcactcgccaccacacccgactaattttttgtatttttagtagagatggggtttctccgcgttagccaggatggtctcgatctcctgacctcatgatccacccacctcggcctcccaaagtgctgggattacaggcgtgagccaccatgcccggtcctagcacctacctttaataagtccttcaggaaaggattacagctgcccctgtacattgaacacatggctagggcccacggacatgcagttttcaaccaaatatggacggaaaagaccggtgggatgcgaaacccactgtatatggagggcgatcgcctatacgtgggttctgcaaggcagactacaagctttgagtatgtgcagatttaggtataccagggagtgttagaaccaattctctgtgtgtattgagggacgactgtgttttgtttaatgtaatgtattttgttttgtttattccaccattaaccacagtctttgaacattgactcaatactaagcctctattgtgtccctgctattattttaggcagtagcaatgcaacagtggaccaaacagacaaaaatatctgctcccacggagcaggggaacagatgacaacagatcaattagaaaatgaaaaacaggtggcaggctcctgtaatcccagctacttgggaggctgaggcaggagaattgcttgaacccgggtggcagaggttgcagcgagccgagatcgtgccacactgcactccagcctgggcgatagagtgagactgtcttaaaaaaaaaaaaaaagaaagaaaaagaaatgtgccgggcgcggtggctcacacctgtaatcccagcactgtgggaagccgaggtaggcagatcaactgaggtcaggagtttgagaccagccaggccagcatgacgaaaccccatctctactaaaagtacaaaaaattagcagggcgtggtggcacgtgcctgtaatcccagcggcttgggaggctgaggaaggagaattgcttgaacctgggaggaggaggttgcagtgagctgagattgtgccattgcactccagcctgggtgacagagtgagactgtctcgaaaaaataaaaataaaataatgtaaaaatagaaaatgaaaaagatgtattctgtggtcgggcatggtggctcacatctgtaattccagcactttgggaggccaaggctggcggatcacttgaggccaggagttcaagaccagcctaggcaacatagagcccatctctacaaaacatttaaagattagctgggcgtggtggcacattcctgtagtcccacctactcaggagccttaggcaggaggatcccttgagccctggcggtctaggctgcagtgaccgtgatcatgccactgcattccacccgtctcaaaaataaaaaaataagtaaattcattaaaaaattaagaagtgtatcctgtgacagtggagataagtgctaggaaaaaaatccttgaaggctccgacaagtcctgcagaaaagagacttgttgaattttattcagtcatagagcagattttcttgggccacagggactttgttctgaagacgtagtatgaaaggctggaatacatgtctcctgcatctgtgatttagcctagcaacattgataaagcacatactgtgtgcctgacactgggttgggcgctgaggagtccttgaggggtttagctggagaaggacaggtcccgtgctcagactcagggctgtgagcctgccaggtatggagcacaaaataaggcactgagagacgtttggattgaatagtaaatgtctcgtgttcgctcacctctctgcagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctatatcctgctggcatggggggctctgcaccttctgggatgcaggaagtccctgctcacctctctgggccccaccacccagtctgtagcagcccgcggtgcccatgaaggtgacagcatgcaccaccgtcacttcccaagcagggtttgtgtcccggcaccatgccaggctcccgagtgaatcattggcacgttttaaggactccctctgcgccaggcccatctcacccccagagttagcaggtctcagggtcacatgtaacagcagtgccgtgcagcttaacagcacacacgggcgcagggcctccttgtcctgtccccttcataacctcaggtaatcccggtagcctggtgaagatgggggctatgattcccattttacatatgaagaagctaaggctcagagaggttcagtgacctgtccaaagacacagctacaggtggcagagttgagatttgaacccaggcaaacctggctctagagtccaggctcttcaccaccaggctttcatgaggcttggctgttcacataggccagtgaggctagacctctcattatccctgctgtattagactgatttgtgagcactcagtttgtgtcaagagctctgctcaagtgccgggcaccatggctcacagctgtaatcccagcactatgggaggctgaggcggacggatcactcgaggccagaagtttgagaccagcctggccaacatggcaaaaccccatttctactaaaaatacaaaaattagccgggtgtggtagcacatgcctataattccagctactctggaggctgaggcaggagaattgcttgaacccgggaggcacaggttgtagtgagccaagatcgcaccactgcactccagcctgggtgacagaacaagactctgtctcaaaaaaaaaaaaaaactctgctaaggaccataagcatatttcatcacttgcagagaggcatcactgtcaccccaatttacagatgggaaactgagcagaaagttgttaaaacacccagcactttgggaggccgaggtggatggatcacttgatctctggaggttgaagccagcctgggaaacatagcaaaaccccatctctacaaaaaaaatccagaaattagttgggtgtggtggcgcacgcctgtagccccagctgctcagaaggctgaggctgcagtaagctgagattgcaccactgcactcgagcctgggcaacaggagaccctgtctcaaaaaaaaaaaaaaaaaaaaagacacctagagccatgcaactaggtattgaccgtcagcagggttggtcagcgggcagccacgtggaggtggcatgggagtgggcagtagaactggacatcgctgtccctgaagggtggtctgaggatgggcgggaccagtctatgaagggaccagaaggggctctcagaatgtccatgtggcccttgacccacacccacccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccaggtactgccagggctcctggacacatcagagcctgctgggctgggccacggggatccagggcactcatggaggggtgccaggcagagggaggagttgtgaggccagaggggctggcacacagagggtgcaagtggaaggggagaggcgggtgggcggggcctaggagaaggaaggagtttgccttagtcccatgggccctggagcacctccaaagggtttaattagggatgtgacggagctgtatttccgcaagttcattcattttttgttttttgcttgggttttttttttagggggggacaaagccttgctctgtcacataggctgaagtgcagtggcacagtctcagctcactgcaacctctgcctcctgggttcaaatgattctcctgcctcagcctcctgagtagctgggattacaggtgcccaccaccatgcctggctaattttttgtatttttagtagagatggggttttgccatgttggccaggttggtctcgaactcctgacctcaagtaattcgcctgccttggtctcccaaactgctgggattataagcataagccacatcgcatggcctcattcattctttttttaatccagtaaatatctgttgagtacatgctgtgtaccgggcactgttctgggtctatagcagtgaacaaaaccaaatcctattcctcgtggaatttaattatttatttttatttttaaattaaaaaaaaattgagacggggtctcactctgtagcccaagctgatctggaactcctgggctcaagcgatcctcccgtctcagcctcccaaagtgttgagattataggtgtgagccacggtacccagctggaatttatattttaatggggactcataggaaataatcaagtgaagaaagaagcacgtaattccaggcagggaaaatgcgatggagaaaacaggagaggggttagggattaccaagtcaaaggggagtcagagagggtcagacccaggcgaagtgtgggaaggcgccatgtggatgccagagagactacagagaagtgaaaaagcgacttccataaaaagttaaaaccagagaggggctcactgaccccagcaggcctccctaggacagcagcagtgcaaaggccctgaggcagcagggagctccatggtgtgaggaagggaagggagaggccacttgtgggagagacagcacaggccaccagggtcgggggtactgtggtggtaagtgacctgtctcctggggtgacaggcagcagagggaggttgtgagaggagctggggtggtgtggagctggtgcaggggtcctgagggcagactgttcgggttgctgcggtttccagaccggatgtgccggacttagctgggccgcgaggagccattagctgtggaagaatatgaggaagtgggatggacaggaccagggctggcctgggtacaggagacagggatgggcggggggtgacagcccagggtgtggctggggtcgggggtgctgggaagctggacaccaggcctgagatggggaggctgatatgctatcaccacgaggcagcttgagttctgcgggttctgaaaacacccaggcagagaggtcttggtgggcatgtgggtatggcggagcttaggatggggatctccggcccggggacctaagtgtaggcatcgccaggagagaagtggtgactgaaggtcacagcagggtgacctcacctgggagggcacttggggcagaggcctgggatgctccaaaggttaatggctggggcagaggcccagggaggccaagagcaggacgtgacacaagggtttcggaaggatccccgattttgaacgcttgtggggtgagaggggtctgggtgagagccaaggagggggtcagggtagacaaaactttcggctgaaatggggaaaagacagcgccaggcaagagtgagtctcgtcgttttgaagatagaaggagcttgagacgctcagatactgatgggatggaggaggcagggaagcggtgacaattagggaccgacaggtgtggagaagcccagagcaaggagcccaggacactggggatgacagagatccagagcctagggtgggaccgccgaggacacggccagctccgctgagccccgcacaccgtccactgcagggcatgagcatcccagcacagccccacgcctccacccgggcaggctcggagcggcgttcggagcagcgccgcctgctgtcctccttcactggcagctgtgacagtgacctgctcaagttcaaccagctcaaggtgaggccgggcttcacccagatcgccggggtggcggcaggacctgagaccggggctcacctctccccctcttccctcccacagttccggaagaaaaagctcaagttctgcaagagccacattcacgactggggcttgttcgccatggagcccatcgcggctgacgagatggtcatcgagtacgtgggccagaatatccgtcaggtaggcaccgcccggcaggatgggcaccggggtgggcatggggccggcccagccagactgacccccttttgtggccaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaacgtgagtgcccagcggggggtggcccctgcccctgctcctgcccctggccctgcttctgtgccaggagggcctggaagccccggcacgggaatcagctcggcctccttcccaagctcaggttggccaagggttatagggagaggaggacatgtgaggtcttttaccaggagctctactcctctgagcctcagtttctcatctgtcaaatgggcatagtgagacttctgtggcatttagaggactcaaagaagtggttggttcagttcattggtaatttcggagttatttctctgcgttagccttttctccgtgccttcattggtcaggctcagtcctgctcgggccgagctgtccactagaactttctgcaagggggaggtgcactgcgtgcatctgtgctgtgggttagccacatgtgtggtggtgagcactggaaatgtgcccagtgcatctggggacctgagttttaaattttatttcattttgatgaatttaaacttaattagcttgtgacgactgtattgggtggtgcaggcctagaggggagggacactgataacagggatttgagtgctgaaggaagagcacaggaagctctgagcaggaggcaggcatgttccggggtggatgcccctgactttgggttcaagtcttggcattgcagcttagtgagttacttaatgtctcttatgcctgagtttccttgtctgtaaaacagagacaataacagtctctccttttaggttgttgggagggccacataggtgggtcactgcacgtgggccatttgagtgctggccaggccagtcctcagcgcctgctggctctcttcgttgtgacttgatccttgcctgggtggtagggactttcctgtgaatatccggggagatctgaggggtgagagggaattgcccaggggaagcggtgctggggcaaggggaactgcgtgttcaaaggccctggggcagttgggagaacacctgtttgagagatagcaagggaggcagtgggcatggggtggggtaagaggatggggtgggcagggctgagggtggccaagctgaggaactaagtttctctgagagccaaggtcgctggaaggttggagccatcgggcaacaggttctgctatccctttggaaacgtttccctggctgctggggcaggagtggattttttcaggggtgagagtggccaagggggctgtagcaggcgggtgagcagtgatgggggcctgagcgtggctggtggccccagaagtggagagcagtagacacaaccaagaggcccttccgggactgaactcaccggccctggttggggccagatctggactgaaggaggcagggaggcagatgctctggggcctgggtgtgtggtgcagcggctgcccagagcaggagcagatcatgctttaggtgtgagctaagtcaaagacagtacccagggctgccactggcagacagcaggtagttgcatttatgggcttggaggcctttaccttttctgtaaagggccagataataaatgtttttggcttggtggctcagatgatctctatggcaactactgaacttggctattgtaacaaaagcagccacaaattatatgcaaatgaatgggagaatggatatggctatgtgccagtaaaactttatttacaaaaacaggctgctaggggctatagtttgctgaccctttttttagagctcagaagtgagacctgagctaaaaatagacatacatttgggaggcacttgtactacgaatggaaatgaaaggcctgggaaataatttttatcatcattatttaatatcagaggcaaggggtcacccctgggggtcgggggagccaaggtccagagcagagcagtgggctgggggtcacgtggcatgtcaggccttaagcacaggcctggttgggtttggggggtctgcagtggtgggggaccctgggggaccaggggctcattctcccccccaccttgcctgcagcccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactaggccccggcaccagactcaaaggatgtcagccgtagccctgggactcccgagcgtggagcccctggccccggggcccggccccccgcgcccgcccccatttcaggtgctgtcctctacccagcggccattcagggcctggcgccccacactaccccctggagcccctggctccggcccctccgcgggaaagggcttctctgtcgttcagcccacgtctctctcattttaacaaacgcccctttcaggatttctgtttaactccagcatcagcttctctctctccgtctctcctcccctctctctcttctctgtctcttctctctcccaccatcaccctcggcctcttcctgtgaatgctgctacgttgttttgtcttctctatttttttcctcgttgtgagaaaagacatttaaccgttgaaatgtgaaggtggaatcagagaggggccccgcgggggtctgcagaggcctcagtgtggctgtgcgtggcccgtgtcctggaagccacccggacctggacgcagggccaggtgctgtgggaaggatggaggcccccacggccttgacctcagaacactacgccctgaaagcgcccctcactgcccgtgggcacagtgaggagaccccacacctttccccacccgagctgcagcctgttccttccccagaggcctggggcaccactgacccggtggaccctgatggagctaagctgtcccaggcaggggtctccgctctgggctttccctgccacctcacaccccagcaccccctaaaccttgggttcaatgtttactttctcattcggatgccagcaacgcgggagcctctcggaggccccagtgcaggtgaggggcgctgagaacgcgggcagccactctcttctgcccttgccttcgccctgggtgggacagggctcccaagggcaggcgggtcccccagtcccgccattacgggttgtcagaccgtctgcgtgtggcattttttggcttataagcttcacccactcacccccaacccacaccccacatccccctgccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataatcaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagcaaaccataaatatactgacttttcttacagatacgccgtctctcttgctctcctctctccctctcctctttattctttctttctgttgggagcacatcctgcttctgtggagggtggagtggtccactcagacactcagatcagcaggggtttttttgtttgtttttgagacagggtctcactctgtcacctcaggctggagtgcagtggtgcaatcatggctcactgcagccttgacttcctgggctcaagtgatcctcccacctcagcctcctgagtagctgggactacaggagcacaccaccatgcccagctaatttttaagaaatttttctgtagagacggggtctccctatgttgcccaggctggtttcaaactcctgggctcaagcaatcctcccacctcagcctcccaaagtagtgggattacagatgtgagccaccgtgcccagcctgaacttgtaggtgggttttgtgaaatgggccaaattatagtcaccactagaccttccacagcttttaagtgtgatttctagatttttttcttaaaacctcaggtttctgactcatgaggtctgcaatgaaggaaataagatcaggtatccttttactatcactagaagaacgtaggtggttcctcagaaatgtttaacacttaaggagatgcccccctggtctgcatttgagggaggaaaaagggctgataaaatagtagaagttgagaagaattaaatctatcctgtattcatggcatttcagagatgctgtgccccagtcagtctcagctctgcttgacccagtagacgggtgataaagggcttatagttggcgtccacggtaaatgtctccaagaagacgtaaaaccttagcaaaaagcaatatgcctgaaaagacgctgtacgtcacttcctactggagaaatgtgaattatcccaggatgccgtttccccctgtcaggttggcaaatattaaaaggtggaggaaacccaatttgagggagcaggaggctggggtactctcgtgtgtcattaggggaagccaaaaatcactgcaacctttaggaggaaaaatacctattagtaatcattatttaaaatgcacacggccggcacggtggctcacgcctgtgatcccagcactttgggaggcctaggagggcagatcacctgaggtcaggagttcgagctagcctagccaacatggtaaaaccccatctctattaaaaatacaaaaaaattagccgagtgtggtggtgcacgcctgtaatcccagatacttgggaggctgaggtgggagaatcgcttgaacccagaaggtggaggttgcagggagccgagatcatgccactgcactccagcctgggcgacagagtgagacctcgtctcaaaataaaatgatcaaatgcacacaaaagtcttggctccgttgttccactgtgaggaattgagcctgacagatacagtgggcaacaatatgaagaagagtgttcttcgcagcctcatttctggtatcaacgaaacgaagggagagtaaattgtccgttcacagtgggctgcttttaggaattgtgcatccagacaggtggacactcccgtaagtggattcatgggaatagagggctgaggtccgggctgagccaggaaagagaaggaagtgtctggccattaattcaatcaaccaatatttattgagcaccttgtatgtgccaggtactcttctaggctctggggataggaatgaaggaaacatactgttcttgagggcgagccagacaaatgtgaaaagtaagtgcaatagtaaggaggaataaagctaagagaagggggtgtagctgaaggaatatacaattttacctttattatttattttagagacaaggtctagttctgtcacccaggctggagtgcagtggcatgatcatagctcactgcagcctcgatctgctgagctcaatgatccccccacttcaacctcctaagctgatcagggccataggcacactttaccataccagctaattttaaaaatttcttttctttttttttttcttgagacagagttttgctcttgttgcccaggctagagtgcaatggtacaatctcggctcactgcaacctccacctgccgagttcaagcaattctcctgcctcagcttcctgagtagggattacagggattactaggattacaggcatgtgccaccaagcccagctaattttgtatttttagtagagatgggatttctccatgttaagcatgctggtctcgaactcctgacctcaggggatgtgccctcctcggcctcccaaagtgctgggattataggtgtaagccaccgcgccagggctttttctttctttcttttctttctttctttctttctttctttctttctttctttcttttttctttttttttctttttttttttttttgttgttgttgttgttgagacagagtcttgctctgtcacccaggcttgagtgcagtggtgcaatcttggctcactgcaacttctgccttctgggttcaagccattctcccacctcagcctcccgggtagctgggactacgggcatgtgccaccatgcccggctaagttttttgtatttttagtagagatggagtttcaccatgctggccaggctggtctccaactcctgacctcaagtgatccgcccgccttggcctcccaaagtgctgggattctagacatgagccaccgtgcccggcctttttttctttctttttttttttttttgaggcagtctctctctgttgcccaggctggagtgcaatggtatggtctcggctcactgcaacctctgcctcccaggttcccaggttcaagggattctcatgcctcagcctcctgagtagctgggactatagctgcgcaccaccatacccagctagtttttttattattagaagagacgaaaccctatctctattttttattttatttattttattgagacagagtctcactctgtcgcccaggctggagtgcagtggcgcaatctcggttactgcaacctccgcctcctgggttcaggatattctcctgcctcagcctcctgagtagctgggattacaggcatgtgccatcatgcccggctaatgtttgtatttttagtagagacggggtttcaccatgttggccaggctggtctcaaatgcctaacctcaagtaatcttcccgcctcagcctttcaaagtgctgggattacaggtgtgagccacctgtatccggccaatttttaaatttttatagaaatagggtctcactatgtttcccaagctggtcttgaactcctgggctcaagcaatcctctggcctcggcctcccaaagtgccaggattataggtacgagccactgcgcctgtcttcatcttctctcttgaacttgctctcctgtcatattttctactttggtcaatgacacttctgttctctgcctccacccaccgctgcctgccactgaccacctaagctcaaaggccagggatcctggatttaaaccttctctttccctcccttacctaccaaatctgatgcttcttccctattcctcaaatccatccacctcttcctctgctcctcagtcccaagagataactcctttcttcattgcctctattgtattgtgggggccaaaatgggagcccctctccagcttctcaggaggctgaggcaggagaaaggatcacttgaggccaggagtttgaggccagcctgggaaacatggagaaaccctgtctctactaaaaatacaaaaattagccaggcgtggtggcatatgcctatggtcccagctattagggaggctgaggtaggaggatcgctgaaactggggagatcaaggctgcagtgaactgtgatcatgccactgctctccagccttggtgacagagacctcagacagagagagggaggtcccagacagacttgggttcccttgtgggcaagagcccctccccccaaaataagactattcatatagcattgactgtgccagcctctgttttaaacgtctttgatactagcaacagggctaggaggagggtattattataattcccacttaacataggaaactgaagcactgagaggtcaagtagcttgccataggtcacacagctaccacgtggctatctgagaggtgaactcaggcagcctggctctctagtatgttctcagctagtgggtgtctgctctgcatgctttatttatttatttatgtatttatgagatggagtttcgctctttttgcccaggctggagtgcagtggtgcgatctcactgcaacctctgcctcctgggttcgagtgattctcctgcctcagcctcccgagtagctgggattacaggtgcgcaccaccaggcccagctaattttgtatttttaatagagatggggtttcaccatgttggccaggctggtcttgaactcccgacctcaggtgatccacccaccttgacctcccaatatttatttttgagatggagtctcactctgccacccaggctagagtgcagaggcgtgatctcggctcactgcaagctccacttcccaggttcaaaggattctcctgcctcagcctcccgagtagctgggattacaggcaccctcctccattcccggctaatttttgtatttttagtagaggcgaggtttcaccctgttgggcaggctggtctctaactcctgacctcaagtgatccacctgcctcagcctcccaaagtgctgggattacaggcatgagctaccgcacctggccatatgtgcccaactttctaaaatgttgactcaaatttgtttgaaaccatgcaggcaaaacgaagtaggtctatgagccacatttggtctgtaagccactagtttgcatccttctgggttatacaatttcccttcttcacattaagtcacaggagaatagagggggagtattttttttgcacggaatcctttgggttctctctgatctctttatttctgaagttcgtgatcccagaagctctgatttcttctataatctgaaaaaaatccccaattcccaccattataccaactcagagtatttttttcttctattgagctctgctgcctcctagctctgagttgacttatcctcacggagggttctcaagcattagaagcagaaagaggccagagacagtggctcattcctataattccagcactttggaaggctgaggtgggcggatcacctgagaccaggaattcgagactggccaacatagtgagatcccatctccatgaaaaataaaaacaaaattagctgggcgtggtggcacatgcctatagtcccagctacttgggaggctgaggtaggaggatcacctgagctcagaaggtggaggttgcagtaagccaagagcacaccactgcactccagcctgagcaatggagtgagactctgtctaaaaaaaaaaaaaaaagagagaaaaagaaaaaaaaaagaggccaaatttgcccaccaccaactcttacctggttttgaagaaagaatctccttcctagggttttaggacccagctgcctcattcttttgcaaggatcactcactcttctatgagtatgaacaagcccctttccaaaagaagtcctcactgcgggcaaggctggggcagtgcagctgcgtgggtggtcatgggcactgccctgctgagggcagggactgggataccaggcccctcctacctgctttatctctgagaccaggaaccaagggaccatatcctacagttgatgagcagggatgctgcccctagagtcccttgtctaacactctcccctctcctgtgttcagaggtttgggctctgggtagcaaaactgaagacagctcatctttagagatcatcggccgggcgcggtggctcacgcctgtaatcccagcactttgggaggccgagaccatcctggctaacaaggtgaaactccgtctctgctaaaaatacaaaaaattagccgggcgtggtggcgggcgcctgtagtcccagctactcgggaggctgaggcaggagaatggcgtgaacccgggaggcggagcttgcagtgagccgagatcgcaccactgcactccagcctgggggacagagcgaaactccgtctcaacaacaacaaaaagagatcatcaagccggcagacaagatgctgccaaactctgaccccacctcagggcctttctccgttcgctcttcctggaatccttttcccgagcatggtcccatggctggctcccaaatgtcaccttctcggagaggtcttccgttatcaaaattagctcccctgcgatcttcgcttccacatattctcatcaactgccttttttttttttgagacagggtctcactcttgcccaggctggagtgcagtgtcaggatcagggctcgctgcagcttagacctctgtccatcaatcgatcctcccacctcagcctcctgagtagctgggaccacaggtgtgcgccactacgccaggctaatttttatttgttatttgtgtagacgcaggggggtcggggtcttgctatgttaccgggctgggctcgaactcctggcctcaagcgatcctcccacctctgcctcccaaagcgctgaaattacaggtgtgagccaccacgcccggctcatcgcttgctttattgtctgaatcgcgtttatctctctacaaaagcagtgtcatccgtctttccctccagagcaagtccccttccttccctggttccagaattcccctctccgcgtggtcccgctggcaaagcgctggcacccgcagctcctcggtcccgcggcgctggcggccgccctggcctccccctggctgccataaggcactactgccttatgcgcaacacaaacacagacacagtattggaccggggcacgctttaatcgggagggctggagcagagggcggccccgccgaggggcgtggtcagtgtgggcggagccttgggggccgagtccgctggtgggcgggacccaaggggagcagccagtagggaagttgggcgagttccagaatcagggggcgtggctgtgtggctgtggcctccgtggggtgggcggggcttacatgccgggcaccaccccattggtctccatgttggtgaggttaccccgcaggttctgctcctcctcgaaagccttgaacagtgagttgaagttgccggctccaaaaccctgtggcgggaaagagaggagatgagccaaggacccagaaaaccgagtgtgctagctgcctgtcccctcgggcctgccggggacaagcagtacctggtggttgtggcgctggatgacttccaggaagagcgtgggccggtcctgcaccggtttggtgaagatctgcaggaggtagcctttctcgtcgtagtccaccaggattttcagctcctaggcgggagacagggggctctgctaggggaggctggcacggtgagatccttggaaagtccacaggggctcctgcaccccaaaagtctggaaatgacctctttttctggcagttcagccacctccaaatatatccccaaactgtcctattactatccccctactacagttcctaaggcaccattcaagactgctgcccgcttctaatcttgtatccttacaatccatcctccccgcagacattatcaggacactttctttttcttttttgagacggagccttgcgctgttacccaggctggagtgcggtggcgcaatcttggctcactgaaacctccgccttccgggttcaagcgattctcctgtctcagcctcccgagtagctgggactacaggcgcaggctaccatgcccggctaatttttgtatttttagtaagacggggtttcacgatattggtcaggctggtctcgaactcctgacctcaggtgatccacccacctcgacctcccaaagtgttgggattacaggcgtgagccaccatgacctgctgcgggatcttttaaaagtcggatcatgtcattcccctgtttaaaatcctccagtggaaatcggaaccctcatgtactgctggtgggactgtaaaatggtgcaaccactttggaaaacagtctggcagcttctcaaaaagttaaacatatagtgttgcttccttaaaatacggattaaaaaaaaaaaagggggtggccaggcatggtggctcactttgggaggccgaggcaggtggatcacctgagctcagttcgagaccagcctggccaacatggggaaacccagtcactacaaaaaaaaatacaaaaattaggctgggcaaggtggctcacgcctgtaatcccagcactctgggaggctgaggtgagtgaatcacccgaggtcaggagttcgagaccagcctggccaacatggtgaaaccccatctctactaaaaataaaaataaaaataaattggctgggcatggtggcacacgcctgttatcccagctactcaggaggcagaggcaggagaatcgcttgaacccgggaagtggaggttgcagtgagccaagatcggccactgctctccagcctgggcaacagagcaagactctgtctcaaaaaaaaaaaaaaaaaaattagctgggcgtggtggcgggcgcctataatcccagctactggggaggctgaggcaggagaattgcttgaacccaggaggctggaggttgcaatgggccaagatcgcaccactgcaccccagcctgggaaacaaagcaagactccatctctaaacaaacaaaagggaacatggaattaccatgtgacctagctactcctagatatattccaaagtgcattgaaaacacgtccacacagagccttgtacatagatgttcacagtagcattacgtataacaccccaaaagtggaaacaacccaaatatctatcaacgaggaatagataaacaatgtgtgtctatctatacaatgggatatttttcagccacaaaaaggaacgaagcactgacacacaccccacgcagatgaaccttgagcacatgctatgggaaagaagctgctcacaataggcctattttgtgattcctttttttttttttccgagatggagtttcactctgtcgcccaggctggagtgcaatggcgcgatctcggctcactgcaacctccccttccctgggttcaagcaattctccggcctcaggctccccagtagctgggattacaggcatctgctatcacacccagctaatttttgtatttttagtagagacagggtttcaccatgttggccaggctggtcttgaactcctgacctcatgatccgcccacctcagcctcccaaagtgctgggattacaggcatgagccaccgtgcctggactttgtgattccttttgatgaaatgtccagaataggcaaatctatagagactgaaggtagattaatggtgcctagggctggggtgggaggggggaagggaacagagggggttgggaggtgctggctaagaggctcaaggtttctttttggggtgacaaaaatgttctaaaattgattttttgcccaggctggaatgcagtagcctgatcatggctcactgcagctttgacctcctggcctcaagtgatcctctcacctcagcctcctgagtagctgggactacaggcacgaaccaccatgcccagctaattttttaaaactgttttttttgtagatacagggtcgccctgtgtttctcaggctggtcttaaactcctggcctcaagcaatcctctcacttcaacctcccaaaatgctgggattataggtgtgagccactgtgtctggcctaactgtttttgtttttcttttagacagggtatcacccaggctggagtgcagtggcctgatgatggctcactgtagcctctacctcctgggttgaagtgattctcccacttcagcctccccagtagctgggaccacagacacagatcaccacgcacagctaatttttttttttctttttgtagagatgggggtttcgccatattgaccaggctggtctcaaactcctgacctcaagtgatccacctgccttggcctcccaaagtgctgggattacaggcatgaaccaccatacctagtcctaaaatggatcttttttttttttttttttttttttgagacagagtctcactgtgtcgcccaggctggaatgtagtagcgcaatctcggctcactgcaacctccgcctcccgggttcaagtgattctcctgcctcagcctcctgagtagctgggattacaggcatgtgtcaccacgcctggctaatttttgtatttttagtagaggcagggtttcaccatgttggtcaggctggtctcgaactcctgacctcatgatccgcccgcctcggcctcccaaagtactgagattacaagcatgaaccaccacacccagtcctaaaatggattttgatgatagttgcacaacatagcaaatagctagaaatcatagaattgtacaccttaaaaaaatgacatgttatgtgacatatgtcaataacactgctaaaaccaaaccaaaaaaccctccagtggtttctggtcacaaaagaacaaaatccagattcctgaataatagctcacaagaggaactggctcttgcttacctgtctgacctaggtcatcgctcaaaaacagcctcccatccactctagcctattctttctgttcctcagacgctcagggcatgctcctacctcggcccttgctgatccctctgccaggaatgcctttcttcccgctgttcacatggccagctcccgctcatgatctagacttcactcagatgtcacctcctcagagaggccctccctgaccagtctctgtaaagcagccccaggctgcctgtttgaacttcctgcactgactatctctgaccgtgcttttattgtttatttgtttgtcatctgtctcctcctcccacatagaccctagaataaatgtcctttgccagcagggacttggtctgggctcccctccgggctgagacaatatttctgaaaagatgcaatgcagagctcatactccccccacaaggctgcggatcctgcctgggcctcacctccagggcatcaatgttctccttcaccttgatcttggccgtcttcagcttctcccgcagttgtttgtagtacgtggagggaacagataagaactccaggcctctctctctcaagtggcgaatctgtttcagagcaaagctgaggtcagccttcggcctccaagttcaactcccctagccaggtggaggtgctgggtcatcaggatacagggtccctatcctagctcccctcaactgccaggatgctgtgtggcctcttcccctttcttctctgtcatgggccccgttagaacaacaactgctagatttatagaacactcaccatgtgcctgccttgagcactttctttttttctttttttttgagatggagtctctgttgcccaggctggagtgcagtggcacgatcttagctcactgcaacctctgcctcccggttcaagcgattctcctgcttcagcctcctgagtagctgggattacaggtgactaccatcacactcagctatgtatttttagtagagatggggtttcaccatgttagccaggttggtctcgaactcctgacctcaggcgatccacctacctcggcctcccaaagtgctgggattacaggcgtgagccactgagcccggcctgagcactttctacgtattccctcattatgtccatgcagcaatcttttgaggcagctgaaggactattctcccatttcatagctggggaaactgaggcatgaaacgattaaggatctattaggccgagtgtggtggctcacgcctgtaagcccagcacttttggaggctgaggcgggcagatcacttgaagtcaggagttggagaccagcctgaccaacatggcaaaatcctgtctctattaaaaatacaaaaaaaaggccgggcgaggtggctcacgcctgtaatcccagcacattgggaggccaagatgggtgatcacgaggttaggagatcaagaccatcctggctaacacagtgaaacccctactaaaaatacaaaaaaaaaattagctgggcgtggtggtgggagcgtgtagtcccagctacttgggaggctgaggcaggagaatggcgtaaacccgggaggcagagcttgcagtgagccgagatcgcgtcactgcaatctagcctgagcaacagagcgagactctgtctcaaaataaaataaaataaataaaaaataaaaaataaaaataaaatacaaaaaaagttatccaggcgtggtgtcatgcacctgtaatcccagctacttgggaggctgaggcaggagaatcgcttgaacccaggaggtggaggttgcagtgagccaaaatcgcaccactgcactccagcctagaagacagagcaagactgcatctcaaaaaagaaggatatatatatatatacacacacatatatatatttgagagacagggtctttgttctgtcacccaggctgcagtgcagtggcatgatcttagctcactgcagcctcaacctccccaggctcagctgatcctcctacttcagacttctgggtaactagaaccacaggtgtgcaccaccacacctggctaattttttgatttttttgtaaagatgaggtcttatggccgggcgcagtggctcacacctgtaatcccagcactttgggaggccaaggtgggcagatcacaagatcaggagatcgagaccatcctggctaacacagtgaaaccccgtctctactaaaaatacaaaaaaaaacattagctgggcgtggtggcgggtgcctgtagtcccagctacttgggaggctgaggcaggagaatggcgtgaacccaggaggcggagcttgcagtgagccgagatcgcgccactgcactccagcctgggcgacagagccaggctccgtctcaaaaaaaaaaaaaaaaaaaaggatgaggtcttactatgttgcccacgttggtcttgaacttctgagctcaagcagtcctcctgcctcggcctcccacagtgtctgaccccccaatttaaatgtgcaatgccattcacccttgctgtcccaattccctgctttactttcttcctgggtgctctctaccatctagcatttatattttacttattttgtttattgctccacaagggcagaaactgttataggcatgagccaccatgcccaaccttaatttcctcattttaaaaaaaatttcttttttgaggttgcggggagatagggcctcactctctgtcacctaggctggagaaaagtggctcaatcatagctaactgcagccttgaaatccttggctaaatggatcctcctgcttcagcctcccaagtagctaggactacaggcatgaaccaccaagcctggttaattttgtttactttttgcagagacagggtcccactgttttccaggctgatctctaacttatgggctcaaacaatccttctgctttggcctcccgtgtagttgggactacaggcataagccactgtgcccagtcctaatttcctttattaattactattatttttttctaaagcagaatttcactcttgtcgcccaggctgtggtacagtggtgcgaccttggctcactgcaacctctacctcctgagttcaagcacttctcttgcctcagcctcctgagaagctgggattacaggtgcccgcaaccacgcccagataatttttgtatttttagtagagatggggtttcaccatgttggccaggctggtctcaaactcctgacctcaggtgatccccctgccttggccacccaaagtgctgggattacaggtgtgagccactgtgcccggccctaatttcctgatttttaaggtaaggcaactaaagtccagagacagcactgaatctcccagagacacagagcaagccactggcagaaccgggaccatcacccaggcttcctgataccctggcgcctgctacctccaaagcccaggggttctgtggagactgaactctctgggggtgggtgtggctgtgcctgcccatgagttgcaagaagcagtgagggagtcctgtcagtctcccagcccagagaaacgggcccaggactgccgccacccgccctctcaattttgcagagatcgtccctggctctgaatgagagaggaattcggacagggaagggggttctaaccgctgtgatgatgtcttcggtcttgagagcgatgtgctggaccccagcgcccccgttatagtccacatattcctgggggagggaaacaaggagaccactgtcatttgccccatcacccacatccctgaccctacaagagcccccagacctcttccctgctcccctctcccccagccaggggcggcctcacctggatctgggacttcttcttgccaggcgctggctcattgatgggcatcttgatggactcttcatagttggccaccacaatggatcgcagagagctatattccgtgtgcacctgcgtgtcatccacggaccagaagcggtggaactgcaggtttttcaggtacctgtagggtgggcggtggaacacatatgctctgagcgcctccagggacggcctccatcacccatttccaccttccagaatctgtccctgagcaggctccagaaaggagatgccactgccatcatacccatcagagatttagatctttttgttgttgttgttgctcgagacagagtctcactcttgcccaggctggagtgcagtggtgcagtcttggctcactgcagcctcaatctccaggctcaattgctcctcccacctcagcttcccaagtagctgggactacaggcatgtgctaccacacctggataattttggggtatttttattttttgttttttgagacggagtttcgctcttttcgcccaggctggaatgcagtgacgcaatctcggctcgctgcagctgccacttcctgggtccaggcgattctcctgcctcagcctcccaagtagctgggattacaggcatgcaccaccatgcccaactaattttttgtatttagtagagacagtgtttcactgtgttggtcaggctggtctcgaactcctaacctcaggtgatccacccgcctcggcctcccaaagtgctgggattacaggcatgagccactgtgcccggccgtattttttgtagagatggggtctcactatgttgcccaggctgtcttgaactcctgggttcaagccatccacctgcctgggcctccaaagtactaagattccaaatatgggccaccacgcccagcctagatttgtacctttatgatgacatttttccttcaggtggaagtgtcttggaacgaaatacatacaggacggcaaggctcccacagatggaagtaaagtgctttgagaaaaaggcccttgcttggaatttggacagggggctctctgggtggtggcaaccttcctccaagcctccctggactgtgatgtccccagggttcctcagaaggagggcctgtgggtcgctttgggcctcaagtccactggtctccatgttgacagttttacagtgaataaatgcatcagtggcctcaggctaactcccaacatcttgtgctgtattttccacttttattttattttactttattattattattattattttgagacaaagtctctctctctcacccaggctggagtgcagtggcgtaatctcagctcactgcaacctccgccttcctggttcaagcgattctcctgtctcagcttcccaagtagctgggattacaggcacacactgccacacccagctaatttttgtatttttagtagagaccggggttcgccatgttggtcaggctggtcttgaactcctgacctcaggtgatccacccgcctccgcctcccaaagtgctgggattacaggcgtgagcaagtgcgcccggtctattttattttatttgtttattggagacaaaatcttgctctgtttcccaggctggagtctcactctgtcgcccaacctccacctcccgggttcaagcgattctcctgcctcagcctcttgagtaactggaattacaggggcccaacacctcgcccactgagtttttatatttttagtagagacggggtttctccatattggtcaggctggtgttgaacccctgacctcaagtgatcctcccacctcggcttcccagaatgctgggattacgggtgtgagccactgcacccagtcgtattttccatgttagtgcaaggaccagggagtgggccagtccaccgtgaggacccgtcatcttcacgcagagggagagggccaaggtctcaccattcggaggcggacaccatctcctgatcaggctggtttcccacaatgtggtcgatcatctccagactgcatttgggcctgggaagggaagaagatgggggtgagaaggtggctaccccccagattgctcccttctccatgacccctcaataataataatagctcacacttctgtttttggagttctatttttttgtagagatggagtctctacaaaaagagagactcttttttttgcccaggttggtctaaaactctggggctcaagtgaacctcctgcttcagactcccaaagtgctgggattataggtatgagccactgcgcctggactcacacttatgtagcatttactaatgggccggacattttattttgtcaactcatttactattacagtccccattttacagatgaagaaactgaggcctagagagatgaagcgacttgcccagggtgaaatggctgtgaagtaacagagctgggatttgaacccggggaagtttggttgcagaggccatggtctcagcctctgtgccacctcttcaagcacccctgaggacttccaggaattccctagccggctccattctgccccaacacacatgcgcagtggacatggaggaaggggcattacttttcacagtccctcagggctttccacccacctctgccctgagggacactcacagtttaggaagtagggggtccatgaacgctggggcctcatatccaggcaagaattggccgatgtagttcatcttctccaccagggtgtgtgtggtgtccccatactacgggtggaaaacagcctggctcggcccctgggcacccatccccgccgaggacagagcacatttcatagcgctaacgtagccccgggttccaacctgcatctgaccctaaccagatgcgtgatcttgggtaagtcacttctcctttctgaaatgaattgcaatctgtcacttgtttgagagtttccgtgagggcggggacactgttttgctcatgatggtgtacccagcgccaagctcagtgcctggcacaggggaggtactcaatgaagcacctacttcatttatttcagtaggtcaactagatgaagaacgcaggagggcattggattaaattatactgaagagcagcctggcgcggtggcttaggcctgtaatcccagcactttgggaggccaaggcgggtggatcatgaggtcaggagatcgagaccatcctggcgaacacggtgaaatcctgtctctactaaaaaatacaaaaaattagccgggtgtggtggcgtggcgggtgcccgtagtcccagctacttgggaggctgagacaggagaatggcatgaacccaggaggcagagcttgcagtgagcagagatcgtgccactacactccagcctgggcgacagaatgagactccgtctcaaaaaaaaaattatactgaagagttctgtcagccactttaaccatctttttttttttttttttttaaggcggagtctcactctgtcactcaggctggagtgcattggcacgatctcggcttactgcaacctccatctcccgggttcaagccattctcctgcctcagcctcctgagtagctgggattataggcgtgtaccaccatgccgggcccacctcaacatcccaaagtgccgggattacaggcatgagccactgtacctagcctttttttttttttttttttttgtttgagacggagtcttgcttgttggccaggctagagtgtagtggtgtgatcttggctctctgcaacctccgcctcccaggttcaagcgattctcctgcctcagcctcccaaatagctgggactacaagcacgtgccaccacacctggctaatttttttttttttttgagacagagctccgctcttgttgcccaggctggagtgcaatggtgcgatcttggctcaccacaacgtctgcctcccgggttcaagcgattctcctgcctcagcctcctgagtagctgggattacaggcatgcaccaccacgtccagccaattttgtatttttagtagagatggggtttctccatgttggtcaggctggtctcaaactcccaacctcaggtgatccgcccccttggccttccaaagtgctgggattacaagcatgagccaccgtgcccagccccacacctggctaatttttgtgttgttttacttagtgacatggggttttaccattttggccaggctggtcttgaactcctgacctcaagtgatccacccaccttggcctcccaaagtgctgggattacaggcacactttaaccatttttatgtttaatttaattttttaacttttattttttaaaatttttatttatttatttgagatggagtctcgctctgtcgcccaggctggagtacagtggtgcaaccttggctcactgcaacctctgtctcccgggttcaagtgattcttctgcctcagcctcccgagtagctgggattacaggcgcctgtcatgcccagctaatttttgtatatttagtaaagacagggttttgccacgttggccaggctggtctcgaactcctgaactcaggtgatccacctgcctcggcctcacaaagtgctgggattacaggcacactttaaccatttttatgtttaatttaattttttaactttttaaaacatttttattcatttatttatttatttattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctacttttttgtatttttttttttttttttttagtagagacggggtttcaccgtgttagccaggatggtctcgatctcctgacctcgtgatccgcccgcctcggcctcccaaagtgctgggattacaggcgtgagccaccgcgcccggcctattcatttatttttgagacagagtctcactctgtcaaccaggctgaagtgcagtggtgtgataacagctcactgcagcctctacctcctggactcaagcaatcctcccacctcagcctcccatgtaggtgggaccacaggcatgctccatcatgcctggccaatttttaattttttcgtagagatggggtctcactttgttgcgcaggctggtctcaaattcctgggctcaagcagtcctcttgccttggcctcccaaattgctgagattacaggtgtgagccactgcacctggcctatttattttttatttgtatttttaatttttgtagagatggggtctccctatcttgcccatgctggtctcgaactcctggcctcaagtgatcctcctgcctcagcctcccaaactgctgggattataggtgtgagccactgtgcccagccctttatgttgaatttaatctcaaggaggtaagagctatgattgtctctgtattacagtaacacgggtcctaaacagaattggtcatctttgctgagtgtctaatgtgccaggcactgttctaagtgctatacacaaatgacctcattggatccttttttttttttttttttttttttttttttgagagggagtcttgttctgtcgcccaggctggagtgcagaggtgcaatcttggctcactgcaacctctgcctcctgggttcaagcgattctcccacctcagcctcccaagtagctgggactacaggtgcacaccaccatgcctggctaacttttgtatttttttttagtagaggtggggtttcaccatgttggccaggctaacttctgacctcaagtgattcgcccgcctcagcctcctacagtgctgggattatgggcgtgagccactgcgcccagttctcattggatccttacgatgaccctatgaggagtcatagttgaagatactgaggcttgcagccataaaaaggaacaagatcatgtcctttacggggacatggatggagctggaagccgttatcctcagcaaactaacgcaggaacagaaaaccaaacactgcatgttctcacttagaagtgagagctaaatgatgagaaaagatggacacatcacggggaacaacagacactagggcctgtcaggtgggggaggtcggggagggagtgcaccaaggagagtagctaacagatgccgggcttaatacctaggtgatgggatgatctgtgtagcaaaccaccatgcatgcgtttacctatgtaacaaacttgaacatccagcacatataccccagaacctataataaaagttgaagaggtggggcgcggtggctcacacttataatcccagcactttgggaggctgaggcgggcggatcacaaggtcaggagatcgagaccatcctggataacacggtgaaacctctactaaaaatacaaaatttagccgggcgtggtggcgggcgcctgtagtcccagctactcgggaggctgaggcaggagaatggcgtgaacccggaaggcagcgcttgcagtgagccgagatcgtgccactgcactccagcctgggcgacagagcgagactccatctcaaaaaaaaaaaaaaaaagaaaaaagaaagttgaagaaaacagcctggcacggtggctcacgcctgtaatcccagcactttgggaggctgaggcggatggatcacttgaggtcaggagttcgagaccagcctggccaacatggcaaaaccctgtctctactaaaaacacaaaaattagccgtgtgtgcgggtggatgcctgtaatccccaggaggctgagacagaagaatcacttgagcccaggaggcagaggttgcagtgagctgagatcacgcgactgcactccagcctgggcgacagagagactccgtctgaaaaaagaaaaaagaataaaaaaaaaagaaaaaggccgggcacagtggcccacgcctgtaatcccagcactttgggaggctgagttgggcggatcaccaggtcaggagattgagaccatcctggctaacacggtgaaaccccatctctactaaaaatacaaaaaagaaaaaattagccgggcatggtggcacgcacttgtggtcccaactactcgggaggctgaggcaggagagtcacttgaacctgggaggcggaggttgcagagagccaagatcacaccactacactccagcctgggcgacagagcgagactccatctttaaaaaaaaatttttttgaggaaaacaaaaagatactgctgaggcacaggaaagttaagcgcatgtcccagaccacataggtgttccagttccagtctttgctcatttaaacagagtcatagagaggtacagtaatatgcccaaagtcacacagctcgtgtgggaactgatgtccccagaccccatccttctcccttcttcagagcccctgccttcacccccttgctgtcatcctcccgcactgggaggaagggaagcctgggaggagtggctggtggctcctgcagtccccgtacactggccaggcaatacgggggacagacttgagggacaatgtctgtgctccaaggcccatgggtgggatggtttgatggagtcagctgcggggctcctggcatctcagtggtgccgacagcaggaggggtgggggcaccaaagggaactcaccgtctgcagcacagcaaacttcaccttcccaaacttgtcttgctctacccagggctcccgcatgattttggcgccccgttcccgtgctttctgcagagaagatgggatcggggaattggtgagggctggagccttccagaacccttgcctgctgctcctgcctggtggcctctgcgtggtcctgcaggcccctccagtttctccagccccaggtaggaaccccagccagcttcagccattacccccaatactcatgctcatttggcaaatagggaaactgaggcccaggcccagagttggggctatgggagacaaactaggtagggatgggtgtctgtcctgcctctgctaactccccctgtgatcagtccccttctctagtcctcaatttcaccatctgtaaaaagaatggttggatgagaataataagaagattcatgcatttatttagcaaaactggactgcatgacagtgcttatatcatgcaccaggctctgttctagattctaacctcgttcatcctcacagcaacattatgcaaaagtactattatcatctccattctctaggtgaggacgttgaagcacagagacattaagtcacttgcccgaagtcacacggctaagattcagacctggagagcctggctctggaacgcacactctgaatctgtaggctgcctgttgggtacagtgtttggtttagagttgtgctcaagaaacagtaattctgaggccaggcaaaatggctcatgcctgtaatcccagcactttaggaggccgaggtgggtggatcacttgaggtcaggagttcaagaccagcctggccaatatggcaaaactccatctctactaaaatacaaaaattagctgggcatggtggcaggcgcctgtaatcccagctactcgggaggctgaggcaggagaatcgcttgaacccaggaggtggaggttgcagtgagccaagattgcgccactgctctccagcctgggcaacagagcaagactctgacacacacacacacacaaaagaaagaaaaagaaaatgaaaaaagaaaaaaaaggaaatgaccagcctgaccaacaaggagaaaccccatctctactaaaaatacaaaactagccgggcgtggtggcgcatgcctgtaatcctagctacttaggaggctgaggcaggagaattgcttgaatccaggaggcagaagttgcggtgagccgagatcgtgccattgcactccaacctgggcaacaagagcaaaactccgtctcacaaaaaaaaaaaaaaaaaaaaaaggaaatggtaattctaatttcctcctttgacaacccagctgtggttagccccatctggcagctgtggaaactgaggctcagtgagagagaggacacgggggaaggcagggcacccccggagcccaggtgtgtgtcacaccagcatctgggcttgtcactgtgatgcagcatctgggcttgtcactgtgatgcagcatctgagcttgtcactgtgatgtggcatctgggcttgtcactgtgatgcagcagtgtccttccagccctgactgatggggtccccatggcagacggaggccttcctctctcagtccacccaggtgctttcttacctgcacgatgtagtcacaatcttccacctcgaacgcaatgtccttcactccgtcaccgtgtttcaccaggtgatcgcccatctctgtggccggcagggagaggatggcactggagtctggagtctaggtcccctcacctggcttttagtctccatccaggccctgaacccagagcccacccacggagccatgcgtccaccctcccagaacccagatcccacccacagagccatgcgtccaccctccccgggcacctcacctttgttccaggggttgagcgctgaggagaggacaaacacaatctaagataggaggagaaggaggtgaggctagtggctcaggggggcatggggaggtgcacccatcggcccctccctgccgacccgaaacacccctgatggagcacaagaactcctggacctgggttctagctccttctctgccttagtttcccacactggtcctgagggatggggctttcagccagaccccctctggatcctcagaggaactgctaggtcaggtctccctcggggagagaactccagggaccccatcggtcagggcactgcttaaaattcctctcctctgatatcccaggttttctgagcacctgtggggtcagtgttgggccaggctgaggaggaaacgaaactaggaagggccgtgttgcatggctgtacaaagatgccagcggaggggtcggtgggagctgaattatatgtttttgttgttgttgttggggttttttgttgttttttgtttttttttgttgagatggagtcttgctctgtcgcccaggctggagtgcagtggcacgacgttggctcactgcaacctctgcctcccgggttcaagcgatgtgcctgcctcagcctcctgagtagctgggattacaggtgcccaccatcatgcccagctaatttttctatttttaatagagatggggtttcaccatgttggccaggcaggggttgggggctgtcctgggggtggtgactcaccttcccttgtttgattacatggctgaccacctcccgggaaccggtctccaggcccctgtaggctagaggttcaaagcccatcttgctgcagtagaatgacgtggcctgaatcacagggttgcagcagggttcatgagggtcaaggggccagcatgggggacttccgcaagagagcccctggcccccctcagcctgcctgccctattgcctcaggggcagagaccctcctgggaagatagactgctgcctgcacattttgctgacagataactttcccgctggtgtaattaggattcagagtatctggcccacccctggcctgatcctccctcccaagggccaatcacagaccctgctggaggcctgcccttgtcaggcagccctctgccctgccgtctgctcactccagcaccttgccccggcttctacctgcttggcgttgccaacccagaaggtcacagagtggaagtggaggaatcggcctctctcaggctgcagaaggagagaagaggtgaggttgagtccctgaaagtgagtctagaaaagtgcgggtggagtgatgtcccctagccaccctccttattccagcctcaaccacagaacttaggagcagcggaaccccatgcagccttgccaagcctcaaaagaggtttctcatgtggaagttgagctcctgggtgtcttggatggggaaaccccctcaggaggcctgccaaggtttcacacagggaaatagacttatgttgcagcaatatggatttaagttagaccttagaaagaacttccagatgggattaaaagattggcaggcatttgagaaggggtacaggttttgttttggtttttgtttctgagatggagttttgctctattgcccaggctggagtggagtgcagtggtgcaatcttggctcactgcaacttccgcctcccaggttcaagcgatcctagggttcaagtgatctcccccaccttagcctcctgagtagctgggattacaggggtgcgctaccatgcccggctaattttcgtatttttagtagagacggggtttcctcatgttgaccaggctggtctcgaactcctgacctcaagtatttgcctgccttggcctcccaaagcactgggattacaggcatgagccaccatgcccggccaggatacaagtttgttgtgagggtgaggttgagtccagctcagtctcggggagccccgggggtaaagctgagtgtgcaggcatgcacgtcatgtatccactccagtccttcctcttctgctctctgctgaaaccccagtctccctgcactccgacccccttctagactcaggcccctacatttcccacatttcgcctgcttacctttgcccctttgtcactgtaagtcgtctaaggagaaaaagaaggacagtgagacttggaggttccaacacaaggtgcttctggaagcgttactgaagatgtcccacccaaggggagatggccatggcacttaccatgattgatcttagtcaaacctcctactgggactagaggcctggggagtgctgggccggagtatttaaccccaagcaggtcccgcccaggcctcctggcctacctgggggatggggtggggagctgagcccagccctggaaggttccaggcctggggacctctgatccagccgcagcctcattgaacaggatggtgttgccaggcccagagaggggcagtgacgtccactagtcagtgggaggcagagtcagggccagaagccaagggcaagcttttccaggacgctgggaatgtgaccattactgcccagaatccaaagctcagaagccaaggccggctggagtgcagtggcggctccagaactcttgcctagaggaaatttgagggggcatttggagactggccccaaagtcctgtttgcgtcacagcgttgtattccatagctctgagaggcacggcaggagaaggtttgcatcctggctctgttacatacagtgtgacttgggaaaatcaccatatccctttgagcctcatttgtaaaacaggaatgagaatagtgtggtggggattaaaggagataagcacgctctttggaacaggacctggcacacaggacactctcagtgttggttataattcattgggacagagaacattcctaggccatgaggtcagcaagcggcagggaagaactggaacatgaaccgggctattctaactccaggacccacactttaaattgctagattgccctctatacaaatgggagatattgatatccccatcagatggggaaactgaggcctggagaggtgaacacatgtctcccaggtcatggaactggtaagagcagagccccaaactctggcctgtttgattctgaagttggatctcattgcaccagtgcagaccacttctccctccttttctctattttctgggccattcaggaggcaggcaaggtggtcccacccccttattctgcctgtcctgggcctgcccagtgtgctcccagtgtccacctcagctccttaagtctaaatttccaactgggggccgggggtggtggctcacgcctgtaatcccagcactttgggaggccaaggagggaggatcacttgaggccaggagtttgagaccagcctggcaacatggtaaaacctcatctctactaaaaatacaaacattagctgggcacggtggtgcacgtctgtagtcccagctactcaggggactgaggcaggaggatcacttgaaccaaggaggcagagattgcagtgagcagtgatcatgccactgccctccagcctgggtgacagagtgagactccatctcaaataaataaataaatatccaactgggaaaacttgagtggaggtggcccagggtggatctcacaggcccagaaggttcccatggaggagaagagctctgtgtagcctgcctatcccctccaggccagcaggaacatcttgtcactttgattgctgtggccaactcaaacccccactcctggagcctgccctggcttatatgctaagcacaaaggccaatgtttactaactcaaggaagtgtgtcaacagcagtgggttgcaaaggctggcaggcatctagaggtaggaactctgtccccaacactgtaggtctcagtcccatgctgggtgcacccctagatgccattcacatgtctgggcagagagcagggaggcaagcctgcagggcccagtatccagagtcccctccctgatgctctctgttcaggctgggctccactggataacagatcagcagtggctgggtgtgactgtctctgttcttcatgcccgaccatgcagaggtgggttccagaggccttgctcaagaagctcactgatcagatgggttcataggacgcatccttgaaaataccctggtgtgcagaaaagcattcacctagctgggcctggtagtgagcacctgtagtccccagccactcaggaggctgaggtgggaggatcacttgagtccaggagttaaaggttgcagtgagctatgatcacgccactgcactctagcctggggaacagggtgagaacttgtatcaaaaatagataaggcagggcccagtggctcacacctgtaatcctagcactttgggaggccgaggagggaggatcacttgaggttaggtgttcgagaccagcctggccaacatggtgaaaccctatctctactaaaaatacaaaaattagcctggatgcagtggctcatgcctataatcctagcactttaggaggctgaggcgggtgggtcacctgaggtcaggagtttgagaccagcctgaccaatatggtgaaacaccgtctctactaaaaatacaaaaattagctgggcatggtggcaggcacctgtagtcccatctacttgggaggctgagacaggagaattgcttgaacccaggaggtggaggttgcagtgagccgagatcatgccactgcactccagcctgagcaacagagtaagactctgtctcaaaaaaaaaaaaaaaattagctgggtgtggtggtgtgtgcctgtaatcccacccagctacttgggaggctgaggcaggagaatcacttgaacccaggaggtggaggttgcaatgcgagattgtgccactgcgctccagcctgggcgacagaatgagaccctgtctcaaaataaagaaataagtaagtaagtaagtaaataaaatggaacaagtctcagttactgatagttcttactatagtgtttgctaatattacagcttctggaaaaaaacatgaaaaagaggcaatctctaaatggagatacactttcagggttttaaaaagcagtttttagttgctaatgagcccttgtgaaaccacacagctgacccttagagtcatgattttctagctgatagggatctttttacaggcgtccacccgggctctgaaactgacagacttaaagggcttaagaaagcctcgcttcgctcttagcctcgagacaaacagtctcttggcttagctactgcagaagaaaatcctgaattcacgaattctagttttccaaacctgatcccaagctgaaagctctgcaaggggacggttgcttgagcccaagaggtcgaggctgcaatgagctatgatcgcaccactgcactccagcctcggtgacagagtgagaccctgtcttaaaaaaagagaaaaaaaaatgctgaaacctgatgctgtctgctgtgagctgtttcagtgtcagcatgaattctgccaaactaaaaaaatgggcaaaattgctccactcaacacacaggactttaactctaggaccctggcagattagagacatccctccctggggccatatgctgtgcaaacatcgtggatgctgctggacagtgtgggtcacttacagatgtccatgatgaaagagttcctctctaatgggaccatttacattgggctgctcttcagctctgcatttcttttttttttttttttgagacggagtctcgctcttgctgcccaggctggagtgcaatggtgcgatctcggcttattacaacctccgcctcccaggttcaatcgattctcctgtctcagcatcccaagtagcagggattacaggcatgtgccaccacgcccagctaattttgtatttttagtagagatggggtttcaccatgttggtcaggcatgtctcgaactcctgacctcaggtgatctgcccacctcggcctcccaaagtgctgggattacaggcgtgagccaccgctctcggcctttttttttttttttttttttttttttttgagacagagtctccctctgtggcccaggctggagtgcagtggcgtgatcttggcatctcggctcaatgcaagctttttttttttttttttttttttttaggctggagtgcaatggtgcaatctcggctcactgcaagctccacctccaaggttcacgccattctcctgcctcagcctccggagtagctgggaatacaggcacctgccacctggctcagctaatgttttgtatttttagtagagatgaggtttcaccgtgttagccaggatggtctcaatctcctgacctcgtgattcgctcgccttggcctcccaaagtgccgggattataggcgtgagccaccgcgcccggcaccccccctcctttttttttttttaagatggtcttgggatgtctcccaagctgaagtgcaatggcgtgatctctgctcactgcaacctccgcctcctaggttcaagtgattctcccgcctcagtctcccaagtagttaagactacaggcatgcgccaccacaccaagctaatttttgtattttttatcagagacagggcttcgccatgttggcgaggctgatctcgaactcttggcctcaggtgatcttcccgcctcggcctcccaaagtgctgggattacaggcgtgagccactgcgcccagccagctctgcatttctggtgctgattccttcctaacttgtgattcctgcccaaagcaacaagccgagagagggtacatcacagggaccgtgatccttccacgcactccttcagactggactctcaaaactccccaccaaatgtttcactgcagttgatcgttgtgtctgactttctcaattcgttgcaatttgcaacaatggactaatagcctgattctccttcccgcatctttgtcctgacgtactcaccttagtaaggctgtctgttaaatgcaactgtccctcaaaaggcattatttcttctatgctgctcactacagaaatgatcagaatgaaaagcattggtggcgagccaggagcagtggctgacacctgtaatcccagcactttaagaggctgagatggggggatcccttgagcccaggagttcaagggtacagtgagctataattgcaccactgcacttcagcctgggcagcagaatgagaccctgtctctaaaagaaaaaaaaaaagaaagaaaagggtggagagttatataagcccattttggaaatttgtgaaaatccaggattttgccccttccacttcctgaacctgaaatgaagctttctggttaagttgtataaaaatgtttttctgtgaaaaggtttttgtccctcttggctgggcacggtggctcatgcctgtaatcccagcactttgggaggccaaggcaggcagatcatttgaggtcaggaatttgagaccagcctggccaacatagcgaaaccctgtttctactaaaaatacaaaaaaaaaaaaaaaaaaaaaaattagctgggcatggtggtacacacctgtaatcctagctactcaggaggctgaggcaggagaatcacttgaacccgggaggcagggttcattgagctgagatcgtgccactgcactccagcctggcgacagagcaagactctgtcacacaaaaaaaagaaaaaatatcttattaaagccaggtacagtggctcatacctgtaatcccagcactttgggaggcggaggcaggaggatcacttgaggccaggggttcaagaccaacctgggcaacctagtgagaccctgtctctacaaaaagtttaaaaagtagccggctatagtggtgcatgcccgtagtcccagctactcaggaggctaagtggggaagatctcttgagcccaggagcttaagactgaagtgagctatgattgtaccattgtactccagcctgggcaacagagggaggccctgactattaaaaaaaaaaaaaaaatggccgggcgcagtggctcacgtctgtaatcccagcactttgggaggccaaggcagacggatcacgaggtcaggagatcgagaccatcctggctaacatggtgaaaccccgtctctactaaaaatacaaaaaattagccaggcatggtggcaggcgcctgtagtcccagctacttgggaggctgaggcaggagaatggagtgaacccggggcgcggagcttgcagtgagccaggattgcaccactgcactccagcctgggcgacagagtgagactccgtctcaaaaacaacaacaacaacaacaacaacaacaaaaaactcctgttatagacaatacccacattaattcccatcctcaattttaaggctattatcacttccactggttcatcttagggtagaaaatattataaacgtctgggcatattggctcacgcctgtaatcccagcactttgggaggctgaggtgggtggatcacttgaggtcaggagttcgagaccagcctagtcaacatggtgaaaccccgtctctactaaaaatacaaaaattagctgggcatgatggcgggcacccgtagtttcggctactcgggagggtgaggcaggagaatcgcttgaacctgggagtcggaggctgcagtgagctgagatcatgccagtgcactctaacctgggcgacacagcgacactctctttctttctttctttctttctttgagacagagtttcgcttttgttgcccaggctggagtgcactggcatgatctcagcttactgcaacctccgcctcccgggttcaaccaattctcctgcctcagcctcccaagtaactgggattatgggtgcccgccaccacacccggctattttttgtatttttagtagagatggggtttcgtcatgttggccaggctggtctcacaccctgacctcacgtgatctgtccgccttggcctcccaaagtgctgggattacaggcatgagccactgtgcccagccacgacactctctttcaaaaaaaaggaaaaaaaaaaagaaagaaaatattataaacaaagtaatctaaagtaatctaagtatccatcaacaggagattggcttaatacaataaaacattaactattaaaaataatcaagaggctgggtgtggtggctcatgcctgtaatcccagcactttgggaggccaaagcgggaggatcacctgaggtcaggagttcaaggccagcctgggcaacatggcgaaaccccatctctactaaaaaaataaaaagagctgggcgtagtgttgggcgcctgtaatcccatctactcgagaggctgaggcacaaattgcttgaacctcagaggtggaggttgcggtaagcctagattgagccactgcactccagcctgggcaacagagtgagactctgttttttaaaaaacaaagcaaaacaaaacaaaaaggtggggcgccgtggctcacgcctgtactcctagcactttgggaggccgaggtggttggatcacgaggtcgggagatcgagaccatcctggctaacacggtgaaaccctgtctctactaaaaatacaaaaacaaaattagccaggcatggtggcaggcgcctgtagtcccagctactcgggaggctgaggcaggagaatggtgtgaactcgggaggcagagcttgcagtgagcagagatcttgccactgcactccagcctgggggacacagcgagactccgcctcaaaaaaaaaaaaaaaagaataaataaactttctagatgttctagatggtgatgggaaaaagctctaagatatgttacgtttaaaaaaaaaaaggcacggagcagtgtatataagttaccatttgtgtaaaaaaaaaaccccacagtttacagatggttttaattttgttcttacagtttatttgaattttccacagtacaaaacatgccaacggttctcagccatttgacggagtttaaataaagagaaccaatgcaaccttgccatttggaatcttctgctgttgggagcaccccaagcttagtgacttcagggtttatttcatacttctctgcacatctagttggcctttctggttctgcagcaaagtctatttacatgttttacatcataatttacatgatttaagattttgtaaatatggcttctatttgttgagctataacttacacagagtgaaattcatagaactgtacactgaaaagagtatttcagcgtacagttctatgaattttgaaaacatatacagttgcataactatgacctcaatcaagatacaggacaattccattaccccaaaatgtaatcaccacaaatccaccctcgctgtgcacctttgtcctcaatccaccctcatcccaacccctggcaaccactgatctattttctttccttacagctttgccttttctagaatgtcatataaatgaatcaagcagtatgtagccttttcagtcttgcttcattcacccaacaaaatacatttgaggccgggtgtggtggctcacgcctgtaatcccagcactttgggaggcggaggtgggcagatcacctgaagtcaggaattcaaaaaccagtctggccaacatggcaaaaccccatctctactaaaaatacaaaaattagctgggtatggtggcacgcatctgtagtcccagtgactcaggaggctgacgcatgagaatcgctggaacccaggatgtggaggctgcagtgagccaagattgcaccactgcactccagcctgggagacagagagagaccctgtctcaaaaaaaaaaaaaaaaaattgagattcatccacgttgatgcttgcatccagactttactttcttgtttttcttttcttttcttttttttttagacaaggtctcactcattctgttacctaggctggaatgcagtgggactacaggcacacaccaacatgactggctaaattgttttttttgagacgaattctcactctgtcacctaggctagagtgcagtggtgtgatcttggctcactgcaacctccacctcccaggttcaagtgattctcctgcctcagcttcccgagtagctgggattacaggtgcacatcaccatgcctggctaatttttgtatttttaatagagacagggttttgccatgttggctcggctggtctctaactcctgacctcaagtggtccgcctgcctcggcctcccaaagggagggacccctgggattacaggtgtcagccaccgtgcccgacaccactggctaaatttttgtttgtttgtttgtagagtcaaggttttgctatgttgcccaggctggtcttgaactcctggcttcaagaaattctcccaccttggcctcccaatatgttggcattataggtgtgagccacagtgccccgcccaaactttgtttctctctattgctgagcagtgtttcattgtatgcttgtgccagagtttaatactgctcattggccaggcacagtggctcatgcttataatgccagcactttcagaggctgaggcaggaggatcacttgagcccaggaggtcaaggctgcaatgatcacttcactgcactccagcctgggtgacacagcgagaccctgttcccaaaaaaatgaaaacccaaacaaacaacactgcttagttgctttctgtaatcagcctattaacaaatcaagggagaatgagtcttggttacaaaacagaatacaaatgtgaagggttagagaacagaagctgggcaatacacttcctcatctttttttgttttgttttgttttgttttttgagacggagtcttgcactgttgcccaggctggagtgcagtggcgcgatctcggctcactggcctcaagtgatcctcccgtctcagcctcccaaagtgctggggttacaggtgtgagtcaacacacccagccctttgcctgtctatttctttcttttttctttttttttttttttttgagatggagtcttgctctgtcccccaagctggagtgcagtggcaaaatcttggctcactgcagcctctgcctcccaggttcaagtgattctcctgcctcagcctcctgagtagcctgggattacaggcctgtgcccccatgcccagctagtttttatatttttattagacatagagtttcaccatgttggccaggctggtctcaaactcctggcctcaaatgatccacctgcctcagcctcccgaagtgctgggattacaggcatgagccaccatgcccggcccctttgcctatttcttaatcgaattatagtctttttattattgagctataagagttctctttgtttgttttcttacttttgaggcagactctcgccctatcatccaggctggagtgcaagtgcagtggcacgatcatatttcactgtaacctcaacctccctggctccagcgatcctcccagctcagccttccaagtagttgggactacaggcatgtgccactgtgcccagccaattaaaaacaattttttggctgggtgtggtggctcatgcctgtaatcctagcactttgggaggccgaggcggatcacttgaggtcaggagttcgagaccagcctggccaacatggtgaaaccctgtctgtactaaaaatacaaaaattaaccggacatggtggcagacgcctataatcccagctgctcaggagactgaggcaggagaatcgcttgaacctgggagacggaggttgcagtgagccaggatcgcgccattgccctccagcctgggtgacaagagtgaaacttcgtctcaaaaaaaaaaaaaaaaaaaaaaaattggtggatatggggtctcactatgttgcccaggcttgtcttgaactcctgggctcagggggtcctcccgccaaagtactgggattatagtcatgagccactggtgtggaaagagttcttaatatattctagatataaatcccttatcgaatatatttggaagtattttttccccattttgtaggttttcacttttttttttttagtgcagtggctctcggcccactgcaacctctgcctcctgggttcaagagattctcttgcctcagcctcctgagtagctaggattaaaggcgcccaccaccaggcccaactaatttttgtgtttttagtagagacagggtttcaccatgttgcccaggctggtctcaaactcctgacctcaagtgatccacccaccttggcctcccaaagtgctggaattactggcgtgagccaccatgcctggccttcactttcttaattgtattatttttagtgcaacagcttttaattttgatgaagtccagcgtatctacctgttcttcagtcacttgtgctttagtgtcctaagaagtgggctgattattattattattattattttagagatggggtcttcctgtgttgcctaggctaaccttgaactcctgggctcaagcagtccttctgcctcggccttccacaatgctgggattacaggcatgaaccaccacacccagcgtaagctgattttttttttttttttagcttaaaaggaaaaaatcttctgcagaaggaacatgattcaccagatggttacctctggaggcagcacactttttcaaaataattaaaataatgttaacacaaactaaattcccattttctggtcactttgttttatgtgccaggcactgtactaagcacattccatgctctgctctttactcattaaatccacaacaaccctgttaagtaggtgctctcatatccccatttcacagattagaagatggaggcttactagctaggtgtggtggcgcatgcctgtaatcccagctactagggaggctgaggcgggagaaccacttgaaccaggaggcggaggttgcagtgagtggagatcgtgccactgcactccagcctgagtgacacagtaagactctgtctcaaaaaaaaaaaaaaagaaggcaaggatgggtgatctcattgtcagggggtttagattttatctttgagacaatagggagctattgaaggttttttttttttttttttgagacagagtttcactcttgttacttaggttggagtgcaatggcgggatctcagctcaccacaacctctgcctcctgggttcaagcgattctcctgcctcagcctcctgagtagctgggattataggcatgtgccaccacacctggctaattttgtatttttagtagagatggggtttctccatgttggtcaggctggtcgtgaactcccgacctcagttgatccgcccgcctcggtctcccaaagtgctgggattacagtcatgagccaccgcacccggcctattgaaggttttatagtagagatgcaacgtgatcagaacattaaagcttgctctgctctaggtgagcacagggaagagagctgggctggaaacccagctgcccagagctgctgtgccattgcccagtggcctatttgtgattctccattaggtttggggaagataagtaaaccaagaagctttacatttaaaaattggatctaggctgtaatcccctcactttgggaggccgaggcagacagatcgcttgagcctaggaattcaacatgaccctgggtaacatggcaaaaccccatttctacaaaaaaaaaccccaaaatcagccaggtgtggtggggcacacctgtagtcctagctgctcaggaggctgagacgggtgaatcgattgagcccaggaggttgaggctacagtgagctgtgattatgccactgcactccagcctgggtgacagagtgagaccctgtctcaattaaaaaaaaaaaatgcatctaaaagcagtcaaatagccctgtgctctgcttcctgcaatctacaactggagactcccaaacaggcagaactagtgaggattcagaggcagaagtccatggacagaacctcacccctcccctgccaggccccacagctctcccaagcaagggcagctgggaccagagcaggtgaaggctggcccgggtgcccagctagtcttgttatcagggctggtgatcctgggcagggccacttaggtggggctggtctttatctcttgaggtacagagcccatgtgtctgagctttgtggtgacaggaagctgtatcaccaggcaccagtgatggctgggagggaccagagagttggtggcacgggacataggacccctgggctctgaagactgtgtaatcttgggccactcctggcatcctctgagtcttagtgtcctaactgtgcaagccagggagcactggagctggtgtggaccgtaggatgtcctctgttcctggcaccggggcattgaggagtgtcctggagatttcttttctctcttttttttctttttgagatggagtctcgggctgggcgcggtggctcacgactgtaatcccagcactttgggaggccgaggcgggtggatcacaaggtcaggagttcaagaccagcctggccaagatggtgaaaccccgtctctactaaaaatacaaaaaaaaaaaaaattagctgggcgtggtggtgggcacctgtaatcccagccactcaggaggctgaggcagagaattgcttgaacctgggaggcggaggttgcagtgagccaagatcacgccactacactccagcctgggcgacagagcgagactcctctcaaaaaaaaaaaagagatggagtcttgctctgtcgcccaggctggagtgcaatggtgcactcccactgcaacctccgcctcccagcttcaagtgattctcctgcctcagcctcctgagtagctgggactaacaggagcccgccaccaggaccagttagtttcttttgtatttttagtagagacggggtttcaccatgttggccagtctagtcttgaactactgacctcaagtgatccacctgcctcagcctcccaaagcattgggattgcaggcatgagccaccgtgcctggcctaaaatttcttgtctctccagcatccactcctgttctcataacagcgtctcccttctccatcctttccctgctccgttcatgtcgtttgggtggggcatgtgagccaggactgggcagtgagaatccctgtgattggttcagggctgggcacctggccagaactggccatatggatttgctctggatcttctgcttgagaaaagaggctcactctgagctctgagtatgctgcactgatccagtggtgctgcgggggccaaccctgagtcagctgaaggaaaacatgcttgtatataaagccagaacagagaaaccagagctgagagaagataggctgattcctgatgtctgagcaacttgttccaggcagaaacaagctcctggatgagtcaaacctttttcccttttgcttaagctagtttgagttgggtttctggcatttacaaccactggtgctgacaaacacaaagaaagaaacaataacaccaccaccatctgtgagcatgtattcactgtcaagcaccgaggtagggatcatggggattgtctgttccacagggaggtagtacttgatcattttgtttgcatttgctggcacacataaaataaagttgactgattttagcagtttttattattattttaaaactctctgcagacattgcatccctgtggtagattctactgtccataacccttcaaggaaggcctcaatgcccagctgtagggagactggttggctgtcacctcctatcggatctgcctcagctgtagagacttggccacagctttcccagagcagcccactttttgtgattgagcaagggagtagagaggctggtccctttcagcccaatgggggtgactctgaccagtgagtctgtctccagggccccggtagggctggccaaggccttgtggagtctccaccactgagttctccttctccccagtccagcctcctctgcttcctttcactgatgtggatccttaaaatcattttatggccgggcgcggtggctcacgcctgtaatcccagcactttgggaagctgaggcgggcggatcacaaggtcaggagatcgagaccatcctggataacaccatgaaaccccatctctactaaaaaaatacaaaaaattagctgggcgtgctggcgggcgcctgtggtcccagctacgcgggaggctgaggcaggagaatggcgtgaacccgggaggtggagcttgcagtgagccgagatcgcgccactgcactccagcctgggagacagagactccgtctcaaaaaaaaaaaatcattttatggccaggcatggcggttcacgcctgtaatcccagcgctttgggaggcagaggcagaggatcgcttctgtccaggagttcaaggctgcagtgggctatgattttgccactgcactccagcctgggtgacagagcaagaccctgtctcaaacaaaacaacagcaagaaaaaaatcttgcaccctaagctctgtctcatcctctgctcctagacaacccaacgcatgacagctcccttatgacttgtacctgatggggtgggaaagaggtgatggaggcagcaccccccggtatatgccacggctaagcactgtgcccattttatctctcagctttctatttttctcctctcattttgcagatgaggaacttgagattcaagaagaggaagaattgcccaaataacttgttctttgtggctagaaaatgcttacatggaactcaccaggccacattcatattactatgtttgtgatcatccaaacataaaaccagttcctaggccgtgtgcggtggctcacatctgtaatcctagaattttgggaggccgaggtgggtggatcacctgaggtcaggagttcgaggccagcctggccaacatggtgaaacccccatctctgctaaaaatacaaaaattagctgggcgtggtggcgggcgcctgtaatcccagctacttgggaggctgaggcaggagaatcgcttgaacctgggaggcagaggttgcagtgagccgagatcacgccattgcactccagcctgggcaacaagagcaaaactccatctcaaaacaaacaaacaagcaaacaaacaaaaccaaaaacagttcctgcttccaagattttaaggcattaacatccatttgggagatgtgtgcatgtgaaacatccatttgggagacacctgaaacatctgaactttctttgtcactttctttttttttttttgagacgtagtttcgctcttgttacccaggctggagtgcaatggcacgatctctgcccaccgcaacctctgcctcccgggttcaagcgattcccttgcctcaacctcccgagtagctgggattacaggcatgtgccaccacatccggctaattttgtgtttttagtagagaggggtttctccatgctggtcaggctggtctcgaactcccaacctcaggtgatctgtctgcctcagcctcccaaagtgctgggattacaggcgtgagccaccgtgcctggccttgtcactttcttaagtctaaaacaaggcctggcaaacattttccataaaaagccatatggtaaatatttctgctttgtgggctatcaggcctctgctgaaactactgtagcctgcaaacagccacagacaataggtgaacaaattggtgtggctatgtgccaataaaaacttatttacaaaaacagtcaatgagggaaaaaacagacagtggtccagatttagaccaagggccatggtttacccacccctgcctaggcaatcaacaaaacagtaaccttggtttgtagcatttcctgaattctgtggtgtagatactctgtatggtcaatttcttttcttttttttctccccctttttctttctttcttttttttttttttttgagacatggtctcactgtgtcacctagaccgaagtgcagtggctcaatctcggctcactgcaacctccatctgccaggctgaagcaatcctcctacctcagcctcccaagtagctggaattataggtatgtgccaccaagcccggctaatttttgaatttcttatatagacagggtttcaccatgttgcccaggctggtggcaaactcttgggctcaagtacactgcccacttcggcgtcccaaagtgttgggattacaggcatgagccactgcacctggccggtatggtcaatttcgagtatcaacatgaagtcattgaacttggggttaagctaagtacagtacataccaaacggatacaaacagaagtaaataaccccaaaagcacagatgaggctgggtacattggctcacatctatattcccaccattttgggaggctgagtctggaggatcatttcagtcctggagttcaagaccagcctgggcaacaaagcaaaatcccatctcaaaaagaacagagtagagaagagaagagacagcattggtgatactaaaacttagtaaaaatgattaggaagttgaggccaggcgtggtggctcacgcctgtaatccagcacctgggaaggccgaggtgggaggatcacctgaggtcaggagtttcagacaggcttggtcaaaatggcgaaaccccatctctactaaatatacaaaaattagctgggcgtggtggcgggcgcctgtagtcccagctacctgagaggctgaggcaggagaatcgctggaacccaggaagtggaagctgcagtgagccaagattgtgccactgcacttgaggctgggccacagcgagactgtgtctaaaaaataataataataaaaactggcccacaaacttcctggagaattgaccgtgggctctcctgagtgaataggagctacttccctgctttcgttgcctgaggtttagaggtgggaggcccccatgatagggaaaacagccaccagggaggccgaacagctgatacgggatcaaggcccggggtacatcaaagggcttttccttcctctcaggctaaattaccatcacgtcagtagctccatcacttgcataagcggagggtaaggttactcaagcccagccatcgatccctttcaggctgaacctgtgtcctcatcatccaaagtccccatgcttgcatacgtctcccacccttcagtttggagcactgactttcatcgttggcaagggcaatggggagttctctttggcctctgatttgctgaattgccttcaatacatggcttaacctctctgaacccccatccccatttccgagtcttaggaagaactgtggcagggcgcggtggctcatgcctgtaatcccagatctttgggaggctgaagtgggctgaagtgggaggatcacttgaggtcaggagttcgagaccagcctggccaacatggtgaaaccccgtctgtactaaaaatacaaaaattagccgggcatggtggtgcacgcctgtaagcccagctacaagggaggctgaggcaggagaattgcttgaacccaggaggcggaggttgcagtgagccaagattgcgtcactgtactctagcctgggtgacacagcaagactccatctccaaaaaaaaaaaaaaaaaagaactgttatgagtctctgttacctacagggatagaagtgagtgactacatgtccagtgctttgcatgcaacacaaccaccctgtgagggaggtattattctacccattgtacagttgaagaaactgagactcagagaagctaactggctcatactagtaggtagagttgggattcatctctccttaccccaaatcctagtttttcatcctttctggtgtgccttactgcctctagagcccctccagatttttacaaatgagaggggtgtgagaggctgctggccacagacctgaaacctaaatgtgccaggagagcaacagagaagagctgggtgaggttgggcgcggtggttcacgcctgtagtcccagcactttgggaggcagaggcaggtggatcacttgaggccaggagttcgagaccagcctggccaacatggtaagacccccatctctactaaaaatacaaaaatgagccgagtgtggtggcacatgcctgtaatcccagctactcaggaggctgaggcaccagaatagcttgaacttgggaggtggaggttgcagtaagctgagatcgtgccactgcgctccagcctgggtgacggattgagactctgtctcaaaataataataataataaacagaagagctgggtgggattggggaaagctgcatcccacccccacactctgccaacgagggcagtaacttagctccagacagttgttgcctgtgggtacatgggcctggtgtggccggattttgttcaaaagaagttagcaatgtgaatttttatgtgaaatcctttgatttgaagattgtcttgttttgaattctatttgtatgaaatatccagaataggtaaatccacagacccacagtgcagactggtggctgccgggctctgcggggagggaggaagggaaagtgactgcttaaggagaatgggtgtccttttggggtgatggaaagaagtattctggaaccagatagaggtggtggttgcacaacattgtgaattactaaatgctgctgaatgttttcactgttttgtgactctcatctcaataaattgaattggttttaaatttttctttatgattttgtgcgtttttagatattgggaaatagcatttttattgaagatgagtatacatggagaagtgcataagtgtatagctctgaattgtcacaaacagaacacacctgtttaaccagctcagctatgtggttttttgtttgttttgtttttttattgagatagtctcactctgtcgcccaggctggggtatagtggtatgatcttggctcactgcaacctctacctcctgggttcaagcaattctcctgcctcagcctcccaagtagctgggattacaggcgtacgccaccacgcccggctaatttttgtatttttagtagagatgaggttttgccatgttggccaggctggtctcaaactcctgacctcaagtgatccacccacctcagcctcccaaagtgttgggattacaggcatgaaccactgtgcccaggttacagatatgtgttttggtttttcgttctttttttttttttttgagacaggttctcactctgttgcccaggttggagtgtagtgacaccatcataactcactgcagcctcaaaatcctgggctcaagtgatcctcccacctcagcctccccagcagctgggactacaggcatgtgctaccacaccaggctatttttttttcctttggcaaagatgggggtctcactatgttgtctcggctggtctcaaactcctgggctcaaaccatcctcccgccttggcctcccaaagtgtggagattacagatgtgagccaccatgactgacttattttgttctttaatacataacttataggccgggtgaggtggcttctgactgtaatcccagcactttgggaggctgaggcgggtgtatcgcctgaggtcaggagtttgagaccagcctggccaccttggcgaagctctgtcgctactaaaaatacaaaaattagccaggcgtggtggtgggcacctgtaatcccagctactcaggaggctgaggccagagaattgcttgaacccaggaggcggaggttgcaatgagccgagattgcactccagtctgggcaacaagagggaaaatctgtctaaataaataaataaataattaattaaaaaataactaatacaacttggttggggcggggtggggggatgaaaatacacataattaagaggaaaaaaaagtaaagaaaacaagcctactgataatccttcatctacagacaaccaccttggatgatctgggaatgcccacccagactactcttttcttttctttccttttctcttctgttctcttctcttctcttctcttttttcttttcttttcttttctcttatttgatggggtctttctctgttgcccaagctggagtgcagtggtgtgatcagctcagtgcagccttaaactcctgggctcaagggatcctcccatctcggcctgagtagctgggactacaggcaagcaccaccatgcctggcccacacagactactttctaaaaatgtataaacatatatagatatgacaagatatacagataatgatacatatgatttgatacttatgctaatttttttacatatactttgtaaacacttttgtcatggcaataaatacacatgttcacctggtgtgtgtatatgtgtgtgtttcattgaaaagctatactgggtggggccaggtgcagtggctcatgcctgtaatcccagcactttgggaggcagaggtgggtggatcacttgagcccaggaattcgagaccagcttggacaatggccagaacagatctctacaaaaatttaaaaattagctgggtgtggtggtgtatgtatatggtcccagctattggggaggctgaggtggggggattgcttgagcctgggaggttgaggctgcagtgagccatgattgcaccactacactcaagcctgagtgacagagcgagaccctgtatcaaaatgaaaaaaagaaaaaaaaaaaaaaagaaaggctgtaccatgatttcttttttctttctttctttttttttcagatggtgtcttgctctgtcgcccagactcgggtacagtggcatgatctcggctcattgcaacctctgcctcccaggtttaagagattctcctgcctccgcttccctgggattacatgcgcccaccatcacacccagataatttttgaatttttaatagagatggggtttcaccatcttggccacgctggtcttgaactcctgacctcgtgatccacccgccttggcctcccaaagtgctgggattataggcgtgagccaccatgcccggcctgtaccatgatttctttaaccagctcctagaatcaagcattaccaagatcttcccattagaaacagcatggatggtgatctagctcatttgaatgtagagtttaatgctctttaacaattgctttattaaattactctgaatttatattaataagtatcttattactattttatgttttgtagagacagagtcttgtcatgttgcccaggctagtctcaaacttctggcctcaagtgattctcctgcattggccttccaacatgctaggattacagacatgagccaccatgccaggcagtatcttattattgttattattttcaagggtctcaatctgtcacccaggctggtgtgcagtggcgtgacctcagctcactgcaaccactgcctcccaggctcaagcaatccccccacatcagcctcccaagtagctgggactacaagtgtgtcccaccacgccaggctaattttttgtatttttagtagtaggatttcgccatgttggccaggctggtctcgaactcctgacctcaggtgatctgcccaccttggcctcccagtgttgggattacaggcgtgagccaacgtgcacaacccagtatcttatttttaaaaattactttctgctctgctccacgctctgcccaggtactaaatattaacaccctcacaggtataactgcttccctttttccattctatgggggagttgactttactgaataaaaataggatgatttactatgtgggtctctgcatcttacttttccaaatgcttaattattggcaactgtggtggatattcctttagcccctccaaatctcttccctccctgcccttctctgtgccccaagccttatcaccttcagccaacctgagaccctggcaggaaaggagaggagagacaagtgggggtatctcttccttggcttcctccctgccagacgttgttttagcagctgttttagcagcagctatgtccctgtactgaaggccacactcctgttgggtgactacaactctctctaggtttccaaaccctcccttctcttgcccctttaggcttaaggggtggggtaagagaccccatgctcaccagccccaggtggcttcattatccttatctgctcccatgactttgtttttttgtttgtttgtttgttttgttttgagatggagtcttgctctgtcgccagtctggagtgcagtggtgcgatcttggctcgttgcaaactccgcctcccgggttcaagcgattctcctgcctcagcctcccaactagctgggactataggcatgtgccaccatgctcagctaattttttgtatttttaatagagacagggtttcaccatgttggccaggatggtcttgatctcctgacctcatgatccgcccacctcagcctcccaaactattgggattacaggcgtgagccaccgcgcccaacctaattttcgtattttcattagagatggggtttcaccatgttcgccaggctggtcttgaactcctgacctcaggtgatcctcccgcctaggcctctcaaagtgctgggattacaggcatgagccactgtgctggcctgattaagcaactaatttacaattcttaaaaacttttagggggccaactcatgagcgagcctgccacctttatggctgtcagagtccagacccttgttttatagattcaggaaacgaggggaggatttgtcgtttgtaggattcctgggccagagtgaggtgaaacatggaaagtgtggtggtcctcaagtcaggcagtatgaattctgaccaaccaggtctcgccagggatctctagttccctggctctatttcccatgtgtttgtctcttggcctacctctcgttctgaaatgaagatgagcaagatgtgaaagcttgagagaggcaactgaagttctcctagatcttggcagctttctaaaacaaaggttttgctgggctgtctgtggccactgcagggaagatgaaacagaacaactggaaaggggaaagacagctctctcagactgttcccttgcaatcctcaaacagtccaacatttgaagataaacaagcctcagtccacattctctaagaatctccagtgcatgggacagacaggtaaacatgcatttacaataccaagtgaaaagtgcagaaaacagcccagctgtggggtgggacacataatgatttccagggaggtagtatttctttttctttttgtttttgagagggatctttttctttttgtttttgagagggagtcttgctctgttgcccaggctggagtacagtggtgtaatctcagctcactgcaacctctgcctcccagcttctcctgcctcagcctcctgagtagctgggattacaggcacctgccaccaaacccaactaatctattttagtagagatggggtttcaccatgttggccaggctggtcttgaactaccgacctcaagtgagccacccgcctcggcctcccaaagtgctgggattacaggtgtgagccacctcacccagccttgagctggatcttgaaggagaggttcaagtcagcctggcctgagatggtgttccagggtgggaagagcaggtgctaagacccagtgctaagagagactgagcaaaaaacgtgccagaaactgttagaagttcagcatggctggagcataagttgtgtgtgtgtgtgtgtgtgtgtgtgtgtgtgtgtgtgtgtgtgtgtgtgtgtgtggtggggtacagggatgggaggtggtctaaaggcaagcagagatcaggagtcttaaaggccaagagaagggcactgaagccattaagcagtagcgtgccaatgtcactcttgggaaggttgttctggctgctttggagactgggttaaagtgcgcaacctgagacagttcaaagactgcccaatcaggaggaagaggtggcggggtaggagtagaggtggaggagatgggtggatttgggagctatgaaggcagtcacaggatagaggtttattataatgacagcaatattgacaagctcataatgtagtaacctaacaacagctctcttttcagaccgcatgggtaagaatcttctcctcaccctttttatttggaaaaatttcaaacctcagaagaactgcaagatagttcccccacacaaccaacttttccttttccttctttcttttttttttttttttgatagaaactgggtcttgccacgttgctcaggctggtctcaaattcctaggatcaggggatcctcccacttctgcctcccaaagtgctaggattatagccatgagctgcctacaaaagtttccttgaacatgcatatactcttcatgtggatttgctaattgttacattttgcctctttctccccttgtatcattttctttgaaccacttgcaagttagtagctgaaaccatgacgctacacatctaaatatttgagcatttatctccttaccataaaaagagtttctttcacataattgcaacatcattatctgactgaggaaacttaacactgatatactataatttaatataaagttcatatttagatttcatcaattggcccagtaagtcttttaaagccgctgtttctcattaataattcaagtaaggatcatgtattgcatttagtcatcgtttctcttttcctctctttttttttttttttttgagacggagtttcgctctgtcgcccaggctggagtgcagtggcatgatcgccgctcactgcaacctctgcctcaagcaattccccggcctcagcctcccaagtagctgggattacaggtgtgtgccgctgtgcccggctgatttttgtatttttactagagatggggttttactatgttggccaggctggtctcaaacccctgaccttatgtgatccacccacttcggccacccaaaatgccgggattacgggcgtgaaccatcatgcctggtcctccgctaattaatttttttttttgtagagacgtaagtcttgctatattgcccaggctggtcttaaactcctggactcaagggatcctcctgccttgatctcccagagatataggactacagacatgagccactgcacctgtatctctctctctctctcttttgacaatgttagaaatgttagtttatttttctaccttttctctttttttcttctttctgtttaaagtttgttttaaaattttatcttgaagtggttttaaactcacagaaaagttccaaaaatattataaagaacatttatatgtttcaccaattatttacattttgtaaatgtaaataatttacatttacaaataatttacagagtcaccaattattaacattttgccgtatttactttatctctctcttgtctacaaatatatatctctttctttttcttgagacggagtctcactatatggtccaggctggagtgcagtggcacgatctcggctcactacaacctccacctcccaggttcaagcgattctctcctgcctcagtctcccgagtagctgggattacaggtgcctgccaccacgcccagctgatttttgtatttttagtagagacggggtttcaccatgttggtcaggctaatctcaaactcctgacctcaagtgatccacccccctcagcctcccaaagtgctgagattacaggcgtgagccaccatgcccggccttacatatatatctgtattttttttttttttagatgaagtcttgctctgtcgccaggctgtagtgcagtagcaccatctcggctcattgtaacctctgcctcccggattcaagtgatcctcctgactcaatctcccgagtagctgtgactacaggcatgagtcaccacgtccagctaatttttgtatttttggtggagacagagtttcaccatgttggccaggatggtctccatctcttgaccttgtgatccgcccacctcggtgtcccaaagtgctgggattacaggtgtgagccaccacgcccggcctatatctgtattcttttctgaaccatttgaaagtaaattgcctctcttaaccctaaatactacagggtactttttctaagggcactgtcttacaaaaccacagtgaaagtatcaaaatcaggaaattttcagatatcaagggtgggaggatattacaatttttttaaaaatcaggaaatttggccaggtgcggtggctcacgcctgtaatcccagcacattgggaggctaaggcgggtggattgcctgaggtcaggagttctagaccagtctggccaacatggtgaaaccttgtctctactaaaaatacaaaaaaattagccgagcatggtggcatacgcctgtaatcccagctactcgggaggcaggggaattgcttgaaccagggaggtggacgttgcagtgagccgagatctcgccactgcactccagcctgggcaacagagccaccacgcccggataatttttgtatttttagtagggacaaggtttcagcatgttggccaggctggtcttgaactcctgacctcaggtgatccagccgcctcggtctcccaaaatgctgagataacaggcgtaagccaccgcacctggccacatattgcatttagtttttttttttttttttgagatggggtctcactctctcgcccgggctggagtgcagtggcacgatctctgctcactgcaagctctgtctcccaggttcatgccattctcctgcctcagcctcctgagtagctgggactacaggcacgtgccaccatgcccggctaaatttttgtatttttagtagagatggagtttcaccgtgttagccaggatggtctcgatctcctaacctcatgatccacctggcttggcctcccaaagtgctgggattacaggcgtgagccaccgcgcctggcctagttttttttttttttttttttttgagacggagtcttgctctgccgctcaggcagtgagccacctgccctggcctcccaaaatgctaggattatagccataagcagcttacaaaacagttttcttgaacatgcttatactcttcacgtggatttgctaattgttacattttgcctctttctccccttgtatcactttcttcggaccacttgcaagttagtagcagaaatcatgacactacacatctaaataattgagcatttatctcgttccaataaagataaaagtgattctctcatataattgcaacaccattatctgactgaggaaatttaacactgatatactataatttaatataaagttcatatttagatttcaccagttggcccaataagtcttgtaaagctgctgtttctcattaaataattcaagtaaggatcatgtattgcatttagtcattatttctctcttcctccctttttaactttattatttatttatttatttgagacagagtctcactcggtcactcaggctggagtgcagtgacatgatctcagctcattgcaacctctgcctccccggttcaagcgattctcctgcgtcagcctcccaggtagctgggattacaagtgtgtggcactgtgccttggtaacttttgtatttttagtagagacggtgtttcaccatgttggccaggctggtcttgaactcctgacctcaagtgatccacccacctcagcctcccaaagtgctgggattacaggtgtgaatcaccacacctggtcctctgctaattaattattatttttttttttttgtagagatggaggtcttgctatgttgcccaggctagtctcaaactcctggacctaagggatcctcctgccttgatctcccagcataatgggactacaggtatgagccactgcacctgtatttctctctctctctctctcgataatgttagaaatgttagtttatttttgaggggtgcggtagctcactcctgtaatcccagcactttgaaaggccgagctgggctggatcacttgaggccaggggttcgagacctcagcctcctgagtacctgggattacaggtgtgtgccaccacacccggctaatattttatatttttggtagagacagggtttcaccatgttggcgaggctagtctcaaactcctgacctcaaatgatctgcttgccacagcctcccaaagtgctgggattataggcatgagccaccacacctggcccattgcatttagttgatgcacatctttagtgttcttaaatctaggcaattgcatatccgcctcctttctctgtcccccaccccttattccccatgtgtatttcacaacattgactttttttgaagttttcaggccagttgttttgaagtatgtcccttcttttggatatgtctgttttccaatgattagattcagggcaaacatgtttgaatactacacagatgaccgctgagcccttttcaagacaaaatattagaggcacatggtcagatatcaaagttgattgtttaggtaagctgggttggaattttggcctcacattttgctagttgggtaaattggttattgagacggttttctcagctgtcaaattgggatgtaataatctagcttcatgaggttgttgaattaatatatgtaaggcatttagaacagcgtctggcacattataagtatcaataaataaacactgttaccgttattattatcactacgatttttagaggccttaacaggaacatccagcaccttcaacagtatatggctcataggaatcattccatgaatatttgttagcagaaggacagctctatgagatagattgctatcaattactgccccattttacagatgaggaaactgaggcccagagaagccaagtagtgacctagggtcacacagattgccgttaagtggcaagatacggggtgtgtactcaggcatatcggatctgtaaagtgagggataaggaaccttaatgtattttgtaaatcctccagggctgtgtggatgtgaagaactgaattggagcgccacgcagcggttctctggcgtacagtatccatccatacagtaggcgctcaataaatgtctgctgcacgaatgagaaaatgagtcagctggggcgagatcatcccctagcgttggtgtgcaattgcgtggggatccattgcttccgacgctactcctgccgggtcaccacaggcgcacgtgttccggcagggcgcggcttccggtgacccagctccgccctaagccccatcccaagccccgccccttgactgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgtcgtgactgtcagcgacgtccaggagctgatgcggcgcaaggaggagatagaagcgcagatcaaggccaactatgacgtgctggaaagcgtgagtgtgggttcggggcgccccaagtcgcctaacccggcccggagtccctggggtactgggatgccagggcggcctcagtttgggcgctccgcaacggatctccctgggaggcccaaggcgccgcaagtgcggcctctgtcggcacaagaaggcaggcaaagaactttagcaactgaagagttagccatattgatatccagcaagagtttgtggagccctgctgtgtgctaggcgctggtttaagtgctgtgcattgttgagttaatttaatctttgcaacaaccctttgaggtggatgctgttactctttccattttagggagggggaaacaggtgttacttggtgattaaacagctgtcatgtgcctcgctgactgccttatcttaattttgtactttttgtaaagacagagtctcactgtgttgcccaggttggtatcgaactcatggcctcaagcgatccttccacctcggcctttcaaagtgctgggattacaggcgtgagctactgcacccggcatttgctgattgtatcgtgaattcttaaacttcagtgtgtatatgaattacctggggatcttattaaaatgcagattttgtttgaggcaagggagcagattctgcatttgtagcaaactcccagcaatgctgatgctagtggtctaaggaccgaactttgagttacaaataaggctcatcatccttattgcataaggaggaaactgaggcccagagtggggcaaacgcctatctaaggtcatgtagttcggaagtggcagtggtgggtctggctcaaaagctgatgcaggttttcttatgccatctagtgtaaaatcacagatcagtttgcagaggaagatgcaattaattatgcccaagtagggtgggatggaatgcattttaggtgatgtaagatgaagtttcttttttttttgtctgagacggagtcttgctttgtcacccaggctggagtgcagtggctcaatctcggctcactgcagcctctgcctcctgggttcaagtgattctcctgcctcagcctcccgagtagtagggattacaggcgagcgccagtacgccaggctaattttttattttaagtaaaagcagggtttcaccatgttggtcaggccggtgttggattcctgacctcaggtgatccgcccaccttggcctccccaagtgctgggattacaggcgtgagccaccgcgtccggccataagatgaagtttcatacggagggccagagaaccattttactgggtgctgactatatgctcaaagtgggattcagacttcaggtctgttacattcagaacctgtgctttcaagcaaattaccagcaatttctcaaactttagtttactttctaccacatgcagtatactatatgcatataccacttgtgttattcctttgatatttttatttaaatagatctacttttaatcttatataaatgtattattattgttattattattattgagacagggtctcgctctgttgcccaggctggagttcagtggcaccatcttggttcactgcagcctcaatctcctggtgtcaagcaatcctcccacctcagcctcccaagtagctgagactgcaggtacgtgccaccacgcccagctaatttttgtattttttgtagctatggggtctcactatgttgcttgctcagactggtctgaaactcctgggctcaagcagtcctcctgcctctgcctcccaaagtgttggggttacaggcatgagccacagtgccttgcccataaatgtattttaaaaggaaatttcaaaactccgctgcatatggaaaatgataatctcttctcttaaatataaggtcagatgctttgcatgttgatacggcatgttggttgcttctggctagctgctgttgcttgctgaaagctttcagcctgaaaccgtgctctatatttgtttttaaaaagtgggtttgggccgggcctggtggctcacgcctgtaatcccagcactttgggaggccaaggtgggtggatcacctgaggccaggatggtctcgatctcctgacctcgtgatccgcccgcctcggcctcccaaagtgctgggattacaggcttgagccaccgcgccaggcctacaaaaaatttttttaaaaattagttgggcgtggtggtgcatgcctgtagtcctagctacttgggaggctgaggcaggaggattgcttgaaccctgaatgttgaggctgcagggagctataattgcaccactgcactctcttgtgggtgacagagtgagatgctgtctctttaaaaaaaaaaaaaaaaaaaaggccgggtgcggtggctcatgcctctaatcccagcactttgggaggccgaggcgggcggatcacgaggtcaggagatcgagaccatcctggctaacacagtgaaaccccgtctctactaaaaatacaaaaaattagctggacgtggtggccagcgcctgtagtcccagctactctggaggctgaggcaggagaatggcctgaacccgggatgtggagcttgcagtgagccaagattgcgccactgcacttcagcctgggtgacagagcgagactccgtctcaagaaaaaagaaaaaaaaaaaaaagactgggcatggtggctcacgtctgtaatcccagcactttggaaggccgaggtgtgtggatcgcttgaggtcaggagtccgagaccagcctggccaacatggtgaaaccccgtctcaacgaaaaatacaaaaattagccaggtgtggtggtacacatctataatcccagctacccgggaggctgatgcaagagaatcacttgaacctgggaggcggaggttgcagtgaaccaagactgcaccacgacactccagcctgggtgacagagattccatctcaaaaaaaaaaaaaaaaaaaaaaagaagtggacagctaaaactataaatctcgtataataaagcataggagtaaatcttcatgaccttggattaggcaaagcctttttagatatggcaccaaaaacacaagctacaaaagaaaaaatgataagttggacttcaactttaaaactgtgtttcaaagggcatagtaaaatgaaaagataagctccagaatgggagaaaatatttgcatatcatttctctgataagaggatagtatctagactataataagagctcttacaactcaataataaaaagacagccaattagaagacagggaaaggatctgaataaacatttctccaaagaaaatatggtcaatacaaatggtcaatggccaggcgtggtggctcatgcctgtaatcccaggactttgggagtctgaggcaggaggatcacttgaggccaggggtttgagactagcctgggcaacacagtaagagcctatctttacaaaaaattcaaaattaaaggccgggcatggtggctcatgcctgtaatcccagcactttgggaggccgaggctggcagatcacgaggtcaggagatcgagaccatcctggttaacacggtgaaaccccgtctctactaaaaatacaaaaaaattagccgggtgtggtggcagacgcctgtagtcccagctactcgggaggctgaggcaggagaagggcctgaacccaggaggcggagcttgcagtgagccaagatctcgccactgtactctagcctgggcaacagagcgagactctgtctttaaaaaaaaaaaattaaaaattaaaaattagccaggtgtgatgacatgtgcctgtggtcccagctacttaggaggctgagacagatcgcttgaacccaggagtttaaggcggcagtgagctatgaacacaccactgcacccgatcctgggcaacagaagatcttgtctcaaaccaatacaaacacaaaagccattaccttttacactttacatgggtcagttatatggtatctgaattatatctcaataaaactgttataaaaacagagggtactagagatagcaagtaactggggtgttgcagagaccagcaccaaatggacacttttgccttgacaattgcaggattgtagagaattgggagaggaatatgtatttttgattcagggttatttaatgccgtgtgtgtgagctgctagtgttatggatcccatcctttgagaagcattatccaatgtgatattgattctcaaaggctggtcaacccttaaccactgtgggaaggcaggagcagatacaggtttttagcccctggcgcatttctgcagtgtcacggcgagtcctgtgttaggggagtgtggagaactatctccctgcgcagtggacagtaggtttgggtgtaacccggaggcttccagagagaaagggagcaaaatgaatggaatccctcttctcagtgcctgtgtacactggcagcttgtccctggactgactaatccttacagccactatttatgacttctgcgcgtagtcgttttctgaggccaccttaacaccacagagttggtgacttaaaacaggaatttactttgtcccagctctggaggccagaagtctgaaatcaaggtgtcagcagggttggctccttctgcaggctctgagagagaagctcccaagcctttctcctggcctctggtgactgctggcggtccttggcctacagctgtgtcacttgaacctctgcctgcatcttcatgtggccttcctcctgtgtctgtcccacacctacctctgcctttcttttatgaggacaccagccaccagatgagcttatctcgagatccttaacataattacatctacaaagactctttttcaaataaagtcatatttacaggttctgggggttagctcgtggttatctgtttttgggggccgctcttcaacccactatgctgtgtatgcgcgtggcatgtgctaagtactctgcaggtcagctcgttagttcttgcagcaggtagggagggaggcgagtgctcctattcccattttataattgaggaagctgaggcttagagaggagaaggtctcagctaaggatgcccagcttgtacatggcagagttgagattcaaattaaagtctaaccaattgcaaagcccctcccctgaaccatgtgactggtttcactgcttttgtgtactctcctctgactcatgttaaaaaaaaaaaaagtgttgttttgaataaagaatacattcccataggcaaaattcaaaacctacagaggggtataaaatggactgtctctctccctgccctgtcacctagccacccagttcttctccccggaggcagctggtgctatcagtttccttcttcagatctttttattttcagaagaatcaaagccctgccacagctgggtgctgtctgggcttttcactcccctctagcttccagggccagcagccaggtgtcagccacctgtgggaaggagggtgtgaaggagtggaggaagaggctggccttggggatgatgctcaaaggagtctttggttttatcggcactgttttaacttcaaaaaagaatggattcatgcattacttgcgtcgttaaaaataaaaaatgaaaaacacagtgcccaccccagggtagttgtgagggcatgagtagagcccctggtgtaagtgatcagtatgtggcagttttcattactgtcacctttattatgacttcagaggagaagggtctggggaaagacatcctggggacattacacccatgagcaccttttaaccacgtttctttcctccagcaaaaaggcattgggatgaacgagccgctggtggactgtgagggctacccccggtcagacgtggacctgtaccaagtccgcaccgccaggcacaacatcatatgtgagtggccctcttagaagactttccccaccttgtggtgggaaggtgttaaaggcatacaaataaaaccaactatctgtattatctactgccttctcttctgccttgatgggattgtcttgtccccatccaaggactgagaaccaagggaatgggctagactctaaggttctatatttctggtttcattttctctctctctctctctctcttttttttttgagtcagggtcttgctctgtcttccaggctggagtgcagtggtgctaacatgactcactgcagtctcaaccccccaggctccaagtgctccttctgcctcagcctcccaagtagctgggactataggcatgtgtcgctgtgcctggctaattttttttagtagagacgagtctcactaagtggcccaggtgagtcttgaactcctggactcaagtggtcctcctgccttggccttccaaggtgctgattgtttttaattaaagagctagcagagagtacagattggatagtatatttgttttctgtttctgccataacaaatgacgtgatttgtttttaattaaagagctagcagagagtacagattggatagtatatttgtttctgtttctgccataacaaatgaccacagacttagtagctggagataagaagtccagatgggtctcactggactaaaatcaaggtgttggcagggctggctccttctggaggatctaggggagaacctgttcctggtcttttctggtttccaaaggctgcccaccgtccttggctcatggcttcgtccatctacacagccagcagtcgcatttccctccctctgattctgtcataacatctctttctctcactctcctgcctccctctttcacctataaagacctctgtgatgacaccaggcccacctggataatccaggatcatgtccgaatcttaaggtccttaatcacatctgcagagcctcttttgccatgtaaggtggcatattcccagcttctaggggctaggatgtggatgtgttgggggccattatccactcagccataggtaggcaaccgtctccaccacagagtcctattagcatttatcctccacatttttcacttactaactcctctttaatctgtttgaatcttgattccatctgcatcacatcttatttatttatttattttttgagacggagtctcgctctgtcacccaggttggagtgcagtggcacgatcttggctcactgcaacttccacctcccgagtgacagagcaagagaccgtctcaaaaaaaaaaaaaaaatctgtttgagcaattccttattggtctttttttgaaaaatctgttctcggccgggtgcggtggctcatgcctgtaatcccagcactttgggaagccaaggcgggcagatcacctgaggtcaggagtttgagtctagcctgaccaacatggcaaaatcctgtctgtactaaaaatagaaaaattaactggatgtggtggcacatgcctgtaattccagctacttgggaggctgagacaggagaatcacttgaacccaggaggcagaggttgcaaagagccgagattacaccactgcactccaccctgggcgacagagcaaacaaaactctgtctcaaaaaaaagaaagaaaatctattctcaaaacagccctttttaaagaacagttatagatttacataaaaattggaaaataatggctgggtgcggtggctcacgcctgtaatcccagcacactgggaggccgaggtgggcagatcacctgaggtcgggagttcgagaccagcctgaccaacatggagaaaccctgtctctactaaaaatacaaaattagctgggcatggtggcacgaacctgtaatcccagctactcaggaggttgaggcaggagaatcacttgaacccaggaggcggaggttgccgtgagccgagattgtgccattgcactccagcctgggcaacaagagtgaaactctgtctcaaaaaaaaaaaaaaaaagaaaagaaaaaaaaattggaaaataatgcataggtcctttggcttctgtatgtaatctcccgtgttgttaacagcatatatacacatacatgtgtatatatctacacatacatgtaaatatatacacacatacatgtgtatgtaaaatatacacatgcgtgtatatatgcaaaatacacatatgagtgaatgactcaggctgggtgtaaccaagatttcacttttctctgaaatcctctagaaggaaaaatgctgcataagctgggcacagaggctcatgcctgtaatcccagcactttgggaggctgaggcctcccaaatatatacacatgtgtatacacacaggttcaagtgattctccagccttagcttcccaagtagctgggattacaggtgcccaccatcacaccggactaattttttttttttttttgagatggaatcttgcttagccacctaggctggagtgcagtggcatgatctcggctcactcactgcactcaccatctcccgggttcaagtgattctcccatctcagcctcccaagtagctgagattacaggcatccgccatcgtgcccggctaatttttatattttagtagagacagggtttcaccatgttggccaggctggtcttgaactcctgacctcaggtgatccgcccgcctcggcctcgacaggcgtgagccaccatgcctggcctaattttttagtagtatttttttagtagagacgggatttcaccatgttggccaggctggtctccaactcctgacctcaggtgatccgcccgcctcggcctcgacaggcgtgagccaccatgcctggcctaattttttagtagtatttttttagtagagacgggatttcaccatgttggccaggctggtctcgaactcctgacctcaggtgatctgcccgcctcggcctcgcaaagtgctgggattacaggcatgagccaccgcgcccagctaacagcttatgttaatatggtacgtttgttataattgcaaatttgttttttgaaatacactgcagaaacattttgtactgaaaaaaaccctttcaacattttgattagaattgtaatatgttgtaaatagtcgttcgttccattccccaacagctgtgtattgagcacttccctgtgccaggcattgcagagtctagggatgctgtggacctcactgggggagggcttttctagtgaaagtgaccatgtattatgtaagtctgcctcccaagtgcatgtctccacttgttcagatctgggttcttttcccacatctgctcctgtgggttgagaacttgaatcccttcatgactgagggtcttgcctttgctccaaagtgacagtggcagaggaggcaggtcaggtagtaccgcaatcccactgacaggcacaaggtatcaaaataccagctgctgtgctggcgtggcctgcagattgccatggtggttcacaacattttgaattagctatctgtactgaaaaatcagagaatttcacttcaaagatcccaattttcagcttttctggaaaaatcaaagattttgtagcattgggtcttcctcccaaacccagccaattggcaagagccctgtagcaggggtgccctttggccacctccctgtggactccctctcctggactgaatgtctccaggattactaggcttatgcagcactttttttttttttttttgagacgaattcttgctttgtcgccaggctggagggcagtggtgcgatctcggctcactgcaacctccacctcctgggttcaagtaattctcctgcttcagcctcccaagtagctgggattacaggcacccgccaccacgcccagctaatttttgtttttgttttgttttgttttgtttttgagacggagtcttgctctgttgcccaggctagagtgcagtggcgcgatctcggctcactgcaatctccgcctccctggttcacgccaatctcctgcctcagcctcccgagtagctgggactacaggcgcctgccatcatgcccggctaatttttgtatttttagtagagacggggtttcaccgtgttagccaggatggtctccatctcctgacctcgtgatccggccaccttgacttcccaaagttctgggattacaggcctgagccaccacgctcggcctaatttttgtattttttagtagagacggggtttcaccatgttggcaaggtggtcgcgatctcttgacctcgtgatctgcctgcctcggcctcccacagtgctgggattacaggcgtgagcctctgtgcccggcttatgcagcatttttccttctagaggatttcagagaaaagtgaaatcttgattacacccagcctgagtcattcattcacatgatcacagcgctggcccctcatacatatgcctttgagttcatggctgtggattcagctggttgttaccttccttctgctcacctctcagggctcacccgagacagcactgccttcaggaagccttccctcatatcctagactagcgagggcagactttgctgctggccaggcctccctgcagtcatcagatgttattgtaattacttattctggagctgctccttgcaggactgaatgctccatgagggaatgtcctctgtcttggtcagagactccttctcacctctagctccacatctggcatgtaataagcacttgttaactcttcagtgaataaatgtaggagtcttgtgtcctccactgtcttccttggcccctgatgtgtggttctcatcccaggcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcggtaatccaggggttggccactcaagtccatgcccaggggacacggtgggtcaggtagccttcggggatgtggaaagacagactagttctctccgtgctgcggtgctgagttcagttactcatttaacaaacactgactgaggcctgtcgtgtatccagccctgtgctgggggcagagttttagagaggggtcagccccggctgcccactacattggtgggggagtgacctcttcccagtgacagaagatgataaatgtcccaagagagggagaggatctcttcttggggctcattttagctgggcactgaatgatgaaaatgagaatggcatcttgccaaatgagttatgcatcttatgtggtgtcttaaaaaaaacattaggctgggcacagtggctcatgcgtgtaatcccagcacttgagaaggctgaggcgacttggaaagctgagatgggaggatcacttgggctcaggaagtcgaagttgcagtgagctgtgactgtgccactgcactccagcctgggtgacagagtgagaccttgtcttaaaaaaaatttttttttgaccgggagcattggctcacgcctgtaatcccagcatgttgggaggccgaggccagtggatcacttgaggtcaggagttcgagaccaacctggccaacatggcgaaaccccgtctctactaaaaatacgaaaatcatgccactgcactccagcctgggcaacagagtgagactccgtctcaaaaaaaaaaaaaaaatttacccatttaaagtccgtatacagtttagtgtcttttggtgtattcacagagccatgcattaccacaatcaattttctttctatttaaaaaatttgcagccaggtgcagtggctcacgcctgtaatcccagcactttgggaggcttaggtgggcgatcaccttatgtcaggagttcaagaccagcctggccaacatggcgaaaccccatctctactaaaaatacaaacattagccgggtgtggtgacatgtgcctgtaatcccagctactcgggaggctgaggcaggagaatcgcctgaacccaggaggtggaggttgcagtgagcggagatcgtgccactacactccagagcctgggcgacagagtgagactctgtctaaaaaaaaaaaaaaaaaaaaaaggagatggggtttcgctctgttgcgtaggttggtctccatctcctgggctcaagtgattctaccaccttggcctcccaaaatgctgggattataggcatgagccaccatgcccagccataatcaatttcagaacattgtcattgtcttgtaaagaaactctgtagtgatttgccatcacttcccaatcccccagctccccgcacccagttatctactttctgtctctatgtatttgtctattctggatatttcctataagttgaatcatataatatgtgaccttttatgactggcttctttcacttagcaaattttcaagtcatctgtattgagcatggatcagtgcttcatttgtttacagacagggtctcactctctcacccagacttcagtgccatggtgccatcatagctcactgcaacctcaaactcgcagagtcaagtgatcctcctgtctcagcctcccaagcagctaggactgtaggcacatgtaaccatgcctggttaattttttatttccttttttttttagagatgggttctcactatgttgcccaggctggtcttgaactcctggcctcaagcgatccttcttcctcggcctcccaaagtgctagaattacaggcatgagctgtcatgcctggcccttcattccttctttttttttttttttttttttttttttgagacggagtctcgctctgtcgcccaggctggagtgcagtggcacgatctcggctcactgcaagctccgcctcccaggttcacgccattctcctgcctcatcctcccgagtagctgggactacaggcgcctgccatcacgtccagctaatttttattttttgtatttttagtagagacagggtttcactttgttagccagggtggtctcgatctcctgacctcgtgatccgcccgcctcagcctcccaaagtgctgggattacaggcgtgagccactgtgcctggcccttcattcctttttatggccaaataatattccactgcctggatatatcatattttatttatccatttgtcagttaatggacatttgaattgttaccactttttggctattacgaagcatgttgctgcgaacattcttgtacagtttttttgtggagatgtagttaaatttaattccacagccacttctgggataggtcctaatctttactcatttcatcctcgaggaaaagccttgcagacctgaagtaacttatgtcaggacacatagttcctgccaggtggaatggggtcctaaaccctggtcaggacacatagttcctgccaggtggaatggggtcctaaaccctggtcaggacacatagttcctgccaggtggaatggggtcctaaaccctggtcctaccagtcttctttaatggtcacaagtctgtaagttacacagaagctccctatcattcactaccccatctactgcatctaacccagtgccagttggcccacaacaaatacttgttacaggggtgaatgagtggtggtctgtcttcttaggacctagaacaagagcgtcactctagtcttggatgcgccctgtgcctgtggctgcttgtctgggggcttctagggcaagtgtcttgtctaaatgttgatcactgaataaaatgggcccagcctggcttgccttctcttacccttgaacctgggttaggaccgcagagagcagcatttggcctttcccatgctcctcaaggccttcacagtgtctggtaactgccagctctcagacattgggcagacctggtcatctttactagagctgccctcaaaggaaccccaggaggaggtggccccgttacccactgccccttcctgcatgaggtgtctacatccctgacctctttgttctgagcctaccctgtagaaaacaagctcgtgaccttggcattaaattgggtattgaaggttagagaccaccaggagcacactgaacctctagcctgattttccatttttccttccctctccagggtctgcaagtggatgatgagattgtggagttcggctctgtgaacacccagaacttccagtcactgcataacattggcagtgtggtgcagcacagtgagggggtgagtggggctacctggtgtctcggtctgtttgggtttttctaacagtatgccatagactgcgtggcttacaaacaacagaagttcatttttcacagctctggaggcagggaagtccaagatccaggcaccagccaatttggtgtctggggagggcttgcttcctaactcctaggtggtgccttcttgctgtgtcctcacatggcagaaaggggaggaaccctgggagctcttgtataagggcactaatcccagtgggggcgccacccctcatgacctaatcaccttgcagaggccccacccctaataccatcacattggtggttaggatttcaacatatgaatttcagggggccacagacattcaggtcatagcactcggcctctggtctatagccctggagttactggaagtgttgctgaggccctggactgctgccttcatggtgttgctcagcacagccccattcaaggacttggcacctgctattccttctgtttagaatgctcttcctcttcatcctccttctgttttacactggtgacatgctcgcagggggcctttcctggctaccctaacccaaattcccctctcctctgccctgtctctgttttcatttaacaaggtttcttagagatcttttcttttttttttttttttttttaagacagggtcatgctgtgtcacccaggctagagtgtggtggtgctatcataactacctcacggctaatttttttatattttgtggaggcggggtcttgctatgttgtccaggctggaatttttgttgttgttttgtagcaaagatccacacttttcaggagtgatactgtggcaaagcccaggaaaattattaactaaagtttttggttcccaaatgaagtctccagttaacccaacagttgtggattttttgactcctgcttagctgcacggttcatctacttgtaacccatcagtgcaggccaggccaggtcaggtcaggagatggctggcagttgcctatgcccctgctagtggtcaggccatcgtttctgcactgatactgtcatcaaatctgtaacttgtatggacgtttaaaatgatgattttgtgaaatttatcagtttttttgcttatggctcttgcattttgtgtccatttaaagaaattcttttttttttttttaattaagaaattcttggctgggcgtggtggctcactcctgtaatcccagcactttaggagggcgaggtgggtggatcacgaagtcaggagttggagaccatcctggctaacacggtgaaaccccgtctctactaaaaatacaaaaaattagccgggtgtggtggcacacacttgtagtcccagttacttgggagactgaggaaggagaatcgcttgaacccaggaggcagagcttgcagtgagccgagatcgcgccattgcactccagcctaggcgacagagcaagactctgtctcaaaaaaagaaattcttttaattcttttattgttttatttctgtttttcctttagtccatctgaaatttattattattattattattattattattattatttgagatggagtctcgctctgtcacccaggctggagtgcagtggtgcgatcttggctcactgcaacctccgcctcccaggttcaagtgattctcctgcctcagcctcctgagtagctgggattacaggcgcccaccaccatgcctggctaatttttgtatttttagtagagatggggtttcgctatgttggccaggctggtctcaaactggcctcccaaagtgctgggactacagatgtgagccactgcgcctggtctatttttattatttttacaacagttttattgagatttaatgcacatactacacagttcacccatttaaagtggtttttagtgtagtcacagaattatgcagccatcacaattgtacattttcatcacttctcctcctgaggcagccactttccagccacatgtccttcagaaagactgctcatataccagcacacagagctgccagttgattttattttattaaggtgtaatttacctgcaccagatccacctttttcagtgtacagtcccatgagttttcttctttttcttttctttttttttttttagatggagtcttgctctgtcgcccaggctggagtgcagtggtgcagtctcgggggggctactgcaagctctgcctcccaggttcacgccattctcctgcctcagcctcccgagtagctgggactacaggcatgtgccaccatgcccagctaatttttttgtatttttagtagagatggggtttcactgtgttagccaggatggtctcgatctcctgacctcgtgatccacctgccttggcctcccaaagtgctgggattacaggtgtgagccaccacacccagccgagttttcttttttttttctttaagatggagttttgctcttttgcccagtctggagtgcagtggcacgatctcggctcactgcaacctctgcctcccaggttcaagcgattctccagcctcagtctcccaagtagctgggattataggtgcccaccaccacgcccagctaatttttttttgtatttttagtagagacagggtttcagcatgttggccaggctggtctcaaactcctaacctcaggtgatccacccacctcagcctcccaaagttctgggattacaggagtgagccactgtggcctgccattcccgtgagttttcacaaatgtatgtagtatgtcattgccaccacgatgaaggtcaagagcattccaacaccccataaaattgcctcaggcttctttgtagttaatccctcaccgtcaacttccagaatgtcatagagagaaaaaccacacaatatattgccttttgagtctggtgttcttcactcagcccagtggattctgagacttctgtctgttgtgtggatctgtgagaagagctgctggtttttaatctgttttatccagttaaatgtattctcagcttccgtgtaggcttataaatccttctttataaaagtagtgattcaattttaagcaaaatgaatcttttcttcatgtgaaatttcacggggaattccaagatgtcactggataaaggctgagctgtcttggtgggctggaggatggagaaggtcgtgtgttgtgagtagggcctttctggcttcagcctcatcccctcaggggacctgagctcagctggagaatcaagaatccgggtttggttgtctgttttgtgagtcaagaaaaaaaaccttgcatagcacagtggctcacacctgtaatcccagcactttgggaggctgaggcgggtggatcacctgaggtcaggagttcaagaccagcctggccaacatggtgaaaccccatctctactaaaaataagaaattaggcctggcacggtggctcacacctgtaatcccagcactttaagaggccaaagtgggcagatcacaaggtcaagagatcgagaccatcctgcccaacatggtgaaaaccggtctctactaaaaatacaaaaaaaaaaaaaaaattatctgggtgtggtggtgtgtgcctgtagtcccagctacttgggctgctgaggcaggagaatcacttgaacctcggaggcagaggttgcagtgaaccaagatcacgccactgcactccagcctgggccgcacagcgagactctcccatctcaaaaaaaaaaaaattaggtgtggtggtactctccagctacttgggaggccgaggcaggagaattgcttgaacccgggaggcagaggttgcagtgagcttagatcatgccactgcaccctagcctgggcgacagagtgaggctctgtgtcaaaaaaaaaaaaaaaaccaaaaaactcacagtgttctattgtgagacatttagatagtttgccattttgtggagattaacactcttgcagatggatttctatttctttttttattttttttgagacgaagtttttctcttgttgcctaggctggagtgcaatggcatgatctcagctcactgcaacctccgcctcacagattcaagcgattctcctgcctcagcctcccaagtagttgggactacaggcacccgccaccacgcccagctaatttttgtattttcagtagagatggggtttcaccatgttggccaggcgggtcttgaactcctgacctcaggtgatctgcccgcctcggcctcccaaagtgctgggattacaggcgtgagccactgtgcccggcctttctttgtttttttttttgtttgttttttatttgagatggagtcttgctctgtcacccaggctggagtgcagtggcattatctcagctcactgcaacctctgcctcccggcacctggccttttttagcgaacttcctacagctgggatttctagatcaaatgcatacattttcaaggggaaaagatctttaaaaaattataaatgactgctgatggataatggatttctttttgggtgatgaaaatgatccagaattagatagtggtggttgtttatactaaatacattgaatatactgaactctgaatatactaaaactcacttaattgtatactttaaaatggtgaattttattgtatgcaaattatgtctcaatgataaaaataggctggctgcagtggctcacgcctgtgttcccaacactttgggaggccaaggcaggaggatcacttgaggccaggagtttgagaccagcctgggcaatattgtgagactgtgtctctccaaaatattttttaagaaattggccaagcatagtggcatgtggccaagctgctctggaggctgaggcaggaggatcacttgaccctaggagttcaagggtgcagtaagccaaggtcacaccactgcactccagcctggatgacagagtgaaaccctgtctcaaataaataaaatacatatttatccttaaaatcacatagtgcaattgtatttacaaacaaaagtcctagtgttatagctctaagaatttgtctaccaggttttctggtcatcgctggaaacaccctctcccctcaaaaataaatttttttttttttttgagacagagttgtcgctcttgttgcccaggctggagtgcagtggcgcgatcttggctcactgcaacctccgcctcccgggttcaagcaattctcctgcctcagcctcctgagtagctgggattacaggcatgcaccaccaagcccggctaattttgtatttttagtagagatggagtttctccatgttggtcaggctggtctcttaattcctgacctcagatgatctgcccgcttcggcctcccaaagtgctgagattataggcgtgagccactgtgcctggccccaaaataattttttaaaaagtcctgtgtctctcccttccttagtgcctcttccgctgcacatgctgggtcctgggcgaggtactggggctgtaacggggaacgaaacaaacagggtccttgccttgggagcactttggtgggggagccaggccttaatcaaataatctcagctgtataatgatacacactgataagtgttatgaaggaagagtgttaagaagctcagagagtaaatcatggggccctgatttggtttgggattgaaggagtgttcctcaggaagtgaccttcagatgtgtatagaagtttctctggtcgaggggaagctggcagggagaaaagccttcaaagcaggttcataggccctggggtgggaggatcaaagaactcaaaggagggtggagcccagagcagaatggagagaaggggaggaggtgaggccaggaggtgttaaggtcaggcctgtggtccttagtaaagattgtgctgtttttttcctgaggtgcagaagggagccaccgcacagttccagattggggtgtgacaggggtaagaagccttctctggatgttaggtagagaacagattggagggtgacagagctgtagcagtcagtcaagagaggatggtggctgtgacaaatggggtggaggaaggggtcaatcaaagagacatttagggtgtaaaatccatgggccttaacctgatggagtgtgtcaaggaggcctccaggtttccagcctgcccagggctgtcatttatagaactggaagcacacaagtgtgtccctcacacagtttccacacgtgggtgcatgcgtctacagccactgcctttttttttttttttaggacagggtctctcgctctgctgcccaggctggagtgcagtggtgcaatcatagctcactgcagcctcaaactccagggcttgagcagtcctcctgccttggcctcccaggtagctgggactacaggtgtgcaccaccacacctggctaatttttttttttttcattttttgtagagacagggtcttgctatgttgcctaggccggtctagaactcctgggctcaagtgagcctccagcctcagcccctcaaaacattcagattattaagcatgagccaccacgcctggctgtgattgctttttgacaaagatgacacagaaaaggcctaatgtacatgttactctgcatttccgcccacttcgaagggaattccttgtcggcacatttgtatcttcattcctttgaatgatcccaccatgttccattggtcggttcaccatcttttacttagccagcctcccatgttcgacatttaggttgtttccagtgtttggccgtaacaaacagtggtgtagcgagtgtccttgcctgtgggagaatttctgccatgttgctagatgtgtcattactgagttaaaggcagtgcacatttacccttcatagatcttgtcaaggtgtcctccaagaagcttgtgccagtgcaccttctctcaagtagcacctgtgagtgcgtctgtttctagctttcccaactatgttacagtctttggcaataacatagatattctttgacaatctggtaggaaatgactttttttttttttttttttttgagatggagtctcgctctatagccaggctggagtgcagcggcatgatctcagctcactgcagcctccgcctcccaggttcaagcgattctcctgcctcagcctcccaagtagctgggactacaggtgcctgccaccatgcccagctaatgtttgtatttttagtagagatgggttttcactatgttggccaggatggtctctatctcttgacctcatgatccgcctgccttggcctcccaaggtgctgggattacaggtgtgagctaccatgcccggcctatgctgtattttcttagatttagagattccattgatagacctgacatatttatttttttgtggtaaatatacataatataaaaattaccattttaggccgggcgcggtggctcacgcctataatcccagcactttgggaggccaaggtgggcggatcacctgaggtcaggagctggagaccagcctgccagcgtggtgaaaccctatctctactaaaaatacaaaattagccgggcgtcgtggtgggcgcctgtaatcccagttactctggaggctgaggcaggagaattgcctgaacccgggaggcagaggttgcagtgagccgagatcacgccactgcactctggcctgggtgacaagagtgaaactttgtctcaaaaaaaaaaaaattaccattttaaccattaaaaaatctacactttagtggcattaagtacattcacattattttgcaaatatcacccctacccatctcccatctccaaaactttttcaccctcctaaactgaaacccaaatctccattaaacactaactctccattcccactttccgcaggccctggcacccaccatcctactttctgtctctatgaatttgactactccagggacctcatctaggtgaaatcttacatactgtgtagtttttttgttttgttttgttttgtttttgagatggtgtctcgctctgttgcccaggctggagtgcagtggctcaatctccactcactgcaccctccacctcccaggtttgagccattcttctatctcagcctcctgagtagctgggactacaggcgtatgccaccaggcatggctaatttttgtatttttagtagagatggggttttgccatgttggccaggctggtcttaaactccttatctcagatgatctgcctgcctctgcctcccaaagtgctgggattacaggacactgtatagtttttgtctggcttatttcacttagcataatgtcctcaaggttcatccatgttacagcatgtgtcagaatttccttccttttaaaggctgtataatattcgactgtatgtatacaccacattatttttatccattcattagtcaatggacactaggattgcttccacctttttgttgtgaacaatgctgctttgaacatggttgtagcaatatctgttcaaatctctgctttcatttctttgtatatatgcccagaaatttaattgctgcatcatgtggtcattctatgtttaaagtttctaaaattttttttaacttcaatatatgaactttttttttttttttgagatggagtcttgctctcacccaggctggagtgcagtggtgcaatctcagctcactgcaacctccgcctcccaggttagtgattctcctgtcttagcctcctgagtagctgggattacaggcacccaccaccactcccagctaatttttgtatttttagtagagactgggtttcaccatgttgaccaggctcgcctcgaactcctgacctcaagtaatccacctgccttggcctcccaaagtgctgggattgcaggcgtgaaccaccacacctggcctatgaacattttaaaatgtcaaagatgacttccaggtttctggaatgagcttgcttatttatttatttatttatttatttatttatttatttatttatttatttattttgagacaggttctctgttgccaaggctggagtgcagtggtgtgatcttggctcactgcaatctggacttcccaggctcaagcaatcctcccacctcagccttgagagtagctgggactacaggcatgtgccaccatgcccagctaatttttgcattttgtggttttgccgtgttgcccaggctggtcttgaattcctgggctcaagcgatcccacccgtcttggcctcccaaagtgctgctattataggcgtgagccaccgtgcccggcgctttgtttaggttttggaggaccctccattactgttttccactgccgtgcaccgtttcacattcccaccagtggtgcacagggctccattttccccgcttcctcgccagcacttgttttctgtttcataatcagtgtgtggtagaatctcattgtggttttgattttcatttctcttatgattagtgacatggagcatcttttcctgtgctttttgatcatttgtatatcttctttgaagaaatgtctatttaggctgggcgctgtgtctcatgcctgtaatcccagtgctttgggaggctgaggcgggcggatcactcgagctcaggagtttgagaccagcctggggatcatggtgaaacctgtctctggaaaaaaatacaaaaattagccaggtgtggaggattgtgcctgtagtcacagctactcaggaggctgaggcaggagaatcgcttgagcccaggaggcagaggttgcagtgagctaagggattgcatcactacactccagcctgggcaacaggagtgaaaccctgtctcaaaaaaaaaaaaaaaaaaagaaagaaaaagaaaggtctattcaagtcctttgctcattttcttttcttttctttttttttttttttgagacggagtctcgctctgtcacccaggctggagtgcagtggcacaatctcggctcactgcaaactccgcctcctgggttgacgccattctcctgcctcagcctcccgagtagctgggactacaggcgtccaccaccaagcctggctaattttttttgtgtgtgtatttttagtagagatagggtttcactgtgttagccacgatggtgtcaatctcctgactttgtgatctgcccaccttggcctcccaaagtgctgggattacaggcgtgagccaccgcgcctggcctttttttttgtatttttagtagagacggggtttcaccgtgttagccaggatggtcttgatctcctgacctcatgatccgcctgccttggcctcccaaagtgttgggattacaggcgtgagccaccacacccagccctttgctcatattctaatcagatttttttgttgatgttgaggtataggagttctttatatgttctggatgttaaatccttattagatatatgatttgcatgtattttcttttttcttttttttttttttttaagacagaatctcactctgtcacccaggctggagtgcagtggcacattcatggctcactgcagccttgagcttctgggctcaagtgatcctcccacctcagcctcccaagtagctgggactacagatgtgcgtcatcaagcctggctaattaaaaaaaatatatgttttttgtaaagacgagatctctctttgttgccgggctggtcttgaacttttgagctgaggcagtcctcctgcctgggcctctgaatgtgttgggattacaggcatgagccaccgtacccagcatgtatgtattttctcctatcatgtgggttgccttttcactctgttaatagtgtcatttgatacatagaagttttagattttgatggcatcttgttttatttatttatttttatttttttgagacagggtctcactctgttgcccaggctggagtgcagtggtgcagtcacagctcactgcagccttgacctcccttgagcaatcctcctgcctcagcctcccgagtagctgggactataggtgcacaccaccatgcctcgctaatttttatactttttgtagagtcagggtttcaccatgcccagcctggtcttcaactcctgggctcaagtgatcttcctgcctcccaaagtgctgggattactggcgtgagccaccgtgcctggatatcgtattttaatttgtaatttttttggtatgtactccccctgctttaattttaattttttaaattaaagtactatatacaggctgggtgtggtggctcatgcctgtaatcccagcactttgggaggctgaggtgggtggatcacctgagatcaggagttcaagaccagcctggccaacatggcgaaaccccatctctattaaaaatacaaaaattatctgggcatggtggcacgtgcctgtaatcccagttgctcaggaggctgaggcaggagaattgcttgaaccggggaggcggaggttgcagtgagccgagattgtgccactgtactccagcctgcgcgacagagaacccatctcaaaaaaaagaaagtaatacatacatgccaggtgtggtggcacatgcccaaaatcccagcactttgggatgctgaggtgggcagatcacttgagcccaggagtttgagaccaggctggccagtatggtgaaaccctgtctctactaaatatacagaaacattagctgagcatggtgctgcatgcctgtagtcccagctactcaggaggctgaggcacgagaattgcttgaacctaggaggctgaggttgcggtgagctgagattgcaccactacactccagcctgggcaacagagcaagactctgtctcagaaaaataaagcaatacatacgcatggttaaaaaattaatgatatggaaatatataaaagtaaacatcttctttttccaaaggactagtcctctctggaagtaaccactcttaacaagtttttccatgttcttccagaaaacttcgcacactagagcaacacaggtgtccttttagaaaatattatcggccgggcacggtggctcacacctgtaatcccagcactttgggaggctgaggtgggtggatcacctgagatcaggagttctgagaccagcctggccaacatggcgaaaccctgtctctactaaaaatactaaaattaggcgggtgtggtggcgggcacctgtagtcccagctactcaggaggctggggcatgagaattgctagaacctgggaagcagaggttgcagtgagccaagattgtgccactgcactccagcctgggtgacagagtgagactgtgtctcaaaaaaaaaaaaaaagaaagaaaatattatcaaataggttcatactttggtggggttttggtttgttttgactaaaacccttcattctctgtactgtatttgaacaatacctattgatggacatttctggtgttttcagtttttgaatttctacacagtcctggaatgaacatttcatttgtatgtctcgctaatttttatactttttgtagagtgctgggattacaggcatttgtatgtcttgtaatttgtatgtcatcttgcaattgtgtactatgtaccttggatgtaccttttaaagatcgttggtggtgggacacgtgttttttgaggaagatggtactgaggtcagcaccctggctgccctgagagtgcagtgccacgttccccaccctctcgccaaccacaggattatgctgcaaatgtaaatctttaccaatttgataggcaaaaaatgggatctcagcattttagcctgcatctctgagtactaacgaggctgaacacgaaatgagcttattttcttttcagaagcccctgaatgtgacagtgatccgcaggggggaaaaacaccagcttagacttgttccaacacgctgggcaggaaaaggactgctggggtaaagtatctgtttctgttcattctcactggggcatcatttgagtgtttgttaaacatgaagctggaggggaaggctggggagacattggggaataatgggaatccccagtttgcatggaaactgcagataaatcctcgtggtaggaacgagactacagctctagaagcagagggagccccagagtctctcctgggagtctctccagttcattcatgcactaggcatttgctttaaaagaatgaaagaacattggtgaaaaggtcagaagggctcagcctctgaccttcctgaagggagcctccaaacttacgccattccttttcttctttcttccagctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatgaccctgttgtcaccccagctgaatttcttatgaccctcccaaaccaaagctcagatggggtcagaagagcttcatagaaagttgggcaaaacaggctagcaattgcaaagtcaggctttgaccaacatatttctttgcactgaggccttgctgctgtggatacggaaatggttaagtactgtgcttcctcagcagctgggctgtcagggccatagtagctccctttggagaacagggaaagcctggaggcttcccaggtggcccagcgtggtgtcctgtcagcttcctctttaggaacccaccagagggcagcaagctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaagtgctgggatcacaggcgtgagccactgcgcccagcccactgctagtttgactttttataattgaacctcctggctatgccctgagatcagcgctattttgtaaaccgctgaggtatggataggaacgagtagatcagacctcttgaaaatgcttattcttcctcccttttattttttgtctcttttaagatggtaaaatggttctcagggattcctgccaatactttgaattattttttcctctccatggtatcagtgttcatttccccagttcttgcacaccgctttctgttttggcagttctgccaggcaagccctgtgttccttgggactggttttgctgtggttggatacagataccagcttgccttgatgggattggtattgctgtgtgcttccagccacaggttctcacactcaattccaaagccttcctattgggcgaattccctcaaactctatttgacctgacagccatacgtattcccctctggtagccacagacatgctgtgtttaccaatgtttgctgtttaaattgcatgttctaattccacgtatcttccagtctcttttataaagtctcagactataataaacacagcttgcccagtttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattgtatccgagttcatacttctccaccccatcttgccaaggttgcggaaagtaaaaattggcagtattggccgctgcagcttcttaggggacgggaccatgtgaaaaggtgggatcgtgcgagcggaggaaggacagaaaagcgaggaaagtctatgccgccagcgaccggcaggaggcacgtcgggcacgctcgtcaccgtttcctggcacgtgaccaccgccctgccctgtcgctttagggcctgtcgcttccggcggtggcggttgccatggggacggagcttgggtggcaaccagaactagggagctggtggagaaggtggcggccgctggaaggaggcccgggaggtggctgaggggtccaggcggcgggacgactctggccttttgaagaccggggtgggtgctctctgtaagtccggggcggaggccacgcggccctggcgagggggcccccgacctggcggggtctggtgccccttggggggcgctcacccgacctggcccttgtggggcctggggcggccccagggagacctgagttggaggcagaggccgcacctgggctttaatcccctcgcagagccacgcacctggcacccctgccccaaacccctgcggctcgaacccggctgtccagacgcgccggcgaagttgggctcagtcaaaagaggctcggtggtgagagccctagacttgattcagagcagtgatttttcagctggagaaactaagtgccagagaaatctcgttcttactagcggtgtcatcttgaataagtcacttcacctctcagagcctcaaactcatttatccattcattatttatttattattattattattattttttttttaccagagatgaatttgaggagctgatacatttagtgctgagaaagaaattaagaaatagaaataccttttctactctgtactctctgggactttattttcaaagtgttgagttctcttattctaatgtcactgaaaatgtagggattttttttgttcggggtccaactctttagggataaagtatccatccttattgttttcctagttcaaactcttgtttgttgtaaggaataaatggagaatatgccagaaggctttcaaactgttcatttctttgcacattagggttgcttttctctcaaataataacaactgctaccattttttcaagctgtatgtgccagaattgtgatgagcattttatatatgttatcacttctctacaacaaccctagaatttaggattattcttttcattttgcccatgagaaaatgcagactctgaggggtaaagtgacttgcccaaggtcacagagcaagtacgtggtggaaatgggattcaatgctaggacaagctgacagcaaggcccttgcttttaaccactaggctaccctgcttcttctcgtattcctgtttctagaattgttgctaatatgtgggttatgcattttgctgcctgtgggaatataaatatattttaaatgagtaaaaaggctacaaggtgtttattcccagaaagttgacaggccctggatcagtatttttaagatctgggccacaaatacatatactttaagatttcccagctgcgcgtgatggctcacgcctgtaatcccagcactttgggaagccaaggcgggcggatcacttgaggtcaggagtttaagaccagactggccaaaatggtgaaaccctgcctccattgaaaaaatacaaaaattagctgggtgtggtggcagacgcctgtaatcccagctgctcgggaggctgaggcaggagaatagcttgaaccctggaggcagtaattgcagtgagccaagatcgtgccactgcactccagcctgggcaacaagaacaaaactctgtctcaagagaaaaaaaaaaaaaaggtttcccacaaatgtgactttttttttttttttttttttttgagagagggtctcgctctgttgcccaggctggactgcagtggcatgatcttggctcgctgcaacctccgcctcccagattcaagctattctcctgcctcggccttctgagtagctcagattacaggcaccaccaccacaccaggctttttgtattttttttttttttttgagacggagtctcgctgtgttgcccaggctggagtgcagtggcacgatctcggctcactgcaagctccgcctcccgggttcacaccattctcctgcctcagcctcccgagtagctgggactacaggcgcccaccgccaagcccggctaattttttgtatttttagtagagacggggtttcaccgtgttagccaggatggtctcgatctcctgacctcgtgatccacccgcgtcagcctcccaaagtgctgggattacaggcgtgagccaccacgcccggccaactttttgtatttttagtagagatggggtttcaccatgttggccaggctggtctcaaactcctgacctcaactgatcctcccgcctcagcctcccaaagtgttgggattacaggcgtgagccactgtgcctggccagaaatatgacattctttttttgtttttatttttgagacagaactttgctcttgttacccaggctggagtgcaatggtatgatcttggctcactgcaacctctgcctcccaggttcaagcgattctcctgcctcagcctcccaagtagctgggattacaggcgcctgccaccacacccagctaatttttgtatttttagtagaaacggggtttcatcatgttggccaggctggtctcaaactcctgacctcaggtgatccatctgcattggcctcccatagtgctgggattacaggcatgagccaccgtgcctggtcagaaacatgacattctttttattcctatggaaagggaacagagccatttatgcacatttcatcagtaggttagtgcactaggagatggaaatgggaagctgagggccagctggttattatggtcaaaatctctctagaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaaggggaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccagtaagtagtcatcttaattcattcatcaattcattcagaatcattagttgaatgcttagtataggccagactatgggaacacaaaaccaaataaggtacaatccattcctttttttttttttttgagacagagtctcactgttgcccaggctggagtgcaggggcacaatctcagcctgctgcaacctccgcctcctgggttcaaactattctcctgcctcagtctcctgagtagctaagattacaggcatccaccaccacacccagctaatgttttatattttcagtagagatggggtttcggtcttaccatgttggccagactggtctcaaatgcatgatctcaaatgatctgcccaccttggcctcccaaagtgctaggattacaggcacacgccaccacgcccggccacaatccattctttttttttttttttttttgagacagagtttcactcttgttgcccaggctggagtgcaatggcgtgatctcggctcactgcaacctctgcctcctgggttcaagtgattctcctgcctcagcctcccgagtagtgagattacaggcgtccgccacctcgcctggctgatttttttgtatttttagtagaggcaggctgtcacttatgttggccaggctggtctcaaactcttgacctcaggtgatccaccagctttggcctcccaaagtgctaggagcccctgcacctggccacaatccattcttttaaggagctctaaggtgtgtagggaggcagacctatgagtgcagtgagtgaaagatgcacaggagatgaaacagggcctcttaactcagtttggaggatggccagggaaagcttcctggaggaggtgtgtgccacagctgaggtgctcgccttagaatggagtcggtatgataataggagtgtaggcttcccacagactgctcccagtaggagaacttagctgtggcctaagaataggtcactgtctgtagctagtcagccttttggagaccacgagtgccacttagaagaatgattttgccattgtgggtctgctggtaggccaagaataaacttgaacacacccacgtttgtcctgttcttttcttttctcttttcttttcttttttcttttttgagacggagtctcgctctgtcgcccaggctggagtacagtggtgcaatcttggctcactgcaagctccgcctcctgggttcatgctattctcctgcctcagcctcccgagtagctgggactacaggcgcccgccaccacgcccagctaattttttgtttttgtatttttagtagagatggggtttcaccatgttagccaggatggtctcgatctcctgacctcgtgatctgcccgcctcggcctcccaaagtgctgggattacaggcgtgaaccaccgtgcctggctcttttcttatcttttccttttccccctcccctcccctctcctccccttcctgtcccttcttctctcctctcatccctccttcctttctggggtctcactttgtcacctaggctggagtacagtgacatgatctttcacaagcagcctcaacctcccaggctcaagcaatcctctcacctcagcctcctgagtagctggggctacaggcatgtaccaccacgcccagctaattttgttcatttttggtagacataaggtggcactgtgttgcccaggctggtcttgaactcctgggctcaagtgatcctcccctcttggcctcccaaagtgttgggattacaggggtgagccattataccccatcttgttttgttttttaagtacaaaatgttccagcctcttttaaaaaacatttcataattcctaggtgaggctaacactaagactggctgactgggaatagaaaaggtgaataaatggtgagtagcagcacatatggaatcatgatattttatttctttttaaagaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttggtaagtgtaatgcttttaaatctcccccagtgcttttgagagtgttgcgcaataggggaattttatgcatgttgggggaaaaagaataccaccagaaggatactttttaaactaataatagacttgtgtttttttttttaagacagtcttgctttgtcgcccaggctggagtgcagtggcacgatcttggctcactgcagcctccacctcccaggttcaagcaattcttgtgcctcagtctcccgagtagctaggattacaggcatgagccaccacgcctggctaatttttgtatttttagtagagatggcgtctcgccacgccatgttggccaggttggtcttgaactcctgacctcagatcatccacctgcttcggtctcccaaagtgctgggattacaggcgtgagccaccacgcccggcctagacttgtgtcttttttttttttttttttttttggagacacagtttcactctttttgcccaggctggagtgcaatggcacgatcttggctcactgcaacctccgcctcccgggttcaagcgattctcctgcctcagcctcccaagtagctgggattacaggcgcctgccaccatgcctggctttttttgtatttttagtagagatgggatttcaccatgttggccagggtgatctcgatctctggacctcgtgatccgcccacctcggcctcccaaagtgctgggattacaggcgtgagccaccacgcccggcctagacttgtgtcttttaaagttcggttaagagctccgactggaacacgtgtgactgaacatgaacttgagagcggcatctgcgttcaatggtgttgctcagcaggcaggaaattccagacatagtttgtctgttgcatagggtgctatttcacgtgggagatccaaactccattccgcccctttccccagcttcctcctccccctttccttcccgcttcctctccctcttcttcccttccctcttcttcccctcccctctcctttcccttttctctcttccctcctgtctcctctccttttttctctcacattgtaaaactcctccttcatgctgccaattccaccccttccccttcttgcctcacctcttctgcctttatctttacatgaccccaaaaccatccattccaagagggtcccagagtggaaggtaatggaggagtgaaagccgcagtgaaaagccccaggcagtccagaggaatctgcctttgccactgctgaaaatattccagggaggcaccatctgcgaggagtaaaaatattatcatttaccaggagaaggaaaaggaggagttttttccttcttcctccatctgctactttctgaaaattgtttcctaggattcatccttcctgtagattcatgcctttggaagatgtggaagcgattgaatggatatcaaatacttaatgtagttcctaagacatagtgagtactcagtaagtgtccgcaactgtgtgtcatgacgatgacggtggcaagacgtctggagggaaatgcaggcaactggaaacctcctttctgcatatgggcttcatttgagccccgtgtgacagcctctctcccacagcttgcaactgttcactccgagagaaagaataattgagctttagggctcacaaagactcttgtcttgtttagccagcaaacataaatcaggcaatgtctctaagaaggtgtattctttgtgtcaggggcacagctatctggacttggcaagagccactcccccaagttttgggtctcgcttagccttggtctcactgcggaaccaaaacggcagaaccaaaaattttctagactgtcttcctttacaaattactttagcttttatttatttatttattttttgaggtggagtcttgctctgtcacctaggctggagtgcagtggcgtgatcttggatcactgcaacctccacctcctgggttcaagtgattctcctgcctcagcctcccgagtagctgggactacaggcatgcaccaccacgcccagctaattttttgtaatttttttttttttttttttttttttagtagagacggagtttcaccgtgttagcccggatggtcttgatctcctgaccatgcaatctgcccgcctaggcctcccagagtgctgggattacaggcgtgagccaccatgcccggccttttttaagagacagagccctgctgtgttgcccaggctggactagaactcaatcctcccacttcagcctcctgacatttctttagcttattgcatgtatcttctttcttctttctttttccttcactttctttttctttctctctttctcctttattatttttttctttttgtttattttgagacaggctctcactctatcacccagactggagtgcagtggtgcgatcatggttcactgcaacctccgtctcctgggttcaatggatcttcccacctcagcctccccagtatctgggactacaggtgtgtatcaccacacccagctaattttaaaaatcttttttagagatggggtctcactatgtctctcaggctggccttgaactcctaagctcaagcaatcctcccgcctcggcctcccaaagtgttgagattataggtgtgagctaccgtacccggcctcaattttttctttttgttaaaactattcagtgttggccgggcgcggtggctcacacctgtaatcccagcactttgggagcccaaggtgggtggatcacctgaggtcaggagttcaagaccagcctgatcaacatggtgaaacccctctccactaaaaatacaaaatcagccgggcgtggtggtgcatgcctgtaatcccagctacttaggagactgagccaggagaatcgcttgaacccaggaaggcagaagttgcagtgagccaagattgcgccattgcacttcagcctgggtaatagagtgagactctgtttcaaacaaacaaacaaacaaaaactattcaggattatttgtaaaaaattcagacaacttatacatgtttgaaggcaaagattcttcttcctacacacacccccacccaatctcatttccctatgtaattcctgccacagttggctgtgactgctcctctcctgaccttgttctgtgcatgtacaacatgttatctgtgtgcccatgcctgtgcacatggctcacatttagtttttgtgttgtttaggtttttttttttttttaccggtgagataatcctgcatttctacaaaatgtttttccacttaatatgtcttggaaggtttcttgtatcagtgcatgtatctctacttcctctttttgtttttctttttttgagatggagtctcactctcacccaggctggagtgcagtggtgctatcttggctctctgcaacctctgcctccctgggttcaagtgattctcctgcctcagcctctcatgtagctgggattataggcacgcaccaccatacccagctaacttttgtatttttgtagacacagggtttcgccatgtaggccaggctggtctcgagctcctgacctcaggtgatccacccacctcagcctcccaaagtgttggaatttcaggcatgagccaccgtgcccagcccacttcctctttttaaatgtaactgttcccctttctgtggccatttaggttgcttctaatttcttgctgtcacacaaggtcctacagtgaacgtgctcctccatctctcctgtgtccacagcatcctccttttcctttggggtcctctccttagtgctaaggcctgtactagctcccattgttcacggtaaatagacatgactgtggatcccacctccagctaggaaacaaggcaatcatgtatttatgagcaggaatcttatgaatatcaaatacaatgaaatctggttttgacagcaaagttttattttccagattaatatgttttagaaaaagattgatgtaagcagtggctatctccataatcatctgtcatgcatgttaaaacttctgcaaaacacgatgattaatactatttgatttccacaattgtgaacgctgctcgagtggggttgttctgttaccactaagtgaagtcagcctcgtggtgacccgggaagagctgttgtggctgaagacaggagtccttttaggaatgctttctttttgtcactaatttgttaaatggcaaaataaatttccaggaagatgatccttttaggattagcaagtttccaaaagaacaatttcatttgaataaatcagcttttaagaaacagccaaatattaaataattctgttcctagaagttgcagcttgagacaattatgattccataattctaccactcacacccacacaataagagatctaaatataaatataaattatagggaatgagcagatggaaacaggagaggatggggaattaagaatgtaggagagagaaattggccacattacctgctatgtctgtcttggggagaaacaatttaattttataagtattgttcaaagataagaaaggaaacttaccagattttgtttctatatgccaatttaattcactgattcttagcaacgcaacgcatcactttcagcactctactgcatttgattacttgaccctagataattttatgtatatgtgtatatatatacgtatatatatatatatatacgtatatatatacgtatatatatatatatatacgtatatatatatatattttttttttgagacagggtcttgctctgttgctcaggctgcagtgcagcatgacgatctcggctcacagcaacctccacctcctaggctcagtcaatcctcctgcttcagcctcctgagtagatgggattacaggtgcacaccaccatgcctggctaatttttgtattttttttagagatggggtttcactatgttgcccaggctggtcttgaactcctgggatcaagcaatccactcacctcagcctcccaaagttctgggattacagatgtgagccactgcaccctgcctggattttatttttgagcagttttaggtttatagaaaaattgaaggccgggagcagtggctcatgcctgtaattccagcactttgggagactgaggcaggcggatcatgagattgagagactgagaccatcctggccaacatggtgaaaccctgtctctactaaaaatacaaaaattatctggacatggtggtgcatgcctgtagtcccagctactcaggaggctgaggcaggagactctcttgaacccaggaggtggaggctgcagtgagccgagatcatgccactgcactgcagcctggtgacagagcgagactccatctcaaaaaaaaaaaaaaagaaaaaagaaaaaaaaattgagctgaatgtactgtacacagggcgcccacatattcctctgcacatccctcctctttttcacagttttcccttttattcacatcctggatgagtgtggttcatccgttagcactgatgagccaatactggtaccttattattaacctaagtccatagtgtatattgggggtcattctgtgtgtcatgcttattatgggcctggacaaatgtatcctgacatgtacccagcattctagtatcatacaaatagattcatgccctgaaaccccctgtcctccaccgatccatccctcccttcctcccctgagccctggcaaccactgatcttttttttttttttgagacagggtcttgctctgttgcccaggctggagtgcaatggcgtgatctcagcttgctataacctccgcctcctgggttcaagcaattctcctggctcagcctcccaagtagctgggattacaggcatgcgccaccacacctggctaatttttgtattttcagtagagatggggtttcaccgtgttgaccaggctggtcttgaactcctgacctgagatgatccacccgcctcggcctcccaaagtgttgggattacaggcgtgagccactgtgccgggccacactgatctttttattgtctccaagtttcaccttttctagaaagtcatagttggaatcatgtaatatgcagtcttttcatattggcttcattcacttaccaacacgcatgtaactttcctccatacctttttgtggcttgttagccctttttttttcctcgttgaataatattgcattgtctggatgtgccacagttggtttattcttaatttttaaaaaatactttgagctgggcgccgttgcccactgctgtaattccagcactttgggaggccgaggcaggcggatcatgaggtcaagagatcaagattatcctggccaacatggtgaaaccctgtttctactagaaatacaaaaagtagctggatgtggtggtgcatgcctgtactccaagctactcgggaggctgaggcaggagaatcacttgaacctgggaggcggagtgaacagtgagctgagattgtgccactgcactccagcctggcaacagagtgagactctgttccctcctccaaaaaaaacaaaaaaaaccccaaaaaactttgaacacaaaactagtacataaataaactagtattgaagtaaaagcagtagtcagatttattgtacttataatttttcatttcataaaattttaattttgggtttattccaggcaatacagaatttttaattcttctgaagagattttgtctcttcatcctttatccttccagtagaaatagtacatagggaccaaatacccaggctgaataattaattgcctttcttttttttttttttttttgagatggagtatcactctgtcatccaggctggagtgcagtggcacgatcttagctcactgcaacctccgcctcccaggttcaagtgattctccagcctcagcctcctgagtagctgggagtaaaggtgcgtgccaccacgcctggctaatttttgtgtttttagtagagatgaggtttcaccattttggccaggctggtctagaaccctcaacctcaggtgatccacccacctcagcctcccaaagtgctgggattacaggcatgaaacagggctcccagcctatttgcctttcttataaagttacgtaatgacttcattgtaacttgtctactctacatgcttttagaaagtaaatggaatttcacaacgttaggtgctcactgtgtgtctggtattgaacaaagtttaggtcctggggagtggaagaaaaggaagttatttctgtgtattgttgaagactttcttttctaatggagatataattaacatgccataaaattcaccctttaaatttttttttaaattgtggtaaaatacacggaacattaacgttgccatcttaacctttttttctcacactgtcgcccgggctggagtgcgatggcgcgatctcggctcactgcaacctccgcctcccgggttcaagtgattctcctgcctcagcctcccaagtagctgggattacaggcatgcatcaccacacccagctattttttgtatttctaatagagacaggatttcaccatgttggccaggttggtctcgaactcccgacttcaggtaatccacccgcctcagcctcccaaagtgctgggattacaggcatgagccaccacgcctggctgaggactttcttaaagtggttcctcttcactgaactgttgatgtgaaatccttcccctccggcgagttcctggagccccagctctgggctgaacacgctgtaatgtcttgctggctttgcccttgtcttccagaccatgacctggtcgtttggatggaacagttctcttcctgtttactatattcgagaggaaaggcagagagttcttctgtatgtttgtgctcacactgcgatcatctacaacgtgttcaggaacaatcaataccaccttcaggtatgcagggatttccttcctacaggtgggggagttgtctttaacgtgcgtgtggtattttgttttgtatctcaagggctgacttcattctatcactgtcgtattttcccactctccttggaactaaaagcaagcctgtctttagaaacacatggtattgtttattgtctctctgtttctaatcagaatcaacttacaaaacagcagttgatattaattttatagtgagaatttaaaacatctgtattttttacacttctgcaaaaatgtggacagcgtagatcatatctccacagatataacacaaagggcagctattcagcagggtgccgacctcacggacacttacacacatctctagttttcaaagggctttcatcttataactgtaccgagaagtgggtattcatatatccattttacagaagaagaaactgaggctcagagtgttttaagtgacttgcccaagactgtactagtaaacaatgactctacatctcctgtcttgaaagtgttaagtaggtcagttgtccttttatccctccctcctctcagcagctttgctcattttcacccctctctgagcctcccccatttgtccttcatgcctgccctcctcacagcactctgcctcctttgttcctgatatttgggacccacttcattttcatcatttacctttccaagcatcctattccttggtgtctgactttccactcgttggcctggtcaactgttccacatcaccctttcagttgacgtgtgttgttacaggagtgtccttagctgatgcctagatcaaaaacaccacgaggtatttaccaaggacccagtcagtactcagtgttgtgccagggactcaagatgtctgggtgcaacttaaggaattcactctctagaagtccagaaatacgcaggcagaaatcagcaggcagctccccttggagcttcattgaatgcatggcactgaacacagtggtgatggcagagagagaaggagagattgctgtgggcaggctcagatagtcaggggaagcaggatgcgcagatgggctggggtggaaggaggcaggagtccagcctcactagggccagagggctgggagtggccttgaccatccattcgtttcacaaatagttatagctgctatgtttcacagtataggtctgtagtaatgaacaaaacagatgtattccctgctctcatggagcttacagtctagaacagagacagatgttaaacaagtgaacacataaatgattacaaattgtaaccagtgcttgaaaggagatgtgaaaacgctctaagggagaaaaatcagggtaagagaagacttaactttagattgagtgggcagggattgaagaggtgctgtttctgctgagacctggaggatgcgaatgagccagccaaagacagtctgggggagaacattccaaacagagggagcaacaagtgttcaggcctgtgtgtggggcctggaaagaaggctggtgtggctgctgcaccatgagggagacagagaaggaaggagggaagaggggccatttcccagcagggagtgctgccatttgtgttcccagaagattcctctcttgtgtgcataaaaggattgtaagaagataagagtggaagcagaggccgagcatggtggctcatgcctgtaatttcagcacaggctgtggccaaggaggctgaggtgggtatatcgcttgagcccaggagtttgaggccagcctgggcaacatggcaagacccttgtctctacaaaaaatgtaaaaattagctgggcacggtggcatgtgcctgtagtcccagctacttgggaggccgaggtgggagaattgcttgagcccaggagatcgaggctgcagtgagccaagattgtgttgatgcactctagtctgggtgacagagtgagaccctgcctcaaacaaacaaaaagagtgggagtagagagaccagtgaggaactttttgccccagagctgctcagagccctgaagtgagcagtgttctagagagaagaggccggcagcgtgactcagagtggctgggggaggggaggacccagatgcttatcctccacttgggttgggagttgccgcttgccttcacctctaggagccactgttcatgtagggaacttatctttcaggtgtttggagggagaggaagtttgaaaatcacccactaggaagtggagaaacacccaggaaggccagcgggaacagaatttccagccagatgagcgttgaaaggagctcagatctttctgtgggtccccggcctttgctgatagtggccaaggctgggccgcatcttggatgtttcaaagcgttttctctccatttccatagggccacgccaatattatctcctgcctctgcgtcagtgaagacaggcggtggatcgccacagcagacaaagggccagactgcctggtgattatatgggactccttcacagggtaggctttgtgtagccacttcttttttccctgaatttctgtagagtatctgccactgtgtgacagtgacagaatgagcaatgccaatgcctagaaatttgatttgttggtgttccacagtagactggcttatgctgactcacactaacctagctcacacaagctcaaagcataacccagatggcaaatctgtcatttacaatgagaaacattacttctacaaggacagattttttagtggctggtcatgctgcctcttctgggcagttcttaatggttgctaccaagtgttcgtgtctatcgctgctcctcattccatacatttcttgttggatatgttcgatttcgatctgtttgcctgccatggttttaggtatagtaatgatgggaggctttccaaagctgctgtttctctgcagtctctctctaattctaacaacccaccattgcctcctttcttttatagtacagacagggtctcgctccattgcccacgctggagtgcgttggcgcaatcatagctcattgcagccatgaactcccaggatcaagagattctcctgccttggcctcctgagtagctgggaccacaggcgcatgcaaccacacctggctaacttacttttgtagagaggaagtcttgccatgttgccctggctggttttgaactcctggcttcaagagatcctcccatcttggactctcaaagcactgggattataggcatgagccaccttgcctagcctctttttaaatattttattttattgtattatatttttgtagagatggggtcttgctttgtttccaggctggtcttgaactcctgggctcaagccatcctcctgcctcggcctcccaaagtgctgggattacaggcatgagccaccgcatccgatctctctttctctcttttttaaattaacagacttttatttttagaacagttttagatttacagaagaattgggaagatagtactgaggattcccataaaccccacacccaggttcccacattagttacatcttacattagtaggatcaatttgctgtaattcatgaaccaatattgacacattattattaacagacatccaggatcccacccaggagaccacattcgatttagctgtgatggctccttaggctctgcacggctatggccgtttcttagactttccttgtttttgatgactgacagttttaaggagtacaggtcagggatttggtagggtctccatctattgcactgtgtctgatggttttctcgtgataagcctaccagccttttgacacactctggtgtctaagaaatgagttgcagtgaccttcttaacctgggggtaaaaggcaggctcacttcgatcaagcgtcagataaaccagtccaggtggtgaggggaggttgacagcccacggactctctggcactggagctgggtccggaaggccggggttgtgttccctccttgtatctgcttctgtaactcactctcctccttccccggctggaggcagactgaatggagagtctctctggtatcaaggttgtcatccggtattgcctttcttcctaactcatcaaattcaccttttctggtcccttttctgatagtgcatccaacaaggaaaggtggaatttccgtgggcttgggcagtgctgctcaaagtgtggtctgcaggctgagctcatctgtcagctggtcctgggctatgctgaacagaaagtacagaaaatgagagggggcctttgggaacttgtatagcaatttgttcttgctatggtatttttattttgtgaaagtgtttgacctgggctgggtgcagtggctcatgcactttgggagcctcccagcactttgggaggctgaggcaggaggatcacttgaggccaggagtgggcaacatagtgagactctgtctctacaaaaaattaaaagttagccacatgtggtggtgcatgcctgtagtcccagctacgcgggaggctgaggcgggaagatggcttgagcttaggtgtttgaggctgcagtgagccatgatcgtgccattgcactcctgccagggcgacagagcaaaaccctgtctcaaggaaaaaaatatttattggtctgcaaaggaataaagtttttaaaaatatctttcaccacagatagtttgcaaagtgctgggcaagatgatgcctaggcagttgggggatactgtggggctgaacacgccaccttgtgtgacagccgtcaagcaggaggcagtcttatctgccgaggacattgggaatggggctgctagtttgggctgtgggatgtgacatgctgtaatcaatgagaatgcagtagaggtccaccaaatgaagggaaggagctgtagggtttcagggaggggcctggttggggacaaaaagcatgagcctgcagcagatggtgggtgggtggtgatgcttgtccagccgtgctgggcagggtgggaataagaacagggaatgtgactggtggtggcttgcctgggtaggataattggaaggggagaagggaaggggcccaggggaattcagagtgacatgaaagagcaggtggcaggaggcaggtgtgagtgtgggctctggcgtccacctgggcttccatgcccggtcagccgtggtctgctgtgtgacttggaggcccagagaagaaagtgactttcccatttgtgaaaaaagaataatgacatctactgttttttactttccttgggctgctgtaacaaattacctcaaacgatttactctcttgcagttctggaggccagaagtctgaaaccaaggtgtcggcagggttggctgcttctgggggctgtgagggagaatctgtcccaggcctctccccttgcttctgctggctgcgggtgacccttggtgtctttggcttgtggacgcatccctccaatctctgccgccatcttcccatgacattcccaccatgcatccatctgtgtcttcttgaggacactgggcattagatttggggcccaccccagtccagcacaacctcatcttaactaactatgtccacaaaggacctgtgtccaaataaggtcatattctgaggttctgggtgggcctgagtttggagggaccacttagcccattaaacccaatgcacaggatgttgtgaggatcactagagcgcagcaccaggccatgatagaggatcctagatgggttttctttcttaactcctggcctgaggcagagagcagtcagatttcactgacaagattgttagggcctggttgggtaggtgggtggggagggaagagttcaacaagtgagtccagatgcacgaggaggttaggaagaagttacgttgaatgttctagagtgggggacacaggaactgctctcccacaggtgaccagtgacctccaggggatctcattacccaaccctgatcctcatctgacttgacttctctgtggcatctaacacttcatttcctgtggcttctctgatctcacatccctacaatacatggcctttgtgtctggcttctttcacttagcatcgtgcttgaaggttcatccgtggtgtggcacgtgtcctttctatggcggaatcacagtacattgtatggatagatcaaacaatgtatagtctttcatctggttttttgttttgtttttgtttttgtgagacagggtctcactctatcacccaggcgggagtgcagtggtgtgatcatggctcactgcagccttggcctccgaggctcaagtgatcctcccacctcagcttcctgagtagttgggaccatggatacatgccactgagcctggctaatttttttttttttctggtagagacagggtcctgctatgttgcccaagctggtctcgaactcctaggcacaagtgatccgtctgccttggcctcccgaagtactgggattacaactgtaagccactgtgcccagcctcatctgttgttgttgttgttgttgttatttttgagacagggtctcgctctgttgcccaggctagagtgcagtggcacaatctcagctcactgcaacttctatctcctgggctcagatgatcctcccatctcagcctcccaagtagctgggaccacaggtgtacaccaccacacccagctaatttttttgtatttttttttttaatagatacagggtttcaccatgttactcaggctggtctcgaattcctgggctcaagtgatccacctgactcagcctcccaaagtgctgggattacaggcgtgagccaccatgcccggctcatctgtttaatttgtaaaaaaatgattttagtacattttaatagaaaactcttaaatttaatgaaaaccaggccgggcatggtggctcatgcctgtaatcccagcactttgggaggccgaggcgggtggatcacttgaggtcaggcattcgagaccagcctggccaacatggtgaaaccccgtctctacaaaaatacaaaatacaaaaaattagtcgggcataatggtgcactcctgtaatcccacctactcagaaggctgagacagaatcgcttgaacccaggcggcggaggttgcagtgagctgagatcgtgccattgcactccaatctgggcgacagagcgagaattcatctaaaaaaaaaaaaattaatgaaaactgatacattttcatggaaagcactggctgccatctccgatcttagtcttctttctagaggtaatcaatttggtgtgtttccttccaaaacatttgcttttgttttgaacacacgtatatggatatcttcatgtagcttgtctccacaacattgttggtgtgatgttttcccagacaaatctgattgtgttgccaccctgattaaaaccctttagagactgtccattgtcaaatcaacttatgctacaggggacacgcaccctgcattagggccctgcagacacttcccccagaaagtgaaatgcccgctgcctgcacccatagccgtctgtggctgctacacgctctcagctgcaagtactggcacatccaacttaaccacaagggaagggtattatctcatgcagtagaagcctgcagtcggccggcagaagggtcagagtccttcaggtgtgtctcatctctgaagcctttgctgaccaacaccttcaccagacagagctgccccgttatgatgtggagccactgttttttccttatttgtgaaactctctctctactagacatgaagcaacttgagggcagtgattttttttaaaaaatttcacagtaaagcatatctgtggttaataatgcaaatgctatgttaatatgaattttatgatatcccaagtgattactttgggacccagaaaagattattcagaggctgttttggttttaggattaatattcattttattagtgataaattaaaaaccgtagttcttcctccagtttttcgctcagcttaaaaatcttactctgtttataaatctagcatatttttgcaatcacctttgaagaggctttgattaatgtttggccccacttacaaatttggttattaactccttttaaacatgtaaaactgcatttcaatatttaagagatttagtttctttacgttttttagtagtctgattaacaaacaaatccttcatggtacttaagtaattactgcaaatctagtaaattagacataaatatggtaaatcttaagtttccttaagtgttctaatattgtttataaacctattacgattttaatttaaaatcacaagtctaaatcaactatatattttaaattagcatcacaaatctaatctgttagcaactctggtatgtcaaattcacttaaacattacaaattcctaaaaaatgaacaaattctcttatcacaaatatgttaataatgcaggtctgactgacttcatcttctctatattcaattccaagtatctccagggatgagatacattttctcactaaggacttcactgtgttatttccaatcattttggaattgccttcccaggtgaatttctggggctacttctcagtaggatgaagtttctccagtgacagagaaccagagaagtcctcagctgggacacagacttgataccagccagttgggaccctagcgtgacatacagagatgctgaggcctgtttatcttcactgtatctaggactccataaacaaacaaacaaacaaacaaaaaagaaccatgtgacccgcattcctggtttaagtcttgctaccacctacttttcattccagtgggaatcagcagacctcccccaacccaaccattacagcttccatcttcgcttccactgcttctgtgctttggctgtcttagatacttgcatgtcatctaattctgggtatttcaaggctgtgttggaatcatacagctctaaggtcttgtcagtaacacagtatggaaatgtaagagcaaaaaataaaagttcctcctcacccaaaccccatcttcagaggaaccattgcttacagtttggagtctattcctccagagttttttcaatacatacacacgcacacacacacacatgattaggatgatgcgattgttttgcagtgtgcttttttcacaaattttggtcactttcccaatctacctcattctttttgaaggcagcaaagtttttatttttatttctattttttatttttatgtctttatttttttttgagatggagtttcacttttgttccccggctggagtgcaatggtgtaatcttggctcactgcaaactccgcctcctgggttcaagtgattctcctacctcagcttcccgagtagctgggattataggtgcctaccaccacacctggctaattttttgtatttttagtagagacggggtttcaccatgttggccaggctggtctcgaactcctgacctcaggtgatccacctgccttggcctcccaaagtgctggaattacaggtgtgagccaccatgctggcctttttttttttttttttttttgaggcaagatcttgctttatcacccaggctggagtgcggtggcgtgatcttggctcactgcagcctcaacctcctggactcaagcgatactcccacctcagcctcccaagtagttgggcccacaggcacgtgccaccacacctggctaatttttctatttttggtagagatagggttttgccatgttgtccaggctgatcttgaactccttagctcaagcaatccaccctcctcagcctcccaaagtgctgggattaccagtatgcagcactgtgcccagcctagtttcttatcatatggttatgctataatatctttttaaataattcatgtatggtatattaagggacatttgtgttgtttgatttttgctattagagcagtaccatgatgactgtgaattttcattgacctttgtttactttttccatgatttccctaggaaaaagtcgtaagggtggagttactgggctgtagggtgtatgcattgaaggttttgatagatacagccaaactgcttctagaaaagtgctgctcctttgcattcccacctgtgtaggagagtgcccgattccctgagagctgggacgttgtcctagtcatcttttcatatttacatccttcctgccaggcacaacctggcacagaatcagtgcctggtacctagtgaatgagaacctagagcttgtgaagagggcaaacagcaggcccattgccttgagttaggcttgactattattgttgttgaggttaaattcgcataacataaaactgaccattttaaagcatacggttcggtgacatttaatacatttacactcttatgcaaccatcatctctatccagttccaaaacattttcaccgccccagaaggacaccctgcatccattatctgtctctgtgggtttgcctattccggccgtttcatatgagtggactcatacaccacacgcctttcgtgcctggcttctttcactcagcatcgcttccgacgctcatccatgtcatagcatgcatcagtgcttcattcccttttatgactcagaaagattccactgtatggatagaccacattttgttctgttttggagaggtttgggctgagctcagacctgccctgggactctctgggaagccagggagacctcagcaagtgtcgccccccttgtcctgttttgcagtattcctgtgcacacaatatttgacagctgccctgaagggaatggcatcatggccatggccatgacccacgacgccaagtatctggcaaccatctcagatgctgaagtccaggtaaaggccctggccctttgggtcagcatcagcgagctggccgacctgtgcagcgtgtccccatgggcagctctgttcaggctgggctgtgtgatgtctgtgatattctcaaaagaccagactccacagcacagagtctgggcctctgtccttagttacttgaagttttggggtcaccacaagaggtgtaagttacttcagcagacttcacagaccttctcatgcccctctctctactgtcacctacagaaggtatgcatctggaagtggactttggcagtggaaacgccagcatgcactctcgaactccccacagagtacggtgttcaggtgagttcagttggagcctgtaaacatcaacctgaagttatacaggtgcaaggccaggctgggcgtggtggctcacacctgtaatcccagaactttgggaggctgaggtaggttatcacttgaggtcaggagttcaaggccagcctggccaacacagtgaaaccctgtctctactaaaaatacaaaaattccctgggtgtggtggcacatgcctatagtcccagctacttggaagactgaggcatgagaatttcttgaacctgggaggcagaggttgcagtgagccgagactgcgccactgcactccagcctcggtgacaaagtgagactctgtctcaaaaaaacaaaaacaaagttctacaaatgccaggccaaaacctactttttgtttcagtagagttgtgttatgttgcagtagagtgtttttgtttgtttgttttgtttttgtttttgttttgagacagagtttcgctcttgttgcccaggctggagtctggagtgcaatggcacgatctcggctcaacacaacctctgcctcccaggttcaagcgattctcctgcctcagcctcccgagtagctgggattacaggcacgtgccaccacgcctggctaattttgtattttttttagtagagacgggttttctccatgttggtcaggctggtcttgaactcccgacctcaggtgatctccccaccttgtcctcccaaaatgttgggattacaggcatgagccactgcacctggcctcagtagagcttttaaaaccctttcatttcctgatcttgttttacttgaatataatagctaatatttttgaagcacttatgttccagagtctgctaaattctttacttacattatctcacataatccatgcaaacatgctagcaaaaaagatattaatatctgtggaatactaccattaattattaaataatttgtctaaaatcacccacctggcagtctttcttattctagaagtgtgctcttaactacttcaaaccttgtaaaactaactctgaggagtatagggaagttatcattattgctcccaacttgcatgaggtgacttgccaaggacacccagaaagtttctatcaggtctccttatttcctgagtcactgctccctgcttttgtgacttgtctcattcatccttgcatgcttcatttgtcatacatttattgagtacctgttctgtgccaggcactgtggtaagtacatgcctgacttgcaggatctaaaatccaaacagagggtttgggtgactagactcagccagggaaatatggttatgcagccatatgtccatcttctttcctttccccccaacattcctcttgctcctaaaaaattttttctttctccttaaggttgtgttaacacagtagccaccaaccatatgtggctatttaggatggatttttctattgctgcaaaaaacaccattggggttttgatagcgatagtgttgaatctgtagatcactttggatggtatcatcattttcacagtgttgtcttccaatccatgagcatgggatgccttgccgtttatttatgtcttctttaatttctttcaggggtgttttgtaatttccagagttcaagtcttcacctccggttaaatttattcctaaggattttgtggttttttgatgctattataaatggatttgttttcttaatttctgttttagattgttcattgctagtgtataaaaaggcagctaatttttgtgtgttgattttgtaccttgcaaccttgctgagtacacatggtgatttaaatttaaaatgattaaaatgaaaaaaaatcttttttgagacagggtctcactgctgtccagtctggagagcagtggcgcgatctcagctcactgcagcctctgcctcctgagctcaagcagtcctcctaccttagcctcctgagtagctgggactacaggtgcacactatcatgcccagctaattttttaatttttttcagagacagagttttgccatgttggtcaggctggtctccaactcctaggctcaagccatccacccgcctcagcctcccaaagtgttgggattacaggcgtgagccaccacacctggccctcttcttctttttgctatgctttcttcttgggtattgtcatctattcccaaggccatttacttccaagacatatcctgaaatctttcctctcctttccacctctgttgctaccatcctagtccaggccacagtcacctctacctgcattatctggcccgctggtctctctgtgttcactctcgcttcactctctaacagtcttcccacagcagtcagactgttttttttgttgttgttgttttgttttcttttcttttcttttcttttctttttttttgagatggagtctcattctgttgcccaggctggagtgcggtggcacgatctcggctcactgcaacctctgcctcctgggttcaagcgattctcctgcctcaacctcctgggtagctgggactacaggcacgtgccaccatgcctggctaattttttgtatttttagtacagatggggtttcaccatgttagccaggatggtctccatctcctgacctcatgatccgcccgccttggcctcccaaagtgctgggattacaggtataagccaccgtgcccggccagagtgttatttttatttttcatttttatttatttatttttgagacagagtcttgctctgtcacctaggctggagtgcagtggcgcaatcttggctcaccgcaagctttgcctcctgggttcacgccattctcctgcctcaaccacctgagtagctgggactacaggcgcccaccaccacgcctggctaatttttttgtatttttaatagagacggagtttcaccgtgttagccaggatggtctcaatctcctgaccttgtgatctgtctgccttggcctcccaaagtgctgagattacaggcgtgagccaccatgcctggccatatttttaaataattaaaatattacatcactcctgtacttaaaatccttcagtaacttctcattgtcctcagaataacattaaaattccatgacatgtggcctccaaggtgtgatctgatccctccatccatctcctaatgtctaccatcctgattattgtttatcagtttgcattttccagaatttcatgtacaataaatggactctgtttgcagagagctttggtttcttccactcagttttgttgttgcacgtatcagtagtgtattcctttttattgttgaatagtagtgcattgaataggtgtgtaactgtttattaattcactgttaatggacattgggttgtttcctggttgtggctattgaaaataaagctgctgtgaatgttcatggacaagtctttatttttgaaggagattttcctgtggtatagaattctagagtggtagtattttctttcagcagttcatatcttcaaggatgtgattctgttgtcttctggtttctaccatttctgttgaaaagtcagctgtcgatccctattttgaatgttgtgtgtctctctccttggcccccagctgattttacagatttttcccttggttttcagcagggtttttgttttgttttgttttgttctgtttttgagacagggtctcactccatcacctaggctgaagtgcagtggcacagtcactgctcattgcagccttgacctcttaggctcaagtgattttcccacctcagcctcccaggtggcaccatcacacctggctaattttttttttttttagagatggggtctcgctgtgttgcccaggctggtcccaaactcctgggttcaagtgaccttcccacctcagtctcccaaggtgcagggattataggcatgagccactgctgcaccagccccagcagcttttcaatgatgtgtctatgtggaagtgggtatgttgttgatttttgtaaagcttatcctttaggatttcttgaacctgagatgttatatctcttctcagttttggaaaattctcagccattacctctttacacatttcttctgccacattctttctttattcttcttctggggctccaattacatatacgttagaccttttctggtcttgtcccactggtcttttattttcttttatgtattttctatcctttcatctgtttctgcttcagtctgaatgttttctactataatttgtcttcctttcctgctgactagttctttctttggctatatctaaatttttgttaaactgtctattaagcattttaaatcattttttcaggtctagaatttccatttgattcttttttaagtagagctatctgctgagattccccatcttgtcctctacttcctgcatgttaatcctgtgattgtctaataaccccaatgctcggatctcctgtggcttctttctgctgattgctttttccccttggttttcagtcatttggatgggtcttttttcttttcttttcttttcttttttttgagatgggggtcttgctctgttgcccaggctggtcttgaactcctggcctcaagcgatcctcctgcaaagttctgggattccaggcatacaccacagcgcctggcctggatgtatctctttaatatgcctggctattttttactgaatgcctgatgttgtgttttttaaagtgtagaaataaatttgaggcttgagatgacttcgtccaaagaagactgacttctgctccttaaaggcacttagcagagtggtcagcttaatctaatcagagcttgaggtcgtttgaggctgattttcaggctttgtgaagtctgcctcatgcacttgcttttgccagttccttaccctacccaggcttttgtgctgttctgatatgaattctcaaacactggcattagtagtttacacccctgtggtatgtaacattcataaaatgttcagaaaatgataggtaaggaataggcgtggagacggggtggaaatggcagaaatggaacttaaaaagcttttttccagcctgtccctcagtgctgtctcctgcagcccttctccccaggctgtagccacccacctcccatgcacatttcaaacacataccccatggctccccaggaagagcttgctttgttgttcttgctgtggctgtttggtttctgtatttaaaactttccgtcacttccatagtttctgcagggttggtttttgggaagggagccagcagcccatgctattcaccatcttggcaggaattagaatccccttccaatatcttgcattcattccaagatattgtgtggccctgtcaaatttagaaatgtatacgcagcagtctttatctaaaaggatacagaataaaggttattggtgaatactggtttacttttgcttgttccaatttattttattattattattgttattattttaaattgaccactatcagaaaagcttgttatagccaggcgcagtggcccacacctgtaatcccagcactttgggaggctgaggcaggtggatcgcttgaggtagggttcaaaaccagcctggccaacatggtgaaaccccatctctactaaaaatataaaaattagctgggtgtgggggcacatgctggtagtcccaactactcaggaggctgaggcaggagaattacttgaacccaggagatagaggctgcagtgagctgagatggcgccactgcactccagcctaggcgacagagcaagactctggctcaaaaaaaaaaaaagaaaagcttattctaatttatagatgatgaattataatagatcaaactggaaagggaacacatttgacactgtttattttaatcaccagtatttaaatgatattcctatttttttttacgaaatgcggtatcttttctgttttatattcctactcatttgttttaattaaaattattatttaattttaacattcagcttaaccagaaacagaaaatttatcattaatgtattttcatactttatatttcagaactacgttacttttaacccaacaaataataaagaattggtgagcaatagtaaaacacgggcaatatattatgcatgggtaagcagaaatattttgatttgttttaaatgtgggtagaagtatgtgttcattctttgagtacaaatgtttcagtaatgtaacaatatagtatctctacttaggaagcaatgaatatatattaaaatgtttttatttaactgtagtatttagtcctattagaaattagcatattaaatcaaaagcaaataatccaattttatttattaaattttattgaagtaatgaggcaaatgtttatttgaatttatttaacaagactaaaatacaagttttatggtttttttggagatgaggtctcactatgttgcccaggctggcctcaaattcctgggctcaagtgatcttcccgcttaatcctctcaagtagctgggattagaggggtgagccggccacacctggctctaaaatacagcaggttttttttttttttttttttgagaccttggtcttttttcccttttagaaaggaattagcaaacagattagtgatacatatactgacacagggcaaaatcatgagaataaaaaacattgaggctgagcacagtggctcatgactgtacttccagcaccatgggaggccaaggcaggaggatcacttgaggccaggagtttaagactagcctgagcaacataacaagacctcatctctacaaaaaattatttaaaaaaatttaacagtgcatggtgatgcatgcctgtagtcccagctgctcagaaggctgaggctggaggattgcttgagcccaggagtttgagactgcaatgagctgtgatggtgatggtgccactgcactatagcctgggcaacagagtgagactctgtctcaacaaaacaaaacacaacaaaacaaaaaacgtttcaagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaataggtaggagatttccttttggggttatgaaaatgtcttggatctagatggttgctcagcattgtgaatgtatgaaacaccgctgaattgcacactttaacatggttatgattaattttatgttaagtggattttacctcaataaaaaattgtagaacaaaaccaaaacacattgagtcactgattgtgagtgatagtcattatttaagatatttattatagctttattttattttatttttgagatggggtctcactctgtcatccaggctgcagtgcagtggtgcgatctcagctcactgcaacctctgcctctcaggttcaagcaattctcctgcctcagcttcctgggtagctgggattacaggaacctgccaccacacctggctaatttttgtatttttagtagagacggggtttctccatgttggccaggcttgtctcaaactcctaacctcaagtgatctgcccgcctcagcctcccaaagtgctgagattataggcgtgagccaccgtgcccagccgattgtgactttacatagtacttaatgcaaattcgaattctctattaataagcctttaaaactttaataaataccttaaggtcggccgcagtggctcacgcctgtaatcccaacactttgggaggctgaggtgggcggatcacctgaggtcaggagttcgagaccagcctggccaacatggcaaaaccccatctctactaaaaaaaaaaaaaaattagctgggcatggtagtgcgctcctgtaatcccagctactcaggaggctgaggcaggagaattgcttgaacccaggaggcggagtttgccgtgagctgagatcgcgccactgcactccaggctgggcgatagatgtgtttctgcttgaagacaccttatttaatatagaactccatctcaagaaaaaaaaagtcataatcatttgtggcattttttatattttttatgtatttgcttttctttcagaatgtttttagatatttcccaagacagcaagttctcttacctgtagaaactgcaaatttctgaccttgtttagatgtatttgttttgcttttattattaatgccgttcttcctttggaaactgggtctttttgagtagtgattattttttcctcttatcagtatgaagagagggatacactggctcacagtgccccacttttaactgaaaaagtgagtatgcctattgcatttttgtccatcagattttgtggagaataaatatttatgtgcaagcttagctgcttcgggctactctttgtacatcttgatattaagctactgggaaataatttgaaaaattttacttgggtcctgtatacatattgaattgtcagttgaaaatcatgtaagtattgttaaaaataatttttttttttgagacggagtcttgctctgtcgcccaggctggcgtgcagtggcgtgatcttggctcactgcaagctctgcctcccgggttcacgccattcttctgcctcagcctcccgagtagctgggactacaggcgcctgccaccacgcccggctaattttttgtatttttttttagtagagacggggtttcactgtgttagccaggatggtcttgatctcctgaccttatgatccacctacctcagcctcccaaagtgctgggattacaggcgtgagccactgcacctggccctaataaaatgttatacaaagagttattgctgtgagaaaatataaaaacgtgatggcttttagaatgtgtatgtgcatattgacaaggaatgaaagttgtgggggtgcagtggctctcatctgtaatcccaacactttgggagactgaggtgagaggatcacttgagctcaggagtttgagaccagcctgggcaacacaggctagacttcgtttctactaaaaaaaaaaaaaaaaaaaaaaaaaaaaaaattgccagccagggtggtatgagtctgtggtcccagctactcgggaggctgaggtgggaggatcacttgagcccaggtggtcaaggctacagtgagctgtgtttgtgccactgcattccagcctgggcaacagaacaagaccctgtatataaaaaaaaaaaaaatgaatgaaacagtgtaagtaaagtcgttgaacatgagtggatcccttataaagctgctcagtttcagaataatacatgatattaggtatttagatgtttgagagccaataagagggaggtgaaccagatgttgagaaaacattttatcttgcctgcttgccgcaagctcttgtgtctgaggtggaacttgagtcgtctcctgtagcattttctgcatttgctgcccatgtaacctgctctcagggagcacctgatgatgagttttctgcatacttgcttctctctcggtatgatttgtagaaatttatttaagagggcatgccaaaagacaaaaacaaaaaataaaaagttgagatggatgggcacaatgagattattctgtctgcagacttgtttttcataaatgaaagtactaaaaaataccatcagttctcattattgttggtagttatgttatataaagtctctgtaaacaccaaattagcagatacttaactattgctcttaagggaaatataggggtaggtttctgtgagcctctggtcacattttcaccaattgatcaatacataagcttgttttatgtgtatttctatttaaagacactttatttaatatataacattgattcattaacattgaactcatggccaacagcactataactcatgacttgaacaaaactcatctaacctacatattttctccataaagcacatcacagcattcttttgcttaggaacactagccagcacttcagcactatgtttcagggtcaatttaaatactaaaatcaccaagaaaaatgcaaacaaccaaaaatgcaaacaacatggcactaaatagaccatgaaaaggacacttgtttatagtcagagctgagacaagaaggcggagcattgccctgcctgccctcaactggaaatgtgcatgttgagtgagtaaaattatttgtcacactgcacatgcacttctgcaaatgaccgtgagagtgctgcaagtattgattttgggattacaaatcaattcttaaagtaggtaaattcgcaaatacagaatccacaaataatgagccatttgaaatgataaaaatgtattgaaacagtgctgctcttagaaagaacttggtgctcttgtttgactaatcattattttactattcctcttgtgttcaagtcagaagaggtaaaccttaggatcttctctgtattattagagaatcgggcagcatagagaatagggcatttctatgtacagtgcttaaatattttctactgatgggaaaataccttatgataaaaggaggctgggataattattttatgctattttataaccagagcatgctttgactcacaacaggcattagtttcttcaccagtctctgaaacctccataagagaagtttaacaggtataaacagtgattaaccactctctcgtttgctttaaacaaacaatgtaattgaacagagtacataacccttcacttgctcttagcaaacttccagaggttcagaactgcctggaccatggcaattcatgggagacggttttagtgattgttttctttttctttctctttttctcactatatttcagcatagcattataaaatatcgtattgataaatgctttgttttatatttattaccaacagtaactataacctttcttttgaaacagaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgataggtaattttaacttaattaaaagataactatggataattataaaaatattttaaaattgttatgggaggttgggcacagtggcttacacctctaatttcagttctttgggaggctgaggtgggaggatcacatgaggccagaagttcaagaccagcctgggcaacatagtgagaccctatctctaccaaaaaacaaagagagagagatgggaggattgcttgagcccaggagttcgaggctgcaatgagctatcattgccactgtgctccagactgggtgttagagtgagaccctcctgtcttaaaaaaaaaaaaaaaaaaaaaaaaaaaaaaaacctcttttggatgtatatgcatattttgtatagcataaagtattctggggagaatcataatgaactgggaacattggttgcctctgaggaaaagaactgagaactaagatcagggatgggggtggatttacttctttttatagttccatttatactaattggatttttaaaaaaatcatgagtatgcattatgtttaaaaaatccctttgtgtcgatgaaacaaaaaggaactagattttttcttctgtgctaattggatggattttgcacccaacattttacatgcattaaatgtaagaaaataatttgaatagctgtattatttttgtctgattacaagataacatttacagctgggagcggtggctcacgcctgtaatcccagcattttgggaggccgaggcgggtggcctcaggagtttgagaccagcctggccaacatggtgaaaccctgtctctactaaaaatacaaaaattaggcaggtgtggtggtgtgcggctgtaatcccagcatcttgggaagctgaggcatgagaatcacttgaacccaggaggcagaggttgcagtgagccaagatctcaccactgcactccagtctgggcgacagagtgagactcggtctcaaaacaaaacaaaaataatatttacccattgtgagaagatcaaatgcatcaaaactctgtcttaattaagacagagttctcatttcagctgggtcccttccttgctgagtgaccttgagcaaggaacttaaccttgttgagcctctatttcttcatctgtaaaatgggcataacagtactatttctctcagagtggttttatgaggatttcacgagatatggatgcacatgcttggtgcaggggaaccctaggtaaatggtggccatcgtcagtgtgtgagagaagttcccgaaggtgtggagaaaattgcctagtgatggggacgctacccatatggttagagtcactgggccatctgctttcaaaatgcccatttgcttccattcgcctttctttcgatgcaggggaacaatgaggtcttgacatggttttacaaagagaaatgcaaattgtcaccctcactcagtggagcgagaagataggagaactgcagttggccatgcaatcaacctttaatcggttggggtttaggatccagtggagaccaggcctgggttctccaagttaataaaacccagtcaggacctgggagtccaagaaggaaaaggtctctggaaatacttggtcagtattgctgcttctgtccagcagagggcagggacagatgttcaagccaattagcccacctgccttgcttattaatcagaaacctcatttaaccactctgcatatgtaagagaaaaatcctcctcatctgccccccgtgattagaattatgtcaaagtcttttttaaaaagcccatttgggatggatccaaggactggaaatgaaagccattttgtcacgtggcactgccttctgccgtgatgactggacagggttttatgatcacactaacagtagtgccttcctgtaaagtggctagtgtcccattgccagcctgcatgatttcagagggctggtgaagcgattctctccattgtcatctgtagttatatggggagtgtaaatccttgtccacctccattgcgtatggctgatcttggagggcagggaagaactagcagagagcatggactttgctttagatatacctgggttccttgcatagtcaagccacatggccctgataaaattgccaggtataagtatgtcccatgcaatatatgggatgtacttacactaaattttttgtttgtttgtctgttttgttttttgagacggagttttgtgcttgtcacccaggctggagtgcaatgatgcaatctcggctcactgcaagctccgccttccatgttcaagcgattctcctgcctcagcctcccgagtagctgggattacaggtgcacaccaccacacctgactaatttttgtatttttagtagaggcggggtttcaccatgttggccagactggtctcgaactcctgacctcaggtgatccacccgacttggcctcccaaagtgctgggactacagacatgagccaccacacccagctacactaaatttttttaatgcaaattttcaaagtaactgggtatctgtattgttacctgctaaatctggcaacacaatgccctgagcaaatttcttaactctctgaaagttagtttcctagatgtaaattgggataacagtaaaatcattctcgttgggagtattaaattaagtttttgcaatgccccagaatccagagcctgacatataattaggtattatatagatgctacttgttattattgctatttgcaaaactgatgttattctccatttcagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggtaagttgttaatgaatctagtcattagaatggttgaaaaatgatcactgtcttctttagtttgcatacagtgggaggttcgtgttgttcctgggatatctccctggctgattgtgataaccactggatcatttaaaaaattaatgaaacataaggccgggcgtggtggctcacgcctgtaatcccagcactttgggaggccaaggcgggtggatcacgaggtcaggagatcgagaccatcctggctaacatggtgaaaccccgtctctattaaaaatacaaaaaattagccgggcgtggtgacgggtgcctgtagtcccagctactcgggaggctgaggcaggagaatggtgtgaacccgggagacggagcttgcagtgagctgagatagcgccactctactccagcctgggcgacagagcgagactctgtctcaaaaaaaaaaaaaaaaaaaattaatgaaacatgactttaatattaagactctttagtaactggaagctgtaaagtcctgatccctgatctctcacctctgttgagtctggagtcttttgctgcaggttggtctcttttctctaagctgagcttgtcctagccactgcagttaaaggcactggataattaatagccataacatttcaagaccgaattatctgtgagtctgcttaattacccttgcagtagttacaggcacatctgtatgtgtgcaccaaactccatatttgcatacacaaatgaatatttgcatgtgcagattagctaattgtacaactgactgtccatctgcatacttaatgactcaatttacatggagaaaagtgggctttttcacttgcaaatggaggctgttgggtattggtggtatatttttggaaatgttgggttaataatgtcactaaattacagacgacagaggcgttttatgtgcaattagaagcagaatagctggcatgccccattccctgcaaacactgatattgtttggtctctccttggcaaacaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggtattttcatcttatcagcctaccatcggttccacatggacagccctgaaagggatggatgcacctgggctggcatagctccaggaagtctccccgactccagcccccagcaggctggatgaggcgccttctctctggggctcccgtggtgttctgggcctatctgtgcgtctctgcgcgctcaccccagcaggctggatgaggcgccttctctctggggctcccgcggtgtcctgggcctatctgtgcgtctctgcgcgctcaccccaggagatcacgcgtttcggttcatttctccgcacgggagctttgttgtgttagttgctgtcttctccgcacccagaacaaagcctggcacagactcaacatctcttgaatgaatgtaatccttttccatcgttctctggcttgtcatttcaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgtaagtattttcatggacaacccatccagtggcttagcaattttatttgaaaccaaaagaggccagacatagtagctaacacctgtaatcccaatgatttgggaggccgaggtgggaggatcattggaggacaggaattcaagaccagcctaggaaacacagcaggaccccactgctacaaaaacactttttaaaaattagccaggccttgtggcacacatctgtagccccagttatccaggaggctgaggcgggaggacccctgcgggccaggagtttgaggttacagtgagctataaggcaggtatgttggtctgcctttatgttgggagggaaaagcagtggtcttcgctaaactcctgtcccttccggcgctctccatccccacactggtgcggccactcctccggtttgtgtacacaacgcttctgaagccaaagctgtctcagcatactgtgggtgcacacagtccagcttctgtgtcccctcaggccaggctctcccactccaactgggttcacttgcagccttcatacctttcaaaaacacatagcttttttattatatgtagctggacaaagaaaagggaggacgaaggcacaaagagtcaggcttttggctttccacagacagcgagggggcacctggaaaggagtgtaaaaccatagtttcacgttcatactttcttccccgctaccttttcagttttctgcttttaactttaattttcttatctgtaaaatgggcattaggccaggtgtagcttatacctgtaatcccagcactttgggaggtcgaggcagtcagattgcttgaggcaggagttcgagaccagcctgggcaacatggtgagacaccccccatctctacaaaaactaatgaaaaaaaactagccaggtatggtggcatgtgcctgtagtcctagctacttaggaggctgaggctggaggatcttttgagcccaggagactgagactgcagtgagccgtgatcaggccactgcactctagcctgggcaacagatcaagactcttgtctcaaaaaaaacccaaaaaaactaaactaaaactaaaatggatattgttttactacttgcttgaatagactaagattatttttgaaaaaaatattcttagtatttttttttttgatagggtcctgctctgttgtacaggctgaagtgcaacagatcttggctcgctgcaacctcctcctcccaggttcaagcaattcttgtgtcagcctcccaagtagctggaattataggcatgtgccaccacgcccagctaatttttgtatttttagtagagatggggttttgccatattggccaggctggtctcaaactcccgacctcaggtgatccacccgcctcggcctcccaaagtgctgggattacaggcgtgagccaccgcgcctggcccataatgatgattcttaatttactaaacgtaaaatgggataactccttctcttttgctcatcttcaggatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttggtgagctgtttagttttcgttgacctggtcgccaagactgtgtctcactcttgtgacatccctggcatcttgcatagagccaggcccacagtacgtgtgtttgttggagaaaatgaatgcacagtgaaggatcacaaacctctccaggttggcattttgccttaacatggctgggacaccacctggggactcctgtgctgaacgaggaggcttcccgggcagcaacaagttagaaggcaaggagcggggagttccccatagcttggaaagcagccgcccttgcctcccagtgtgcacggggagggctgacactcactaacactgtcttcatgtccatcagttggggccaggctgctacctaaatgtgaaaactaggagaggttgtgagataagaggaaaaggtagggatgggcaaacgcaatattacagagtcaggtgaaatggattcaaccagtcattgtatctgtctgtttttccttcctccctccctccctcctttcttctccccctctctccctccctcccttccttccttccctttcttcttccctccctcccccgcccctcccttctttctctccccttccttcctttattcagtttctccatccattcatccatctgtccatccatccatccatccgtccatccacccatccatccatccattctgccctgcccacggaagcatacctgtatgggcccagttcagtggctactgatttgtgactgccaagtgttgggctgagatttagatatgaattagttcctaagataataagtgacacagtataacagaactgtaagacgtcaggtgtgggaatcagctggatctaaatttgaatttttgaatttttactctgccactttttagctatgtgaccttggacaagccactctgaacatccttgaacatctgttttctcatctgtaaaatgggcagaacagtacccctttgcagggaagttctgaggatgacatgacagctgtttttagagcactcagctcattgtcttccaggtagtgaattctcagtactgatgacttagtcagtgtcaggtctaggcaagtcttctcttaggagacctgataccgtctcccccagaacagcactgttggctgataattataaaggctgtcacccaagagcttggggttccttagctgagcctttaatttggcttggtcctcatgtgtgtccatctgggctcctctgcagatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcaggtaagcacccggagcttcccattgcagggggcgtggatcaagttctctgcccccaacctgtttcaggtctccacatagggacctgcaggcagcttggctactattatcatcctctttgctttgcagaggaggagactgaggcacagataacgtaagtaattctcaccaaggtcatgtggccctgtgtggaggtgagatgtgcagaatccaggaaggacacagaccctggggccctgggaaagttgctaatgctatctcctattctcctctcattaagaaaaacatagttttacctggctactaacaattgtttgattttttcttactcttgggtctcaaaggagttttaactttaattgctagccctcctttgtttacaccctgcgtgagccaggtaccgttttaggtgctgaagatgatgaaaacagaacagtttccatcactgtggagtttacatgttggcgggggcaggtgatgcaatggcgtgaacaagtagcaaggtagtaggtatgtggtaatcaggtctgtgcaaagaagaaaaaaaaaaaaaggaaaaggaaaaggcaggataaaaaggtggggaggcagggaaggccttggagagcaggggacatctgagcatccagacagagacttgaagaaagtgagggggaagcgaggggctgctgtgcggttggaggaaagacagtggatcagcaagggccaatgagtgaaggtgggaggcgtctggggtttgggaaatgccgcgaaggctggtgaggccagagtggaatgggcaaggagggggcatgggagagcaggtcagaggtacgggctggtgccaggcacacggcaccctggagactctggttccttcccgggtaaggcgagagctagtggagggttttgagcaggggagtgacatgttctgattgatgctttagaatgatgtctggcttctgtacagagagcagactctggggcgcaaaggtagaagcaagattcgggaaactggtgtgagagctgatggcggcttggccctgagggcagaaaagaggggtcagattctggatatatcctgccggcaaagcgaacagcgtttgctaatggagggaacaggaggtgtgagagaagacacctctcgaagtcagaagaatggactggacctttaaagagatgaggaggacaagggaaagatagctttgagataaaccaggggtcagactggacaaggcaagcttgagatgcctgcttggcattcaggtgggaacccacgaatcagactctggattgtggaggtcccgggagaggctgggctggagtcaggaacacaggatggttgaaggcacgagacggggaggacaccagccggggagcagggcgtccgctgctggggagcagggagtccacagccagggagcagggcatctgcagcccagcatcctagagtggcatctcctccctcctgatgccatcctgcacatgcacgtgggcccctgtgctttggcccctgtgagccctcacaagaaacactgacgattgtgcctcgagtacagcagggcctgcactgtcatcccattccctcatccacagccctgctaactattctcccaccgagcttcaggaggctgtgtgacttgtccaaggtcaaacagggcaggacttgacccttgaccctagccctgaccccatcctctactcagcgctgtggggcctcgacacagccctggctttgggatcttacctggtcagccctggaggggagcttctgcctttggtttggctgtgtcttgggtatggctggaaagaaggatggaggcaggagaagttcgaagggagaatgtttcagtgatccaccacgaccaccaccactgccactgccaccaccaccaggagaaggaagtcagggaactggcagcagctggctcaggcttgaagactatcatggttttgaaatgtatctcagataagacaggtcctcaaaaggccaggaccacccgggatttgttgttgttgttgttgttgttgttgttgttgtaaacagttctttcccagaaggcacaagaaaaaatgactgagaaatgccatgttttatggtagagagaaaaatccaggacagtttccttaaacgattaaaacactggaaagcatgtgtaaagaggagctttagaaagatttcagaatcattgtgcatagtttttaatgaaaacatactttttggacaaagaatatctctcagatatgcgcagtcctaagacactgaattggcagagctggagaatgagggctggcagacctcgggcctgaagttcctgctaacagtcattcactggaggaaagaggcaggagggacttttagacacaaagttgggagcttctgcctgttgatgatcaatctgaaattagcataaagcatcttaaaaatttttatcaaggtgatactcacgtaacataaaatgaaccatttgaaagtgaacagttcagccgggcgtggtggctcacgccccagcatttgggaggggccgaggcaggtggatcacctgaggtcaggagttcgagaccagcctggccaacatggtgaaaccctgtctctactaaaaatacaaaaattagccgggcgtggtggcatgcacctgtaatcccagctacgtgggagactgaagcaggaaatctcatgaacccgggaggtggaagttgcagtgaggcgggattttactagccactttactccagcctgggcgacagagctagactctgtcttaaaaaaaataaaataaaataaaataaagaaagtgaacagttccatggcatttagtactcatggtgctgtgcaacccccactgtagcttcagagcatttccatcattccagaataaaagcccttgcataaagcatcttgtaagctgtaggaataagaaagcctcataaccatggcttaattgggaaggaattgtctttttgtgataaatccaaaagaatgtaaaaatgcatttaaaaaagatttgaaagaacatgaaaaggcagttcacaggaaaaggccaataaacctatgagcagatgctcactagtatgtcaaagatgcaaatgaaaacaagatatcattttttcaccaatcagattagcaaagataaaaatgattgatagtgcttagcattggcaagaggctaggaaaacgggcactctcatccgcttctgggggcgggtgtgaatcagtgtaaccttttgggaaagcaatttgtcaccctctattaaattttatcatatcttctgacttctaggaatgtagcccacagaagtactcacacagtatgccaagacataagtaaacggatgtcttgtttgaaaatatttttaaaaatggaaacaatccaaatgcccattaataggggatgagttaaacaatggtttgtcagtacactggaacacgatgctgcttttagaaaagaaaaaaaaaggaagagtaagacagctctctgtgtaatgacgtggaaatatctcaaagatgtaaaatgagataaagcaaattaccaatgaagcatgaatagcataattctatttttatataaaattataattacaaaagaaattcttgagtcatatacaccaaattattactcatgattatcttgggatagggtgcagcaatgtggagatatagattttctccttcttcttcttctttttttttttttttttgaggcagggtctcactctgttgcccaggctggagtgcagtggcatgatctcagctcactgcagcctcgacctcccaggctcaaacaatgctcccaccttagcctcaggccaccaagccaggctaatttttcatagagacaggaaactactatgttgcccaggctggactcgaactcctaaccccaagcaatcctcccaccttagcctcccaaagtgctgggattatgggaatgagccactgcgttctgcccatgaccagagtcttaaaacctatgttgagatttatggaattttaaaaactcttcccttccctcccctcccctcccctccccttccctcccctcccctcccctctccttccctccccttccctcccctccccttccctcccctcccctccccttccctcccctccccctccccctccccttcttcttcctttcgatggagtcttgctctgtcacccaggatggagtgcagtagcgtgatttcacctcattacaacctccacctcctaggttcaagcgattctcatgcctcagcctcctgagtagctgggactacaggcgcgcaccactatgcctggctaattttttttttttttttttttttttagtagaggtggtgtttcaccatgttggccaggctggtcttgaaactcctgacctcagttgatccacctgcctcggcctcccaaagtactgggattacaggcgtgagccaccatgccccatccatgaccaaagagtcttttttttttttttttgagatggagtctcactttgtcacctaggctggagtacagtggcgtaatctcagctcactgcagcctccacctcccagtttcaagcgattctcctgcctcagcctcctgagtagctgggattgcaggcacctgccaccacgcctggctaatttttgtatttttagtagagacggggtttcaccatattggccaggctggtctcaaactcctgaccttgtgatccgcctgccttggcctcccgaagtgctgggattacaggtgtgagccactgcgcctggcccgaccaaagaatcttaaaacctatgttgagatttgtggaattttaaaaactctttctctttttgccttcagaaagacgcttctggggccagcttatggttcccctattgagcagacacaagtcctcccagtgagaagcatggcggagctacagaaacgctacttggtgtttattaacagagacaaggtaacagcgctctcttctccagttctgggagttgactctgtgtgtcatgagcagcagtcattactgaagatcacgagactcagagagttctgggtttacagccaagcccaactgcttccaccccagtcagctgtgatactgaaaattgcccttgatgagttaggaagactcttgggagacatttctgagcagagttactgcattttctatattcccagtgaagatacatgggccaccaaaggatttttccttcttatttatttacatggaaaaactcttgtaaaaatatgcaaattagttacactttgttgtacatttaatgaataatctgcgttgaaaagtgtaaagtcgggccaggtgaggtggctcacgcctgtaatcccagcactttgggaggccaaggcgggtggatcacgaggtcaggagatggagaccatcctggctaacacggtgaaaccccgtctctactaaaaatacaaaaaatgagccgggcgtggtggtgggcgcctgtagtcccagctactcaggaggctgaggcaggagaatggcatgaacccgggaggcggagtttgcagtaagccgagatcgcgccactgcagtccagcctggacgacagagtgagactccgtcaaaaaaaagaaaagtgtaaagtcataggttgtgagatgtattctggaaaaccctggacaactgaccatgaaggcagggaggaaagcttcccttctgtgtacctgttagagctgtgcaaggggccccctaccagggctggtgtgtgtggatgcccagctacattaaatgtggctctcacactcagagatgggtccagacacacaggtccttctggcacacagatctggaggtgacatgtgaacgtgccaggcctctctcgggcccagctacctgagtctgaatatccaattatgtgttcctttctaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaaggtacacgatggggcgagaaggaaggtatcaagtgtaaactccttttcactcagcaacagtgatagacactgaaccctactgcgtgccaggcactgtgctaggatgtcacagggcctggccttcaggttgctccccggtggcattgctcacattactctgcagacaggagttgctgtcctgtcccatggaccaatggtgtttgcagttcaggcgatgtgacagcaccttgggctcacccctgctccctaaaatgcttctccctctgctccacatatccacacctgctagaaagatctaggccgaccctccaaagcatatactacggaaatagtaagaggatcatttcaagtggtattttcggctcctcttctcaccctccctgccctgaatggagaacctctgcctgaggcgaggctggagaattctagagttgaacattggagagtatgtggactttgaggtgaaagggataatatgagtttgaatatgggcccaccctctactggctatggggcctagggcaagcttcttaacgtccctgatctttagattccttgcatgcaaaatgagggtgatagcatgtgaaatgggggtgataataggaacttctgtaggatccctgtaaagatcaggtagtttaataggggaaaagcacctagtacagagcaaagtactcggcaagtgaatgatttcctttcgtctcttcttcctgtaagggcatttgcttatgagctcagaatcttccctaataaagaggggacaagcacccacactgtcctctcatctacccaaatccggcatgctgccgcagggcagagtcaaccatgtggcagccggttcctgttcctgaccacttctccaagcccctgcgctgcctgtggctcggctgggcctctctcggtagtgtgacgttgaggagcaaaaacagctcagaggcaccttccttcctcggaaaacaaacctgattcctggctgccagcacagtgtaccccctgccatctgccaaatgcacatctttctttttatggcagatattgaagcttctactcttaacctgaatatgagcaaaaatagccggttaaatctgctttggaaccacggtggtttgagattgcacttgcagctctgacttccaccccaccttcacctgagagagcagatcttgggaacttgaggatttaggagctggaggtgaactctcctattgaaaagggatcatggcctcagaatggctgcctggttccttgctccctggcttgttgcctggaaccatgggggcaagccacaccctgtggggacaagcagaaccttcccttctatttgttgttgttgttgagacagggtctggctcagtcgctcaggctgtagtacagaggtgtgatcatggctcactgcagcctcgaactcctgggctcaaacaattctcctgcctcagcctcctgagtagctgggaccacaggcatatgccaatgtgcctggctaactttaaaaaaattttttttgtcgatacagagtcacaccaagcctaggctggtcttgaactcatgggctcaagccttgggcacctaaagtgttgggattacagatgtgagccactgcacccagctagaaccttccttctgaaatgtttgtcttcttctcagtcgtcgtgggatctggaatggtagaaatttaagaagaagaaaaaaaggcctctgctttccaatagctttcgcctggccagagtccaggcttctgagaatttcaatttaatctgtggtggggacaaaggatcattataaactaattatcacttcattgctgcttctggtgacttaatatgatcagcacttcactaatggagagaaatgtaaaaaacctaaacaagtaaacaaacagaatttcctactagagttactgatgatgagttgtaggggagataaagatgataaatcccctcacattcgatcatttcagtcagtgcaccccttggccccaactgctaccatcacagtctatggcgcttctgccccgggagagccccttccatcccctctctcagggttcattccgcacgccccttcttctcctgctccgtgctagcatgcaccctttctcttctccttgtctggcatctgtttccaaatcctgcattacttttttgtgctcatcctccctgcctcctgtcatcctgctgccctgctcagccaagagcagagagaccccgattcgaatcctagctaatcactacctgcttgctggatgacgccaggcaagtcccttcacttctcggagcctcagttcctccaactcttaaatgggactgctaccaccaagttcagaccattcctcctcctcctcatccagggagcgtttacagagcacctactgtgtgcttgccacagggctgagctttagctcctttccagaagtactgtatggattgctgggtacagagcaggttttcaataagtgtcatttcccttttgtgccctaatgacctcttttctgttgcaagtgttagaaacacaatttaggcaaaagggaatgtatgagaaggtcgttgggatcgcatgtagctacaccacaagaaggtcacggacagcggcacacttggtgctcacagcacttgctgtctacttggccctgctgttggcttcattctctgcagaactgggtttccttactcagcaggaagatggctgctgacagttcccaaatttcacaaattatagctctcaccacagagagagggagtctctttcccagcttgtgttggagaaatgccagtacagccccctggcccctctggggtcagttgacggtggccaggaggtaggggatgtaggggagctctgaacaccagagccgggagctgcaggctgttctcagaggaccaggtgctcttgctagcctttcccctcaggggctcctgctggggacaggctcctctgtgtcacttctggcctttacctggctctgctccagagccacatggctaaaagtggccttgctgctcactgagcttgttgggattgggcctgggcctggcctggaggccacagagagggagccctctcagctggacacttgcctccatggcaagtgctgagaagtggggaagacccttgctggaggggcccttgctggagggtcttgctggaggggccctcaggcacccctggagaatacccaggttcctcagaccttaagccagtccgtgggcttgtgcatgcctcagtgagaggacccaggacagtgcatggcagactcttcctaagaaaggtgtaggagtgtgctgatacccatttccatggccgtaataatcccaaccacttgtgctgagttttctcagggccggggcctgcactgagtgagttccatgtatcatctgatttcatcctgacagccatcctgggagccaggcaccaatattatccccatcagacacatcaagaagctaactccaaggggtctgatgactgcccaagcaatggaggaggcagtggagctgggattcacagccagggctttctaagtccaccccacaccttaacaaacattcattacaggaggaaaataaaggacttttgtctccaatctttgtgatatggtttggctctgtgttcctacccaaatctcatcttgaattgtactccgataattcccgtgtatggtgggagggacctggtgggagatggttggatggtgggggagcagggggtggtttcccccatgttgttctcgtggtagtgaataagtctcacaagatctgatggtttgataaggggaaacctgtttcacttggctctcattctctcttgccactgccatgtgagacgtgcctttcaccttccgccatgattgtgaggcctccccagccacatgaaactgtaacaataaacctctttcttttgtaaattgtgcagtctcagttatgtctttatcagcagcatgaaaatggactaatatagtacattggtaccagtagaatggggcactgctgaaaagatatctgaaaatgtcaaagtgactttggaactgggtaacaggcagaggttggaacagtttggagggctcagaagaagacaggaagatgtgggaaggtttggaacttcctagagacttgttgaatggctttagccaaaagcctgatagtgatatggacaataaggttcaggctgaggtggtctcagatggagatgaggaacttgttgggaactggagcaaaagtgattctgttatgttttagcaaagagactggtggcattttgcccctgccctagagatttgtggaactttgaacttgagagagatgatttaagatatctggtagagtaattttttttttttttttgagatggagtctcactcttgtcacccaggctggagtgcaatggcacgatcttggctcactgcaacctccacctcccgggttcaagtgattctcctgcctcagcctcctgagtagctgggaccacaggtgtgtgccaccatgcctggctaattttttgtatttttagtagagaaagggtttcaccgtgttagccaggatggtcttgatctcctgacctcgtgatccacctgcctcggcctcccaaagtgctgggattacaggcatgagctaccgcgcctggcctctggcggaagaaatttctaagcagcaaagcattcgagaggtgacttgggtgctgttaaaggcattcagttttataaagaaagcagagcataaaagtttggaaaatttgcagcctgactatgtgatagaaaagaaaaacccattttctgaggagaaattcaacccaactgtagaaagttgcctatgtaaccaatagctgaatgttaatctgcaagacaatggggaaaatgtctccagggcatgtcagacatcttcttggcagcccctcccatcacagtcctggaggcctaggagaaaatggtttcttgggacaagcccaggatcctcatgctgtgtgctgcctagggacttggtgcccggcatcccagccactccagtcatggctgaaaggggccaacatagagctcaggctgtggcttcagagggtggaagccccaagccttggcagctttcatgacgtgttgagcctgccagtccacagaagtcaagaattggggtttgggaacctctgcctagatttcagaaggtgtatggaaacaccttgatgcccaggcagaagtttgttgcaggggcggggccctcatggagcacctctgctagagcagtgtggaagggaaatgtggggtcagagcccccacacagagtctctactggggcactgcctagtggagctgtgagaagagggccaccatcctccagacctcaggatggtagatccactgacagcttgcactgtttgcctggaaaagccatagacactaatgccagcccatgaaagcagccaggagggaggctgtaccctgtaaagccacagggatggagctgcccaagaccatgggaacccacctcttgcatcagcgtgacctggatataagacatggagtcaaaggagatcattttggagctttaagatttgactgccctcctggatttcagacttgcatgaggcctgtagcccctttgtttcggccaattcctcccatttggaatggccgtatttacccaattttggtacctccattctatctaggaagtaattaacttgcttttgattttacaggcagaagggacttgcctgtctcagataagactttggatgtggacttttgagttaatgtgaaatgagttacgattttgggggactattgggaaggcatgattggttttgaaatgtaaggacatgagatttgggaggggtcagaggcggaatgatatggtttggctgtgtctccacccaaatctcatcttgaattgtactcccataattcccatgtgttgtgggagggacctggtgggagatggttggattgtgggggcagtttcccccatgctgttcccatggtagtgaataagtctcatgagatctgatggtttgataaggggaaacctgattcacttggtctctcattctctctcttgccactgccatgtgagacatgcctttcaccttgcgccataattgtgagtcctccccagccatgtgaaaccgtaagtccaataaacctctttcttttgtaaattgcccagtctcgggtatgtttttatcagcagcatgaaaacagactagaataccgtgtctgcgtttatttattaattcttacaacaatgctgtgaggcagaatcgtctcattttatagtggaggacactgatgccaggggggttaagtcacctccccagaatcacacagcttgccaggggtagagccgggacttgcacacatgtccgtgtgactccacactctggacacttccccacttccccactgtggtctacatgaggtgtgcttgatgtcgcagcaaaaaggctaatcacccgattagcagtaatccagttagtggattattagaatgatttctgatgattagccttttgtaggaggcaaagttggtctcatacaaaagtaggttttcttaccattgaaagggcctatttttggaaagtctgaccttgagttagagagcagagggttatttttatctgactggcatgggtccctgtggtctcctgagtttttatggaagcaattagtgttggcagttcacttgtacaatatcccattcttttgactctgatcgttcgtggatctaaagttacgggtaaggctgctctgtctgggaggattgtggtttcagaacacaggatgcctcccccacccccaggagagacatgttccccaaagattgcagacaaattgccaagcacctgccctgtcatcatcaagagaatatcaccataattaaggcagatgccctctacctctgagttccacgcttgaaatggaattttctggtttgggcttcattttaaaggaccttttcttaacaagtgtgtagagaccctaactgtatctgtgctgtgatacccttcagagggccgcagtgctgtgcggaccaccttctgagccatgctcatgcttgagcgctttctaatagagacatttctgttgttgttccagtgtcctggaggcagcggtttctcttgggggtgaagacttgaccccattctatggtctgctgtctggtggccgggaaggaaaattctacagggtaattgtccctagagtaaacacctcctggtaacatctagttaagtttgtaaagcaaatgtgcccagggttaaccttgctttattccaaagctttgttcccccattcagcttaaaaggtactttctagaaaatgtccttgaagtgttcatggatgcttcagacttaagcctaaatgtgtgttgtgtttccgttgtattcctacataggagctagaagactacttctactattctcagctccgcagtcaaggcatcgacacaatggagaccagaaaggtgtcagaacacatttgcctgtcagagcttccttttgtcatgagagcaattggcttttacccatctgaagagaaggtagggagaacgaaaacaagagcagcaacgggatgtgctatttataaaaaacaacctctgggaacaatcattataggtcaaagcaaaaattgcacatttttcttgcataaatggatcagaaagatggttctgggcatttcagatgcactcctgagtaactgccttatggtagagatatgctgtttctgaaaggcgcactcctcatggaagtttgatgttggttggagcatgggtcttgcaaccatggtgttgaattggacggactggggctgccgtctcagccctgacccttgctaggtgaggaccagcctcgtaggatttttttctttttttttttttttgaggtggagtctccctctgtcacgcaggttggactgcagtggcacaattttggctcactgcaacctccacctcctaggttcaagcggttctcctggctcagccttccgagtagctgggattacagacacccaccaccacgccccgctaatttttgtatttttagtagagacgaggcttcacgatgttggtcagactggtctcaaactcctgacctcaagtgatctgcccgcctcggcctcccaaagtgctgtcattacaggcatgagcgaccactcccggccagccttataggatttgaggaggggattgatgcctacgcagccctgggcacggtgctgggtgcacaggaagagctcagtgaatggagggagttattatccttgttagtctcgctgtctagttgctcttaacctagcaggtgttaatggggcacctttggaagctgggtgcttgtctggactgtggagcacggagggtgcagccgtccctcatgaccgtgctgcagaagcacccctagatgcaagaagccccaagcagagtcaagaagcatctcagggaaatgttcctcatgtaaactgttgtttaaagtgcaggtaagccggttgtggcagctcacgcctataatccaaacactttgggatgccaagttggggaggatcacttgagcccaggagtttgagagcagccagggtaacatagagagatcctatctatacccatcccccccaaaaaattgcccggtgtggtggcccatgcttgtggtcccagctgctcaggaggccatggcaggaggatcacttgagccccagaggtggaggcttcagtgcccgtgattgtgccactgcactccagcctgggagacagagcgagaccctgtctcaaaaaaattaataaataaataaagtacaatttattgtatttcttctgacttttattaatattttcctgttttatacatatttatataatcatatatataatcatgcatcatttaatgttggggagatgttctgagaactgtgtcattaagcaacatcgttattgtgtgaacatcatagagtgtccttatacaaacacagatggcagagcctactacacgcctgggccgtatggtagagcctgttgctcctaggctataaacctgaacagcatgcggctgtactgcatattgtagtcagtggtaacacagtggtatttgtgtatctaagcatatctaaatgaagaaaaggtacagtaaaaatatagtattatgaccgtatggaaccaccatcatatatgcaatctgtcattgcaatattattaagtgcagtgtgactgtatagatgtatatagttttaaaaaactaattggccttggcgcagtggctcacgcctgtaatcccagcactttgggaggcttaggtgggtggatcacctgaggtcaagagtttgagaccagcctggctaacatggtgaagccctgtctctactaaaaaatacaaaaattagctgggcatggtggcgcacgcctgtagtcccagctacttgggaggctgaggcaagagaatcgcttgaacccaggaggcggaggttgcagtgagccaagatcacaccacagcactccagcctgggcgacagagcgaaactctcctcaaaaaataaaaaactggccgggtgtggtggctcagacctgtaatcccagcactttgggaggccaaggcgggcggatcacgaggtcagaagatcgagaccatcctggctaacacggtgaaaccccatctctatgaaaaatacaaaaaaaaaattagccgggcgtggtggtgggcgcctgtagtcccagctattcaggaggctgagggaggagaatggcgtgaacccgggaggcggagcttgtagtgagccgagattgcgccactgcactccagcctgggtgacagagcgagactccatctcagaaaaataaaaataaataaataaataaaaataaaataaaataaaaacaaacaaaaaaactaattgataccacatggaatatgtgtttgtatgctatattttcccttaatagtgtatcataagtattttccattatattaaaaattctccaaggccgggcgcggtggctcacgcctgtaatcccagcactttgggaggccgaggcgggtggatcacgaggtcaggagatcgagaccatcctggctaacacggtgaaaccccgtctctactaaaaaaatacaaaaaataagccgagcgtggtggcgggtgcctatagtcccagctactcaggaggctgaggcaggagaatggcgtgaacccgggaggcggagcttacagtgagccgagatcgtgccactgcactccagcctgggcgacagagcaagactctgtctcaaaaaaaaaaaaaaaaaaaaaaaaaaaattatccgaaaacatgctttttaaaggatatattttaattttttaactttttctaatttagaaaatagaattataaagaagaaaatagaaattactcagagatcatcactgttattattttggtagatatcctatcattttatatatggacatagatatatctatatttttaaacaaggaattgagattatatggtatatatatgtatatacctatatatatcaacattatacagaggatgcgtgtgcatatacatatgtatcgacattctcagtaacttgttttgtgagcaaggtggtaaaaattccttggcaacatgcttttaaaggctgcaaacttaattggaccactctccagttgatagccgtgtgagttgtctaaagtagctggtgtcagagacacagctgtgtggagcatctctgtgcatggtttttgcacacttctctcattattttcctgggtcatagtgcaagaagtagaattactgggtcagagaatatgaaattgcagaccctattgctaacctactttccataaatgtagcattttacgtgcccatcttcaggaatccacaagtcctgaaacccagctaagactcagtgttcatgttggctgagaacacttgagcaatataaactgtggtcccagtccctgctctcggcttcagtggcctacccagaatcacctgttttgtgtgctccaggtacacaaaactcatttctcgagaaattagttatcagagccctttaatcccttctgagtcttgaacgaggaccttaaaatcaccaggtactgttgtaagctcctctaaaggtctttggctgatgtgcattttgtcatagcacattgctagaaacataagcaactctgagaaagttcgtacagcccacgtggtgttccagagagtggcattttccaaagagtgttccctagaacatggcttcccaaactgggaagctgcatcggagcatttactgactattcagctcctgggccctgcccaggtccagccaatcggaatctccaagcacaggcttgggattctctacatctcctgggggtgctcactgcggagccgccgacatttgaagagagggaggggctcaacacactgagtgagatcattagtcagctttcttcttctttttttttttttttttttgagacagcatcttgctctgtcacgcaggctggagtgcagtggtgtgatctcagtttactgcaatctccgcctcccaggttcaagcgattctcctgcctcagcctcccgagtaactgggattacaggcatgcaccaccatgcctggctaatttttgtattttttagtagagacaggatttcaccatgttggccaggctggtctcgaactcctgacctcaagtgatccacctgcatcagcctctcaaagtgctgggattacaggcgtgagccaccgtgcccggcctcagccttattctttggttacaagttacggaaacctaagtcgacccattttctggttcacagaattccaggtccagagggagtggggatgtgcagtgtaacctaagccaggccctcatccatgtcgctgggaagggtctctctctttaggcctcgctttctgctgtgttgtctccctccgtgtccggcccccagtccacatccagtgggattcaatgccacaggcaggagcctgtccccttcccagagctgcagacattgtcactgtcatcactgccatcaggcatgtgccactcaggttggccaggcgtgggcactctccttcttggagtgtggggtgggctcagtcccctttaaccatggggactatgaccagatgacagctaagacgtgggcaggtgtctcagcctcttcatgcttcagcttcctcatctacaaaatgagtgcagcagtcgcacccaggaccactctgagcaggtggcgtggcttccacggaattctgagcaaggcaaaaagtgggcccctcttcattctcacttccttctttttttttttttttttggagacagggtctcactgtgtcacctggtcctccagcctcagccctccaagtagctgggactacaggagcgtgccaccatgctctgctaatttttcaattttggtagagatggggtttctccatgttggccagacgggtctcaaactcctgagctcgagccatccaccctccttagcctcccacagtgctgggattctaggcatgagccaccgctccctgacctcatttccttctcattttacattagaaatgttgcctcagatgtctcactgttcccacggccgctgcacttcatctgcatggttctgtctgtggttctgcttcttctgtttttagtccaacgtttaaccaaatacccacctcctctgggtgattggttggcctaacacttggtacttcaagatggagaaagggaagaagcacatcttggtgcaaactagctggcctggctgcagttcccagcctccttggcgagccatcccagcggtggtctgaacgccggagtctgctctgtagatgaggctggagcaggctgcgctctcgtaggggtgtcgtgaggactagagagcgagggtctgtgcggtgcccagcgcacagaggtgcttactcagtggggggctcttccctcagtatttcctgttgagtcagcatgttcctcttaagaggcgatgggatcgcccctcattttcttatttttaattttattttgtaaaattccaagcaaacacaaaaacagagaaaagaataaaatgaactcttggccagtcacggtggctcacacctgtagtcctagcactttgggaggctgaggcaggaggatcgctttagtaagcccaggagttcaagaccaacctaggcaatatagggagaccctgtctctacaaaaaataaaaaaaaaatagctgtagtggcatgtgcctatggtcccagcttctcgggaggctgaggtgggagaattgcttgggcctgtgaggtcaaggatgcagtgagccgtgatcacgccactgcacacacacaccccacactcctgcatatccatcagtcaacttcagcttcagcaattctcagctcccgtttggtccagacccactgacctgctcccgccccatgggttattctgaagcaagttccaggcacccttgcctcacaaggaggcctttcaaacccaggtgccccttcctcagccagggagaggttctccttcacaaggcctgcaggcacctgaggttcacacttctatgaaagtcaccaaaatgccatcgtgggccgtgcctctcgcagttcctgtgggtgaggagtattccggcagctctctgatgcctgcaggtcagtgctaaccatggaggccacattgtggaggctccagggtcaggcagctctgggtttgaatcctgactgtgaccacgtgccagttacgacttggtcaagtttcagaacctctccatgcctcagtttcctcatctacaaaataaacataatagtagtacctacctccagaattattgtgaagattaactgagtatccgtttcgtacagtacacggcacacgttaaatgtttaaaaatgtcatctgatatttttgtctttgtcatgatatccccatctgtggatccgtgattccagaagccctttatgagaatgtttctctgaccttgtgcttctttgtgtataataccctttccaaaatctaaaagtttatattttcttgattttctggtaaagatactttacataaatgtccaaacgccatcaaattgatggcagtcttctcacttgttcaggatttttttttttttaagaggcagtgtctcactctgtcgcccaggctggagtgcagtggtgtgatcacagctcactgcagcctcgacttcctgggctcaagtgatccctctgccccagcctctctagtagctgatattataggcgcacatcaccacatcattcaggattcttgatttttttttttttttgagacggagtttcactcttgttgcccaggctggagtgcaatggcgccatctcagttcaccgcacctccacctctcgggttcaagcaattctcctgcctcagcctcctgagtagctaggatgataggcatgcgccatcttgcctggctaattttgtatttttagtagagacggggtttctccatgttggtcaggctggtctcaaactcccgacttcatgtgatccactcacctcggcctcccaaagtgctgggattacaggtgtgagccactgtgcccagccaggattcttgagtttaatccctgggctgtcctgctttgttggtgaggtgtttagccctggcaaccagtgcccacgtgtcgcacaaaatacttgagaaagagggtgggcacagagcaacccgcttgtctctgcttcctatagaaataaggaagtcctgcatatgcctggagtcccggctgcttgagaggctgaggcaggaggatcacttgaggccaagagttccagaccaacctaggcaacatagcgagaccccgatctctaaaaaattttaaaaattgggctaggcacagtggctcacaatcccagcattttgggaggccaaggcagagggattgcttgagcctaggagttcaagaccagtctgggcaacataaggagacccgtctctgctaataaacaattagctgggtgtggtggcgtgcacttgtagtcccagatacttggagggctgaggtgggaaggatcgaaggatcgcttgcgcacaggagatcaagactgtagtgagctgtgattgtgccattgcactccagactggacagcagagtgaggccctgtctcaaaaaaaaattagttggggatagtggtgtgcaaccggagtcccagctaccctggaggctgaggcaggaggattgcttgatcccaggtgctgtaggctgcagcatgctatgatcatgcctgtgaatagctactgtcctccagcctgggcaccatagctctccaaaaaaaaaaaaaaaaggtaaggaagtgtctaattattaaagatgtactcatttgttctatcattggcaaaaaataataaagcttaaacaacttatcaaaatcttgctgatgaagaaaaggtatccggaaaaaaatgttagttggtaacaaatgttacaaagtaacaaacattgacaattacttaaaaacataaagacagaaataaaaacggaggttgtaaggtttgcactggatgttgtatgttctcccggctgaccccaccacttcccaaaaggagagtttcggtgccgcactcagtgagggccccgctcacccttggattacagggctttttatctactttaaaaaaaaaaaaacgtttcctctttggagatgttttctgaaggctccaggtgtgccccacatcagtgagcagacttgattagctgatgagttagtttatatctgaagctacaccgggagaagtttctgaccttttgttttcaagtcagatttatagtgattaaaaaaaatcttttcagggctttgaaactaacccaggctttaccgtggttaatgaaacatttcctactgagatgtagccgctccccctccttcaggaagttgcatggagtatacgcctcactactggagtgtgttcacacttggttacagaaaagacgcagatgcagggtttaaaccagcggcccaaagactatacattattgatatctttcttacgtcattacaactgtcttggggatttgaagctagttagtgtggtacactgaagccaaattacacaagaatataaccctccccaaagaattcctagccattcccttctttcgcagaaagctgtgctcaggagcaaaacacagccaaagtggtcatggtgggctgctcctagaaatcattatttatttatttatttatttattttttgagactaagtctgtctcccaggctggagtgcagtggctcaatttcagctcactgcactcactgcaacctctgcctcccaggttcaagcgattctcctgcctcagcctcccgagtatctgagactacaggcgcccaccaccacacccagctaattttttgtattttcagtagaaacggggtttcacggtgttagccaggaaggtctcaatctcctgacctcctgatccgcctgccttggcctcccaaagtgctgggattacaaggtgtgagccacggcgcccggcctagaaatcatttttaaatgaaagatctgcagcatgtataatgttatcaaaggaaccatagcttaggtgtcatcgtttctacagatgatttcacatacaaggcagttccatcctctatctttataaatgtgtcttttcctccaggatgttggactgtccacgttgggatggggcccagcatatcattcgtttcctgcttacttgcaacttcacttctttttagcttgcagagtgttgtataatcttgacaggtttgggcagggaattaacattggtgcaaccacctagttctgtaaacttaagtctaatcctgtagagacgtatgtgcccagcaagtgcccacatggtggacgcttggcaaatgttgatggaatgagtgaatgaatcaatgatgctcattggtcatattcgacagcagagacagtgaggaagacacaatccctgacattattatttgatctcagtgtaattcttagtaaccctaatgtgtttgatatattcaggagcttgggcatagcttaggagcatttagaaaggaattaaatagtcacttaactttttattttatttgctatttattttttgcttaactttaaaaatgtatatatcttttgactcaacaaatgtacttttaagagtgtatcctggccaggcgcggaggctcacgcctgtaatcccagcactttgggaggccgaggtgggaggatcacctgaggtcaggagttcgagaccagtttggccaacatggccaaaccccgtctctactaaaaatacaaaaattagctgggcatggtggtgcatgcctgtaatcccagcaactccagagggtgaggcaggagaatcgcttgaacccaggaggcagaggttgcagtgagctgaaatggtgccaccatactctccagcctgggcgacagagcaagactccatctcaaaaaaaaaaaaaaaaaaagggagtgtatcctacagaaaaactcacccaagtttataatgatgtacatatggaaggaataattttaaatatataatatatataaatattgagatggagtctcactacgttgcccaggctggtctcaaactcctgggcttaggcaagcctcttgctttagccttcctagttgctgggactacaggccctccaaacctgtacttgacctgaagggacaattgttgtcacatagtctattgtgttgaaaatcaaaacaacactgatatccattgataggagatgagattaataaaataaggcacacctacaagtgagattggcctggtactgtgtctcttcacctgtattcccagcactttatgaggccaaagtggaaggaccgcttgtccttgggaattcaagaccagcctgagcagcgtagtgagaccttgtctctacaaattattattatttttttgagagagtcttgctgttttgcccaggctggtaggcaatggcgtgatctcggctcactgcaacctccacctcctggattcaagcaattcttctgtctcagcctcccgagtagctggaattacccgcagtgccaccatgcccagctaattttttgtatctttagtagagatggggtttcgccatgttggccaggctggtctcgaactcctcacctcagatgatcctcccaccttggcctcccaaagtgctgggattataggcatgagccaccatggctggccacgaattttttttttttttttttggagaccgagtctccctctgtcacccaggctgcagcgcagtggcacgatctcagctcactgcaagctccgcctcctgggttcacaccattctcctgcctcagcctcctgagtagctgggactacaggcacccgccaccacgcctggctaattttttttttgtatttttagtagagacggggtttcaccgtctctacagtgatcagaggatcactgacctcgtgatcctcccacctcggcctcccaaagtgctgggattacagatgtgagccaccgcgcccagccgaatttttttttttttaattgctggatgtagtggctcacgcctgaagtcccagctactcaggaggctgaggtgggaggatcacatgagcccagaggtcaaggctgcagtgagccatgattgcaccattgctctccagtatgggcaacacagtgagactctgtctcaaagaaaaagaaaaaaaaaaaaaagcccatctaggggttctataaataaaaggccgtttcattcagtggcatctgccctccttaggagacagttgtggctataaatttggggagacctcggacatacatttctgtactatttaagttctcctaactataaacatgcagcttgtgttgcttttgtattcagaacaaaaacgagaaagataaacaagcaaatccccccaaagccctgtgtgctaatcttcatggctaaagcagggtcccagctgggatggaggtctgtagccaagtggttcagcctcacccataacgaggggggtaatttgagccaagaagcacagggacaatttctgttctgataaagaccccgagggaatttggaaatttgcactttgaagagaagccctcagtatgttgggtcttgccctgaaacgtaaatatcagcaggcatttccatcctgaaggtaatagaagtggcccagtgttctaggggaggccttcctggccaacagagagtccgtggccaggcccctgcccagcgagaggtgggcttcctgcagaaagatcagagcaagacaaaactatttctgcttttcacatgtaaagcatttaaagaaataaatcttggattactatgcagccattaaaaagaatgcaggcgatagagtccaggcctggtggttcatacccgtaatcccagcagtttgggaggctgaggtgggcgcatcacctgaggtcaggagttcgagaccaccctggccaacatggtgaagccctgtctctactaaaaatacaaaaattagccaggcatggtggcgcacacctgtaatcccagctactcgggaggctgaggcaggagaatcgcttgaacccgggaggcggaggttgcagtgagctaagatggcaccattgcactccagcctgggcaagaaaagcgagactccgtctcaaaaaaaaaaaaaaaaaagaatacaggtaatagtaatgcataataccattctgggaaagtgaggcctagagagagaagaaagattgtatagtcacttagctaccgagggcacagccagggtttgaaccaagctggctgacccccaactccaggttctgttcctacgtatgtatgagttggtacaaagaaggaagaaaaccctaaaaattctggcatccaacactggttattgctgcaggacggggaatttcagggcattttattattatttttctttatatctccattgttagaatttttcataacaagcatgtttcactcttgactggttttatgatataaaagggtagatcacaatgatggtggaagatatattttaaaaatattttaaatatttttaaatatttttaaaaatatttcaaaaatattaaattaatgttcttagaatcgaaatgttgttacttgccattgccatggcttctccatattatttattttcttttcttaaaaaaaactttattgagatataccacataccacgtaattcacctgtttagaggatgcagttcattggtttttagaatgtccaccgagtagtgcagacatcaccaccacgtaatcctagaacatgtttatcatcccaaaaagaaaccccagacccatgagcactcacttcccatttctccttcaaccaccgatgtgctttctgtctctatggattggcctatcttggcatttcatataaatggagtcatgaaatatgtggtcttttgggtccagcttctttcactcactcagcatcatgttttccaggttcatccaggttgtagcttgtctcagtccttcattcttttctttatgattgagtaacattctattcgttcatgtagatatgccacattttatgtatccattcacgaacagatggacatttacgttttcccattttcttggctattatggataaggctgctgtgaacattcgtgtgcaagttttttgttgttgttggatttttttttcttttttttctcttttttttttttttgagatgaaatctccctctggctggagtgcaatggcgcgatctcggctcactgcagcctctgcctcccaagttcaagtgattctcccacctcagcctcccgagtacctgggactacaggtgcccgcccccacgcccagctaatttttgtatttttagtagagatggggtttcaccatgttggccaggctggtcttgaactcctgacctcaaatgatccacccaacttggcctcccaaagtgctgggatcccagatgtgagccacggtgcccggcccacatcacttcttcacttgagctaggaaccatctggggctttagggtgcatgaggcaggatcaggattttagagagctgtggacacagaattagcaaatccttgattgtgggtttggtacaaggtgcaagacttgtcattcagctaggactgtctctttcagacctttgaaaacattcactgggaagggaagagtccctggaggtgtttgagacctgggctctgatgcagggcagggtgacagtcactctaaagggccctgtgaatgggtgttgttcacatggagtagaagacagtgggcaagagcaccaggccaggccttggctgctgtcacctgagactgcgtccagagggcagaactgtgcatgcatgccccactcctggaaaaagaggcagtcgccatccagatctagttcctggagggaggtatggagcagttggggtcacagtgttgcatgaatcgcagagggggcgctcacaggggtctccagatgtggccatgcagtgacgctgcccagcccttacgccccctcctcagcccactactccctgccccgggtcagcgaggagatgcagggggtgaccaggggagggtatgagtgaagatgatgagtgggaacaagacactgtgccccattagttgagaatgttctagagggtattgtgcgttgggaagagggcgtggggaagagggtgagtgctcccagtcctactggtccatgaaaccattagaaaagcaaacctgcccccaccaggagcctgcttataaaaacaaggaatggccccagttcaaatatatcgtgttcctctccatttaatagggaggttgtaaaacttaattatagaacataattctaaggacatcaatggcttcctgaggctgacagcagggatcacagacccaaaggcctgcgtcatcaatgacagaggcagaaataagatgctctcgggtgaggggactccagcccaccaccaagaggccaccctcatgtcttggggcctggagcagtcggggcaacagaggcccagatgctgtatgtctaaatgtttaaaagttaccaatcaagcaacaagctgataaataaatattcccccttgacagttcaaccttcaacatgagctgattcaaagttcacacccgaatgggcagcatgcagggccaagccaagctgggcctgccccatgtgtcctcccagctctgaccccatccctggccactgtgtgcatggcattcaggaggtggacccttctctatactctccaaacagcagccccggggcacccttcaggcctatgggtgggcaacaccaggggcacaggttggcctcaggagggtgagatccccatgggccccggaagtgggcttaggttatgtaggggagagaagcctcgggttcaggtacccagagtgtggtctagaattgggtgcatgggctcggggtgggcacctcctctgcaccctcctcctcatgcttgtttcccagcatacagtgtcttcctctgacctcctactggccaaacccttcatggctctgcagtaggcccacctcttccaggaagccttcccgaagcccacctggctgagagctcctccaacctttgatgatgttctcctgcatcttggcactgaatcttctagagccacggtagccaaccttttaaaatcagttgagggcacttaaaaaaatacatcagtatttttacacctgatttttacacctgggccccagccttgtgcaacagaacctaggggtggagtctaagcatggacagtttttaaagccccaggcagccagggctgaggaccttggcgatggagcctgttagttcgctttccttgtgtatatcgtctcttgagcatctcttcacatggcccagaccttaatagacactgaataaatatttgctgaccccagtgactaagattgaaaaccagaatgcagaactgttctagtaataattgagagacttgtatttcattggctttgcactaaaccaaatgctcagtaactactagtaaatcgagtaaaattaactagggcactaaatgattattctaagcttcttgtgagtttcaagagaattctttttgtggcctcacttgtgtccacattatttacttcatcattcattcattcatccattcatccatctatctatccattcagtaaacatttctctgagcctctataatgtgccaggctctgaactaagctgccggggaaatagagatgaaagctctggctacagcttaatggggaaaacagatgtgagcccaaagaattagagcgtgcaccgcagctgccacccattattactctctactgaaagtcacaagcttggggctgattcattttggcaccagtatcacctccgtgaacccctgtggtctaagagcagcagtattcaaagtgtggtccccagaccaacaggattgacttcacgtgacctagggacttacaagaaatgcaaatggtcagaccctatcccagactcagaaaccccccaggtgggaccagcagtctgtttgaacaagacctcccggtcattgtgaagcctgacatgtcagcgagcctttgccttccagccatgtttctcaagcttggctacgcattcaaatcattcgaatgagaagcttccaaaaatttggtccccagaccaattaaatcaggatctcagctggttgtggtggctcattcctgtaatcccagcaatttgggaggccgaggcaggcagatcacttgaagtcaagagtttgagaccagcctggccaacagtaggaaccctgttgctactaaaaatacaaaaattagccagctgtggtggcgcgcgcctgtagtcccagctacttgggaggctgaggcaggagaattggttggactcaggaggtggaggttgctgtgatccgagatcacgccactggactcctgcctgggcgacagagtgagactatcatctaaaaaaaaaaatcaggttctcagggaataggatctgggcctcagaactgtttaagctctccaggtgaatggaataaagccccgccttagcaggcgtgagaatgccaatcaaaggccaggctgactgacaaccaccagtgcgtctgggccgctcagctaggactcctgcttctctcaagccatcttcacacgggggcgttcagaacaagctctgcgttctatttccagctccgaggttcctctcccaagcatgaactttgttcagacaagtagcagaacctgccttttcaacgaacacttgcgaagtcggctcaggaaggaaatgtcagtgatgccgaagctgccaactccgtgcttgttgagtagtgattcttgatcagtcatacgggaagagagagtaagaggtgaatcacatgctgagtggtttgtgctgtgaatgtttgctgagctctttggaactctctgggtatgagtaactcaggcccttatgaattccttttgtcgtcttagtctcctgttctgaactgagttaaatcatatattacattggtaatttatatatatttatatatattatttcttttttttttctttttcagacagggtcttactcctcactcctgttgcccaggctggagtgcagtggcacaatcacggctcagtgcagcctccacctcccgggctcaggtgatcctcccatctcagcctcccaagtagctgggactacaggcacatgcgccaccacgccaagctaatttgttgtcttttttgtagagacaggatttcacagcccaggctgtctcaagctcctaaaacgatctacccactccagcctcctaaagtgctgggattacaggcgtaagccaccccacccagccaaattataatttatcttatgttatgattacatgtattgtaattagcaagtgcatagaaaaatataatcacaagagctctccctctccctctcccactccctctccctctccgtctccctctccctctccctctccccacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctctgcccggccagcaccccgtccgggagggaggtgggggggtcagccccccgcccggccagccgccccgtccgggagggaggtggggggggtcagcccccccgcccggccagccgccccgtccgggaggtgaggggcgcctctgcccggccgcccctactgggaagtgaggagcccctctgcccggccagcaccccgtccgggagggaggtgggggggtcagccccccgcccggccagccgccccgtccgggagggaggtggggggggggtcagcccccccgcctggccagccgccccatccgggaggtgaggggcgcctctgcccggcggcccctactgggaagtgaggagcccctctgcccggccagccgccccgtccgggagggaggtggggggggtcagcccccccgcccggccagccgccccgtccgggaggtgaggggcgcctctgcccggccgcccctactgggaagtgaggagcccctctgcccggccagccgccccgtccgggagggaggtgggggggtcagcccccccgctcggccagccgccccgtccgggagggaggtggggggggtcagcccccctgcccggccagccgccccgtccgggaggtgaggggcgcctctgcccggccgcccctactgggaagtgaggagcccctctgcccggccaccaccccgtctgggacgtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaataataatcacaagaataattactgtctgttgaatgcttgctatgtgttaggcattatgttaagcactttacgtacatagtctcaataagcttcagaaaagcccaatgcatacgtattactgtattccctgctttttcaagatgaggaaactgaggagaaggaatgtgagtaactcactcaaggtcatatagacagaaaatggcagagccagagtttgaacctaggtctatcatcaaagattgctcttttagccccaacctctactgcctcatggtaaatagtagcattcctatgtagtaatactgtcaaaattatatagtgcaatatgcaaataattgctactggatagtgttttttcctacataaaattatacatgatttaacaagcaattgtacatagtataaactcagtaaatgctgtatatgaaacagtgttaccatttacagctacttttataatatcaattatgtatcaattacagttaatttgtatctgtaaccaataatgttatttcaacattcctggaatcttgccttttttttttgagacaggttctcactctggcccaagctggagtgcagtggcacaatcagggctcactgcagccttggctttctgggctcaagccatcctcctgcatgagccccccagtagctaggactgccaccacacctgtttttagattttagtggagatgaggtctcattatgttgcccaggctggtctcaaactcctgagctcaagccatcctcccaccctggcctcccaaagtgctgggattataggcatgagccaccatgcctgacctggaatgttgcattgagaatatgtggcatctctgaaactactaggtgattacttagatacagcgttaaaggaaaaaagcaggatgtaaaattatacatatgataccagttttgtaaaaaatatgcatgtgtattttatatgcatagaaaaaataggaaggaagtgccccaaatctcaccgaaattgtgattggatggttggattacaagagatttttatttttttcttgatacttgaggccagaccaagatgtgagggtgaagggtacttgagataggttggtagcttggcagtgctgcaaactggtgtcctctgaatttttgttccacattttttaagtgggacatggagaaattggttaccgattgataagtaatgtgtacaaatagagattaaattcctggttcattcccacagaccaaagtagaatgcctgttctttggcaggagcagggaggagaggaagcaaattggttcccacttctctgttgctcttattctttctttgtaaaattccaaaccccacagtttattgggaaacatcctaggttaaaatgtaaatgctaaaataagttactaattcctagccctttcactggtataattggggtttctgcatttcagctgactgctacatgcacggtacaaaaatactgcacagagagaggctgacggcagtgaggaacagttttgtttgtttctttatttattatatttctctcttcctcgtgttttgccagtgacataaggcgtcctgtgaggagtcctgtgttaactggccccgcatttccacttaaacctaggcatgtcagcacccttttctcattcgagaaaaattagaaaatacacaaactttccaaatgagaaggggaaaattttttaaattattatttttttaagctgcaaagaatgaacgtctaaaagatctcatgggcttgggctctgtaggagttggcagtagtaacaccatcacccgatcatctgctggtggccaaaaggaaagcccttatcaaaaaggtatttaggagcctggagtcacagcttttatctctgatgggaagctgtgcacactctaaagtgaggtggcctggtgcagccccactggagggtgtttttaagttcttgcagtgacaagttgtcacattttctttttgcttcatccagatgcatgaatcaaagcaactgaagtctgaaagggaatgaaatgccatgagccagtatctgtaacctgcgggtgacaactcgagagcaacaagtgactgggtttaagatgatctccttttaaaggcgtctttaaagcaaaaggaagcatgtgtgttagggatccacgcgcatgtgatgaaccacatagagcagtgaagtggtgcaaatggaaaattcagtagccagtacatggggcgaggaggtagtgagatggcacgagggaacagcacatgcgtgaatgcaaaggcgtacgccacaacacccggctcatttttgtattttttgtagagacagagtttcaccaggttgtgcaggctggtctctagttcctgggttcaagcagttctcctgtcccagcctcccaaaatgctgagatggcaaggtgtgagtcaccgttcctgaccatcatctctcaaaaaaaaaaaaaaaaaaaaggcatgcatgatggctcactcctgcatccctacactttgggaggcagctgtgctgcagcctgggtgatagagcgagattctgtctcttaaagaaaaaaaatttaagtcttccaatccctgaatatggaaagtctttccatttacttatgttttctttagttttttttttttttacaatattttgtagcttttagagcacaaatcttgcatttttgttaaattgattcctaagtactttattcttcttaatcctattataattggaattgttttattaatttattataattattgtgctgttcactgctagtgtgtaaagaaatacaatagtttgtttttttttttttgagttagagttttgcacttgtcacccaggctggagtgtaatggcgccatctcagctcactacagcctccacctccccagttcaagcgattctcctgcctcagccccccgagtagctgggactataggcatacgctaccacgccgggctaatttcgtatttttagtggagacagattttcaccgtgttggccaggctggtcttgaactcctgacctcaggtgatctacccaccttggcctcccagagtgctggaattacaagcctgagccaccatgcccggcctcaattgattttttttttaagacagggtctcactttgtgtcccaggctggagtgcagtggcatgatcatgggctcactgcagcctcgaacttgtgggctcaagcagtcctcccacctcagccccctgagtagctggaaccataggtgcatgccacatgcctgattaattttttgttttctgtagaagcagggtcttttaatatgttgcccaagctggtctcgaactcctggcctcaagcaatcctccagcctcagcctcccaaagtgatgggattacaggggtgagccactgcacctggcctataattgatgtttatattattgatcttataccctgcaaccttgctgaagttgtttaccagttctaatagtttttagtgtaatatatatatatatatatatatatatatatatatatatatatatatatatatatatgattgtgttatctgcaaatagagatagttttgcttctcccattcaattctgggtgccttttatcttcttttcctgcctaatttccctggctagaacctccaggacagtgtggaatggaagtggtgccaggtggctcatgcctgtaatcccagcacattgggagaccaaggtgggcagattgcttgagcccaggagtttgagaccagcctgggcaacatggtgaaaccccgtctctaaaaaaaaatacaaaaattagccaggcatggtcaagcatgcctatagtcccaggaactctggaggctgaggtgagaggatcgcctgaacctgagaggtcaaggctacagtgagcagaggttgcctcactgcactccagtctgggtcaaagagtgagaccctgtatcaaaaaaaaaaaaaaaaaaaaaaaaaaaaagggggaagtggtgagagtggacatccttgtctttttttctgatcttaggaggagaaagcatttagtccttcatcattaagtatgatgttagctgtgggtttttcacacatgcccgttattgggttgaggaagcttctttctattcctagtttgttgagtgtttttaccatgtaaagttgttagattttgttaaatgctttttttctatgtctgtttagatgatcatgtggtttctgtcctttattctgttaataataatgtattatattaattgaggttgacatgttaaaccaaccttgcattcttgggataaatcccacttgatcatggtgcacaatcattttgtatgctcctggatttaatttcttgtattttctggaggatttttccatctaaaataattggaaagtattcctttttcctctatttttgtgcagtttgtggaaaattagtattctttttttttccccccgccgagacagagtttcactctgttgcccaggctggagtgcagtggcacgttcttggctcactgtaacctcaacttccagggttcaagtgattctcatactgtgccaggctaatttttgtatttttagtagagacagggtttcaccatgttggccaggctggtctcaaactcctggcctcaagtgatcctttggccacggcctcccaaagtgctaggattacaggcatgagccgctgcaccagccctactgtccaatttttagaaatctatcctggtgccttttctatttactgtggtcttttttttttccccatctttcccctagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtaagcacatacatcaggatgtctggtaacatcctggggccattcccagtgtagagaactgagtttggggagccagcccctgtggagctccatctttcatgaaagaggtgatttgaccagatttgagccatgaggggtctggctgacccacctgcatccctggcaagtacgaagtaatgggagggacccggagctagaaagcaaaagaatgtgattcgtgttgcaactacctgagcctcagcaagactcggcatcctcacttgtaaaatgggaataaaaatgccagctgatccatctccctgggctgtcataagatttgggttggggccgggcgcagtggctcatgcctgtaatcccagcactttgggaggccgaggcgggcggattgcttgaggtcagaagttcaagaccagcctggccaacacagtgaaaccccatctctactaaaaatacaaaaattagccgggtatggtggcacacgcctgtaatcccagctacttgggaggctgaggcaggagaattgcttgaacccgggaggtggaggttgcagtgagccaagatcacgccactgcagttcaggctgggtgacagagcgagactgtcaaaaaaaaaaaaaagaaagaaaaaaagaaaagaaaagaaaacaaatatttggattgcatttgtgaaatgcaaccacaccaaagtaaactttttaatttttacctactatgtttctcattattgtacatgaggatgtcaagtaaactctcttgggatgacagtttcatcttagtccaagtgggtggttctgagaggagggaatttgaaatgaagcagagcctggtccccgcagcatgctgtcctatttctctatgccagccccatgtatgttccttgcctggaggaccctgtttaacaccattaggaagcatatgtgacagtaccatgggactctagatcatttttgtgtctaaagaaaaggggctgggcgcagtggctcacacctgtaatcccagcagtttcagaggctgaggcaggaagatcacttgagcccaggagttcgagaccagcctggcccaacatagcaagacttcatctccaccagaaaagtttttattgtttttgttgctttttttttttttttttttgagacagagtctcgctctgttgcccaggctgaactgcagtggcacgatctcagttcactgcaacctccaactccagggttcaagcaattctcctgtctcagcctcccgagtagctgggattacaggccgcgccaccacacccggctaatttttgtatttttagtagagatggggtttcaccatgttggccaggctggtctcgaactcctgacctcaagtgatacgcccaccttggcctctgcaagtgctgggattacaggcatgagccaccacgcccagcctaaatttttttttcaattgagtaaaagaaaaaaaaatagtgggataattctctttaagacctctgaataataacgctaagccctgacagtatgcttagcctcaagagttaaacaatcaccttctcactctttgacacacaggtgagcatatgacggaggaggagatgttggattgctttgcttcactgtttggcctgaatcccgagggatggaaatccgagcctgcaacctgctccgtcaaaggtaccccagctggctttgtctgggcatgtagctgtggctcactgatttgttgtagacttcagtacatttatttctcctgatcggtgcaagccactctccctaagactgcacataacaaagcatgtctgttgggaatcccacatgaataagttatgaaaagaacagtgagtggtggcttttgttcccgcgctctgtccgtccttttgtttcttctgggcttattttccctttgttccactgacctgtcatcttgccggcttgggtgggtgaatattggccacccgtagaggatccagtttgacagctgtttcaggagaataggtatgtaaagagagacttgggggccaggcaccatggctcacgcctgtaattccagcactttgggaggccaaggcaggagaatcgcttgaggttcagaatttgagactggcctgggcaacatagcgagatcccatctctacaaaaaaaaaaccaggctgggcgcagtggctcacgcctgtaatcccaatgctttgggaggccgaggagggtggatcacatgaggtcaggagttcaagaccagcctgaccaacatggtgaaatcccatctctactaaaaatacgaaaattagccaagcatggtggcacacacctgtaatcccagttacttgggaggctggggcaggagaatcgcttgaatccaggaggtggaggttgcagtgagccgagatcacaccattgcactctagcctgggtgacaagagcaaaactccgtctctaaattaattaattaattaaagcaaaacaaaacaattagctgggcatagcggtgtatgcttttagtcccagctactcaggaggcttaagtgggaggatgacttgggcccaggtgttcacggctgcggtgagtgaggattgtgccactgtactccagcctgggcaacagagtgagagcctgtctcaattaaaaaagagagagagagagagaaagatttggagaaggagagagcatcaacttggtgggcagtacaagcccagctacaagctgccaaaactttcaggtttttaaagatcatcctcctgtcccttcctgctatagcctaagtatttttcaccttttcgtgcactggacctgaagttagggccgtgactttcagctcaggaggaaccaatctaaacggctcttctaggctcactggtacaggagcaactctgctgacaagcccggggatggtcagatcccaccaccatcaccaagactgaggagggtgcaaagacccctcacccattccccttttccctctccttttattgtccattccccacatcaaattaaacaaagtccctgaactcagataatttcagactccagtagctaacaggtcattcccaacctgcaagctctccctaccccattcctttatgtgcttcagatctcagaatgtacctttcctgattgttatatatttctgctgtgttcccaggcatcttgaaacagaaaaatcaatcataccatgtggttaaggctttccagtaaggtttgcagagatttggttaacagcgttctgttccgtaaaggagagatttttaagcaatttccacccagagtttttcaaggaatcaaagccaaatcacagcacaaagcccctcttgtttttgtttagtagcatttccttgtgtttttggaaaatcctcctgagttagaaacatagtcattgaggccagatgcggtagctgtaatcccagcgctttgggagtctgaggtgggaggatcacttgaagccagcagtttgagatcagcctgggtaacatagcgagaccccatctctacaaaaaaattttaaaataagctgggcgtggtggcgtgtgcctgtagtcccagctacttgggaggctgaggtgggaggatcacttgaccccaggagttcaaggctgcagtgagctatgatcgtgtcactgcactccagcctgggcaacagagcaaggccctgtctcaaacccctcccctcacccaaaaaagaaagaaacataatcatcatgaaggcatttggtgttcttttcttgttttggctaggttcagaaatttgccttgaagaagaacttccagacgaaatcactgcagaaatattcgcgactgaaattcttggcttaaccatttcagaagattccggccaggatggtcagtgaagttaccaggaatgtttaaagcacaaaggactttgggtgtgtgtgcatgcacatgtgtgtgttttccatgaggcactgctttttatgcatttccctcccccctctcatctttagaacatttagacattaaagcaagtttctggtgagcaatggaattcacaaagttggacattccactgtttctgaaatagaaaagtgggcggaggcgagaaaaaccctggcagctggatgtacatggtggctggatctctgggtctctggtgatgctgcctggatggggtttgcacgggatatggagggggcgtggtctcagggggcagaggggtcctcagccagcagcaggcctccctcgcgacacatgtggtccagggaaatgatggtccatggcctcattccctttccctgcagggccacctggaccctccgcccagtgtggcccagtgtggatcacccctgcctgttgtggggctggggtgggggtgccgggtgcgccgggctcctgagagtcccagattgtggcttcttatcagcaaaacacccaagtggtggtgtgtgaccgttataaagagcatcattagccatgcttaaccccggtggcagctgccaggagaatgcagaagcccctctgagcgcccccgagcctgttcacgctgcacctgcgccagaaaccacagagcagccccgcccagcagaggccggggcctccctcgcacccacactcaccagtgtggtggcttggccgcctcacactctgctgggccgcaaaacatgtagtaggcaaaaataggggccggttccccagctctgggacgttcagggggcgttactaagtttatagcagtattttggccttgaaaatagcatagcattgtagtgtgaacagatgagagttagtctgactttggagttttgtcatccgttctgaggcctcattcaggcaaaggtgccagatgtcattctccaacacactccgtccaacacaccccctagaccagcttcttcctcagagaaactagcatctgagataacatttctgatccacttaaagtgcctttctcggaaggaacattccgtggcagagaaacagaataacaaccacatccttactcatgcacgaagccccctccactacgtggggtccagctggaaatctggcatggtgagaatctttggaacgccccggaacgtggaacggaactgtctaccccaaaccaggctgtgtcactgtgaccttggggcagacagcacgggccaaggttctgccggtgccagcttgtcagatcatgtcaccagggctttgcaacctaatttacattttgttctttttaaaaaacatgaaaagaaaaacaagctttatgaatcaattttgcagctgctgagggcttaggagatctagtatcaagccagttaaaaagttcctggggacattttagggaacaagaaactctcaagtgacttgttctcttcaaaaaataactcggaattggatgcagtctctcaccaaccgggggcttcattcattgaatctggcgccctctgatttggttctgattgatggcatgtattggaattgtcttgagcagaaccgacctgtggtcagttggacccactatggcaggttcattaagctgggacactgcctagcgcaggcagatgctctttctctctgcccatccggcttcagcatctcctttggactcagagagcggggaggtggaggtcctggttatggatcatggttacggttatgttcactgaggagaccaaaatcaccatggacagcaggattggcacgaatggcatcccaccccacacccagcccagcctggcagggggacccttcttacctgggaacctctttctgcaggtgtttgtgggttgtttggtttttcgtttttgagatggagtctggctctgccacccaggctggagtgcagtggtgcgatctcagctcactgcaacctccgcctcttgggttcaagcaatttttgtgcctcagcctcctaagtagctgggattacaggcatgtgccaccagccaccatgcctggctaatttttttttttttttttttttttgagacagagtctcgctctgtcgcacaggctggagtgcagtggtgcagtctcggctcactgcaaccttcaccagagaaactagcatctgagataactcagattatgtcccaggttcaagtgattctcctgcctcagcctcccaggatacagctgggattacaggcacacaccaccatgcctggctaatttttctattttcagtagagatgggatttcaccgcgttggccaggctggtctcgaactcctgacctcaggtgatccacctgccttggcctcccaaagttctgggattacagatgtgagccaccgccctggccaaggtgcttgggttttgttgtctcccaacttccttgacaaaagcagggcacagccaattgcccctttcagctccaggagggcctcttcacctctcatcagggcaggcccagcctgttggcctcaaagatgagaaaagggaggacccagtggcccggtcccatcagcaggaaagaggatacagtgcagagagctcaggcttccagcagtagggtggcaaggcagcgacaacaggaagggatggcaaagaagacagcgtcgcggagcttgctcatgcatcacacttagggactaaatgctgaacaccaaaaacactgtgatgctcctttgcagaaagattcctgtgcgtttcacacggggcttgtggccggctgactcttacatcccggtttgtgagttctggatcaggaaccaccaagagcctccccggcgccagctctctgctccagacccggtcccacctgcaggtgagggcctcgcacgcacagcgtctgcgctgggagcccatggacttgccgcgctcctgttcagcttctgcaactttctagccacctgtgcgcccttgggtgtggctaagctcttagacctcagtttcctcccggagcaactcctgcggtggtggtgcggatgagaagagatggtgcaagtaaagcgttattggcacagggtagagctccaaatatgacagcagctattattatcacagcagaaactgtgcccgagaatcaggaagacatttggtgcaaattaacctctcccaaacccagagtttgagcaagagttagcgtttgctcaaataggggtctctcctagttttgacgatgagctctcaacaagtatttgtggaatgatggaatgaatgaatttgaagcctccctgctcttttctttttttttttttttgccgctctgtcacccaggctgcagtgcagtggcacaatctcggctcattgcaacctccgcctcccaggttcaagtgattctcctgcctcagccttccaagtggctgggattacaggcctgcggcaccacacctggctaatttttgtatttttagtagagatggggtttcaccatgttggccaggctggtctcaaactcctgacctcaggtgatccacccacctcggcctcccaaagtgttgagattacaggcgtgagccactgtgcctagccactccatgctcttttcatagctgacttagctttggaatgaaggccaatggcaggtccttatagggccctcatcaggctgggcaaacctcccctgtcaagggccagggagtaaatattgaggctcttggggccaaagggcctccgtagtgacttcccaatcctgccattgtagtgcaaaagcccccagggacaacacagaaaagaatgcccgtggctgcctcccagccccacttcacctatggacactgacatttggatttcatgataatttccacatatcatggactattatttgtcttttgtttttttttcaaccatttaaaaatgtgaaacccattcttagctcggagacctgcaaacacaggcagcagcctagatttgtcccacagggtgtagctcaccacccccgactctgcctcgtaggccaagggtactcattccagcagatttccacaaatactacaaatctgtaccaaacacctgaccggcactcttcaaaaaatgtcaaagtcatgacagacaaggaaagatggagaaactctcacagaccagaagagacggaaccatgacaactaaatgcagtgtggacacctggatccgttcctgaaacagaaaaaggacatcagtggaaaaactggtgaaatccagctaaagtctgtggtttagttaacagtgttgcaccaatattaatttctgagttttgggcggtgcgcagtggcttacacctgtaatcccagcactttgggcagccgagctgggaggatcacttgagcccaggagttcaaaatctgcctgggcaacatagggagaccccgtctctacaaaacatttttttaaaattagctggacatggtggagcatgcctgtggtctcagctagtcaggaggctgaggccagaggatcacttgagcctgggaggttgaggccgtagtgagccgtgatcgtgccactgcactccagcctgggtgacagagtgagatcctatctcaaaacaaaatttctgagttttgctcagtgtatcacagttgtgtaagatgttcacattagggaaactgggtgaagggtctagggatcatggcactatcttggcaagcctaaaattatttcaacataaagtttttatttatttttatttttatttttattttttgagatggagtctcgctctgtcacctaggctggagtgcagtggcgtgatcttggctcactgcaacctccgcctcccgggttcttgccattctcctgcctcagccagctgggactacagacgcctgccactatgcccggctaattttttatatttttagtagagatggggtttcaccatgttagccaggatggtctcgatctcttgacctcatgatccgccagcttcggcctcccaaagtgctgggattacaggcgtgagccaccgcgcccggccataaagtttttaaaaaatgaaatctgtaccacctttctgactcagtcacccctgaattatttccactatctgctctgtgctttcaattcttgagcagattctcctgccggcgccacagcacctggtcccctcactggctgcctggcctgtgcagacctggccttctgctgtgcttcgaggtgatgcaaacaaaaaggtctttttttaaacatctgtgtcctcaagctgtggctgcctgagacactggtgttttcggcttgagcatgttctttagggatttggccagcagttcccttgcgggcagctatttccaaattgactgtaataaatagatgccaggcgctgggagttgacagtagttgccaccctgctcatatgtcatgtaaccgccctctgctagcttagctggaaggaatattaaaaaaaaaaaaagaaaagccggttgatccaacactgttcagcggcagcgagatgctgactggtgggacagtgagctgcgggtctcggtgccccgaagctggtgttctcccgagtgcactgatgccaaggcggactcacatttatcagtgcccaggcgtgaggcatcagccccaggaaagtcgtccagcactggcatcactgccctccctgagagtgtgaaattgcaagtgatgccgtgaggcaagggtgggggcgtcaatactgaagctgccccgcctcaaaagggcttggaccatggctgggcacggtggctcacgcctgtaatcccagcactttgggaggccgaggcgggcggatcacgaggtcaggagatcgagcccatcctagccaacacggtgaaaccccatctctactaaaaaaaaaaaaaatacaaaaaatttagcagggcgtggtagcaggcacctgtagtcccagctactcgggaggctgaggcaggagaatggcatcaacctgagaggcggagcttgcagtgagccgagatcgcgccactgcactccagcctgggcgacagagcgagactctgtctcaaaaaacaaaaacaacaaaaaaagggctcggaccatcgtctgaggccccctccccatgtcctcttgttgttttgattggaagtcataaaacacatcagtgtaaatatagtatttatttttgcatatctttttaaagctgcatatctttaaagctggtggagttttttgaggggagcaagtttcatgaccacagcaagggcaggctccagtgagcacttcacgccacctggatgtgctgcagactgcaccacccccagcccaccggccagactggctgccctggagaaggcttagtgggtagtcccctgggcctggaccacggctgtccctgcacccgcgaggggatggggggagtggggcacatgcctcctggatgcgagggtggctgccgtcccccctcccctggaagcatctcatttcttcctttataatctgagcgagatggggctggaagaagtggctgtagccccagcactttaggaggccaaagtgggcagatcacctgaagtcagaagtttgagatcagcctgaccaacatggcaaaaccccgtctctattaaaaatacaaaaattagccggttgtggtggcgcgctcctgtaatcccagctacttgggaggctgagacaggttaatcgcttgaacctgggaagcaaagattgcagtgagccgagatggcgccactgcactccagcctgggtgacagagccagacttcatctaaaaagaagaaaaaaaaaacctgagagagatggacttcatttattacccactcacgaattcaacaaacgctgactgtgtgctgggccctgtgtgagggctgcctatctggagtgaacaagagagtggctgttgtctttagggggctcatgttaaacaaacacattaatgtaaacttgcaaacggtgctcagagctacgagggaaaagcccggcccctgtgagagggaatccctagaggggggcaggtttagatgaagtggtcagagaggggagaatgttccagagggagccaagtgagccaaagctgggagctgcggaagagccagatgcattcagtgaaccaaagctttccatggtcaaccctggggaatgctgcaggctcaagacaaggcatctagaatgacctctagtgttcctttaccactgccagtgtatgattcttcctcatgagcctgagtaggaatgtttcatatgggaagtgggtaggtggcggggtgcagcagctcacacctgtaatcccagcactttgggaggctgaggtgggaagattgctcgaagccaggagttcaataccagcctgggcaacacagcaagaccccgactctattaaatttaaaaaggaaaaaatgaagtgggtaggaagaatggaggctggtcaagtgttccaagtggaagatctggccacttctcatttcttcatattccagggtcctgatgtgggataggcggtcactcagagggtcccaggaaagactagccccaaagtcagtgtgttccttcctatgacaccagccacagattgaatggctcacagtgggtttcagccccacctactttaagtccttaagttggcactttttcatccttttgagatttccagggatttcaagtttttaaaaatgaaatcagctgggcaacatggctcatgcctgtaatcccaacactttgggaggtcaaggcaggaggatcgttttggcctaggagtttgagaccagcctgggcaatatggtgaaaccccatttttattaaaaatacaaaatttaggctaggcccagtggatcacacctgtaatcccagcactttgggaggtcaaggtgggcggatcacctgaggtcagaagtttgagaccagcctggccaacatggtgaaaccccatctttactaaaaatacaaaaattagcaggacatgttagcacgcacctgtaatcccagctactcaagcagctgaggcaggagaattgcttgaactcaggaggtggaggttggtgagccaagattgtgccactgcactccagcctgggggacagagcaagactccatctcaaaaaaataaataaataaaaacaaaatttagctgggcatggtggcacaaggctgtggtcccagctactccagaggctgaggtgggaggatcacttcagcctggagaagttgaggtgcagtgagctgttttgcacccctgcacttcagcctgggcagcagagtgagactctgtctcaaagaaggagaaggagagagggacagcttcaatttggtgtcaatcatgatctttggtttgcagtaatagaaattgactctgcttagcttaagtggaaaaggacttgatttcaaagctaccaggcaactcacagaatcaatggagacactggagaagcaagccctggagatgagtgggaaccaaaggatgccaggacgtcccagtggtgctgccacccctgagcacttgatcctccaatctcgttaagatttccaatggccacgtctgctgtgagtcatttctccattgtccctaccttcctcaaacctcaaagtcaaaatcaatcccacagtaagatcccgcttgacctccactaggatagctaaaaatttaaaaagacaataacaagtgctggcgaggatgcggagcagttgccacattgccggtggaagtgtaaaagggtgcagctgctttggaaagtagcttggcagttcctcaaaatgttaaatatagaattaccatatgacccagcaattcccttcctaggtatgtggccaagagaagggaaaatatacatccacacataaagaccattatgtacattagtgttcacagcaacatgaatcatagtagctaaaaggtaaggtaagaccaggcacgatggctcatgccacagatcacagatcccagcactttgggatgcgagggtgggagaattacttgaatccagtagttcgaaactttgagaccagcctgggcaagtgagacctcatctcttgaaaaaaacaaaacaaaacaaaacaaaacaaaaccaaggcagggcatggtggctcacgcccgtaatcccagcactttgggaggcagaggcaggtggatcacctaagatcaggtgtttgagaccagcccggccaacatggtgaaaccccatctctactaaaaatacaaaaattagctgggcatggtggctcgtgcctgtaatcccagatacttggaaggctgaggcatgagaatggcttgaactcgggaggcggaggtttcagtgagttgagatcatgccattgcactccagcctgggcgacagagcgagactccatctcaaaaaaaaaaaaaaaagaaaaacaaaaggtagaaacaaccccataaccatcaacaaaagaatgaaaaaacaaattgtggtatatctatacagtggaatattatttagctataagaagaaattatgtattaatgcatgctaccggatagatgatctttgagaacatgctgagcaaaagaagccagacctaaaaggccacatattgtatgactcaattcatgtgaaacatccttaatttacgtgaaaccatatagactagtggttaccagggaccgtggggaggggacagagagtgactgtttaatgtgactgtttaatgggtacagggtttcttttatggatgatgaaatgttctaaaattgattgtggtgacagttgcacaactccgtgaatatactaaaacccactgaattatacactttaaaagggtgaattttatgctgcatgaattatatcttaatagaaccattattttaaaaaatcaaccggctagaccatccaccatccacacctaaggttggaacccattcccaggacttaactgggcccccagtgaagagagagacagaccccctttagctccggtagcggggtggggaggggctgcctccacccacaaaggctcacccagaactaggagggtgttcagatgctgaacaggtggaatcactccacatgtggagagtacaggggaagaagtctgggcagccttctagatccctgacctaagaatgtaccgagcctgtgtgtagaaggatcccaactttattccaagccactgggtcatccagactttctgcatttagaaaatgctaataatttgggacctcactgagttccaccagctgcgtgttgctgaatgcttatcaaccagctctgggtggggaagaggggaggggcctgacgtatagcacttgccaatttccatagtgtaaatattcccattagagctgatttcaaactatcagcattatgacatgtgtggagtccggaagccccggttccccaatcgggagagctgagttctggccacaactctgctaagtggctgggcagctattgaattgtagctttcttttctgtaaaaggagggaggtggccttgatggtctttgtcgtgctttgcttcatcgcctttctgttcctgtgtcagaggaatggagtatatttcattctgtggttggagctttctccttaaagctttgcctctttgctaggcctggctaatgacctgctccctaaacaccagagcacctctgtttatgaaaccacaggctgctgctgccgctgcaagttgctaggctgcagagactcaccgaggctgggcctgcacgcgcctcacaattacacatctctgttccagagatggaaacctcctccaccccgcagtggtgaacgagcctccaccccgcagtggtgaacgagcctccaccccggaggaacagcagcaggagtggatggagacttgaatttagaaagcagggaaaggggaatcgtttgacttcagtccctagcgagggtcattacatagtaatgatgtttaatcattatgatgattataatgatgacgtgaacaatcgtacaggtcctctaacaaatatagtcatgtgtcgcttaacgacgaggatatgtcctgagaaatgcattgctgggcaatttttttcctgtttttttaagagagtctcattctgtcactcaggctgcagggcagtagcacgatcacagctcactgctgccttgaactcctgggctcaagcgatccttccacctcagctggctgagtaactgggactacaggggtgcaccaccacacctggctgatttttttttcatttttttgtaaagactaagtctcgctatgttgcccagactgggcttgaactcctggcctcaagtggtcctcccactttggcctccaaagtgctgggagtacaggtgtgagccagccatggtgcccagcccagacaatttcatcagtgtgcaaacatcacggagtgtgatttcacaaacccagatggtgtcacctactgtaaacctaggctgtatggtacagcctactgctcctaagctacaaacctgtacggcctgggaatcctatactgtaccgtactgaattctgcaggcaattgtaacacaaaggtaagggtttgtgtatctaaacatttctaagcatagaaaaggtacagcaaaaatacagtgtaaaacataaaaaatggtccatctgcacaggcacttaccgtgaatggatcttgcaggctagaagttgctctgggtgagtcagtgagtggtgagagaatgtgaagacccaggacattactatccactactataggctttacaaacatggtacacttatgctgcattagatttattttaaaaatacagttacagccaggcgcggtggctcatgcctgtaatcccagcactttgggaggctgagacgggtggatcacctgaggtcaggagttcaagaccagcctgaccaacatggtgaaaccccatctctaccaaaaatacaaaaattagccggtgtggtggcgggtgcctgtaatcccagctacttgggaggctgaggcaggagaattgcttgaaccagagaggcggaggttgcagtgagccatgatcatgccattgcactccagcctgggcaacaagagcgaaactgtatctcaaaatataaaaataaaaataaaaaaataaagttaggctgggcatagtggctcacaagtgtaatcccagcactttgggaggctgaggcaggaagatcctttgagcccaggagtttgagaccagtctgggcaaaaaagtgagaccccccccgccttacaataaagaaaaaaaaaagcgtggtggcacacacctgtagtcccggcctcctcaggaggctgaggatggcttcagcccagaaggtcaaagctgcagtgaataatgatcctgccactgcactccacctgggcaatagagtgagaccctgtctcaaaaaaataaataaataaaaaatagctgggcatggtggcccacatctgtggtcccagccacttgggaggctgaggtaggaggatcacttgagcctgggagggggaggctgcagtgagccatgatcctgccactgcactccagcctgggcagagtgagaccctgtctctaaataaataatgtaattgcgggagcaagaccccgtctctaaatcaatgaatgaaagtaattgcactatgacgtgaggatggatccaatgtcatcagctccgttacaattttctgggaccaccatcgtatatgcagttgttgactggaacgttgctatgtggcacacgtccgtcctttctgatgcagcacttaccgcgtggtgacactgctctaagtgcttgacagatagtgtgcataattctctttttattttgttttttgagatggagactcgctctgtcgcccaggctggagtgcagtggtgcgatctcggctcactgcaagctccacctcctgggtttatgccattctcctgcctcagcctcccgagtagctgggactacaggcgcccgccaccacacccggataattttttgtatttttagtagagacagggtttcaccatgttagccaggatggtttcgatctcctgacctcgtgatccgcccgcctcggcctcccaaagtgctgggattacaggcatgagccaccgcgcctggtctagcgcgcgtaattttcataagaaccctatgaaatgggtgtagttattttcatccccattttacagatgaggcacagagaggttaggacatttgacacagccataactaactcactcactcctgtgaccctggaatccctcttttactcttttttttttttcttttctttgagatggagtctcgctctgttactcaggctggagtgcagtggtgtgatctgggctcactgagacctccatctcccgagttcaagtgattctcctgcctcagcctcctgagtagctgggattacaggcacctgccaccacacccgggtaatttttgtatttttagtaaagatggggtttcgccatgttggccaggctggtcttgaacttctcacctcaggtgatctgcctgcccgcctcagtctcccaaagtgctaggattacaagcgtgagccactgtacccggcctctcttttactcttttaacataactagaataatagtaaacatttgtagagagcttgacttccagtttctagtaaacaattattcagactaactctcgaagtaactaaaaatgctaggaaaaatacttgaaaatatcctaaaagccactacatgctgactgtaagaaagaagatagtgagaaattaggccaaaattgaaggaaaaaaactgaaatgtaatctggcaaggaagccacttttacttttgccagcttagcatatttgaacttgaccatgaatgattttatggggcaagaggccagaaaattaggctgggtgcggtggctcacgcctgtaatcccagcactttggaaggctgaggcgggcggatcatgaggtcaggagatcgaaaccatcctggctaacatggtgaaaccctgtctctgctaaaaatacaaaaaaaaaaaaattagctgggcgtggtggcgggcgtctatagtcccagctactcaggaggttgaggcaagagaatggtgtgaacccagaaggcggagcttgcagtgagccgagattgtgccactgcactccagcctgggcaacagagcgagactccgtttcaaaaaaaaaaaaaaaaaaaaaggctgggcgcggtggctcatgcctgtaatcccagcactttgggaggctgaggtgggcagatcacgaggtcgggagatcgagaccatcctggctaacacggtgaaaccccgtctctactaaaaatacaaaaaattagccaggcgtggtggcgggcgcctgtagtcccagctacttgggaggttgaggcaggaaaatggtgtgaacccaggaggcggagcttgcagtgagctgagatcacgtcactgcactctagcctaggtgacagagcaagactccgtctcaatcaaaaaaaggccagaaaattaaaatccacgactcacactaagcgggagtcctttcccacgataatctgggccctgtcggactccaccaatggtatgctggtaaatgttcaaccaccagctctggctggggctggggaaggagggtcctgatgtataaatcatttgccgatttccatggtgtaaatactccctccacagctgattccaaactctcagcatgaggtcactaaacacagagctgggaagcagaagcctgtaaaccatctgcagcacatccctggctccaccctcagactacaagaagtcaaccagtcttgcacaactatgcggccaggattcgcatcacctgagtggtcgggggctcacaaaccctgaactaggattgaggtcaccccagactagcagtgacctgaggggcctggcagaagcaaatataaattatttctagggggaggcctcaaattatccctatgaataaattttaaaatagtgtccagcatggtcaaagagaaccaggcatataacaaggaactatgacaccatgagcaagacctagcagaaacagactcttggagacttcaaatactagaatcatcagacacaggctgtaaaactactgtgctttgttgaaagaaagaagtgtaaaaatacctgcaggagacaggaaactactaaaagtgacatactagatttacaaaggacatttgaagaaagctttatggttttattggggatcaaaatcacaaatactttcaggggccagacaggtaacacaaatgagtaaagtggctatgagtgcactggtgacccagataactctgtctgaaagatacagacagagctctctgctctagccgatgggtgccatgtggcactgagggtccagtttgcagatctgctggttctagagaagctgggtatttttttttttccttccttccttcctccctccctccttccctctttttcttccttcttccttccctccctctctccttctcctcatccctctctcttttcttctttctttctttcgttctttcttttctctctctctctctctctctctctttctttgcttcatgcagtggcatgatcttggctcactgcagcctctacgttctgggctcaagccatcttccccacctcagcctcctgagcagctggggctgcagatgcgcacaaccacacctggctattttttgaattttttgtagagatggggtttcaccatgttgcccaggctggtctcaaactcctggcctctagcagtccacccacctcggcctcccaaagtgctggaatcacagatgtgagccaccgcgcccagcctagatttctttttattatgatcaaatacacataaaattgaccattgtaaccatttaaaagtgtacaattcagcgtcattaagtacattcacattgttctgcaaccatcaccactatctcattccagaactttcctatcactccgaaaggaaaccccacatccgttagcagtcactcctgctctccctcccccttgcctctggcaaccaccaatctgatatctgtctttatggattcgcctagttgtagatatctcccgcaaatggacttacgcatatttatccttttgtgactggcttctttcacttagcgtgtttcaaggttcacccatgttgtagcatgtattcattcccttttatggctgaataatattccattgtgtggatagacacatttatctgttcctcagtcactatttgaattctgacataatattttcctattttaaattttaagatacatttttttaaagtttcatgtggcccaaagcacatacctattgatctcacatatctctgtgagatctgttttatgacctgctgttgcatattttcccagaaaattctcggaacgattctctgaagtccttctttctctttctcttttttttctttttctttctctctttctttttttgttttgttttgttttattttgttttgttttgtttttttgagattcagttttgctctgttgcccaggctggagtgcaatggcatgatcattgcacctctgcctcccaggttcaagcattttcctgcctcagcctcccgcgtagctcagattacaggcctgcaccaccacgcccagctaatttttgtatttttagtagagacagggtttctccatgttggccaggctggtctcgaactcctgacctcgtgatctgcccacttcggcctccaaagtgctgggattacaggcatgaaccaccgcgcccggccttttttttttttctgagacagggtctcactctgtctcccaggctggagtgcagtggctggatctctgctcactgcaacctccgtctcccaggttcaagcgagtctcctgcctcagactcccgagtagctgcgattacaggagcccaccaccgcgcccggctaatttttgtatttttagtagagacggggtttcacccaccatgttggccaggctggtatcgaactcttaacctcaagtgatccacccgcctcggcctcccaaagtgctggtattacaggcatgagccaccgcgcccggccagtatttgttcttttcttcatttttcacgtcaggagactgcgtttcagaatagtaaaaacaaatgcctaggaaaaggcctgcggtctctccatttccacagtagcgtgttccccaaagaccaaaccctcaggggaaacgtctagaatgagtaacaacttaaggctgcaaccttaaactttcccaggactcagtttccccagctgtgaaatggctgctgtcgggctgtcatctccaggcccggggcgctgacatttgggccactctcggtctccctcttcattctgggcgcgcattagctctggtccggccggttccgctgcagctgaacagcaagatgcggcacccaggttaccctgatcatcgcagatttctccccggggctctgttctgaggcctcaaaagtgctccttgtagatgggaccaggggtcatttgggcagtagcagcgcctggtctcagtctggtactgaagtcaggaatggcttaaggtgaaatcgtggtcctctggtgaagctcagcgaagaccccctcgccttgtttatgacaagagaacttctgggggcgggaggaagagtccctgttacgatgctgatcatcattgagcttttgctgagcagaaaactctttagtactcaaggtcgagagtctctggtggtctgcctggcaccaggcaccttcctacaaccctagttttccaaaaggacaaagcctggggcaggcgacgtcctagctcgcatttgaacagggccgcgggccagcagagatgcgcgatgcccaactctttccaagagcacctcgcgtcccgaaccggtgccttcaactcggagaagtcaagagacccgcaagaaacttgcacgactgcacccgccgccgcgctctgggggctgggcaggggcagctgggctggctcccggggaacgcgacccccccgcgccccgcagaccggctgtctcccatggacccctcggcacctgcagcctccgaggaagggtcagcgcgcgtgtccgcacgcccgcccccaccgcgcgcccagagccgggggtcgccgtgcgcccttcgccacctccccaggagggcgtccggggcgtcccctctgggggcgcaggaggcccgggggcgctgcccggtggccgcggcgcccggaggccgcactgccggcggcggcggcggcgcggctccccctgctctgtgcagctgccgcccggcgcttgcgcactgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatggtaagcggaggcgcccgccgccagccgcctccccggccgccccgagcccgagcgcggctccagagagccgcggggcgcagcgccccggccgcctgccccggcccagccccgccgcgggccccgggacttggcgagggcgggcggacgggcgggcggcgcgcgagccgggtcacctgcgccaggctggggccgcggccgctgcccaggtgcgctcgcgcctgtagcccacctggcgcggcggcccggaggcggcgggcgccggggccaggcggttggagcggcggggcggcccccgccgcggcgctcggctcccgggaggggggctcggggccggccccagaagccatttcgttttgtgcaagtcacatgaaagcggcttcccgcgcgccggggccgcgatgccggcggcggcggggagagcgcgagctccattgtgcaggctccgagcgggccgccgccgccgtctcctccccgcgcaccccggcccgcgccccgccgccctccgccagccccggcccgcccggccgcccgctcccgcctcccgggcccggcgccctcgagtctgcggagtttgcagagcgcgagccgtttaaatttagcgctttgggctgcctggagcgagggctctcggcgaccaggaaagatgggggcgagcgctgggagccagcggccaggggcgcggggcgcccacgtcccaccccgctctgcgcggcgccccgggcggggggctcgggccagccgatgtttttggccagaagccgttcgtcctgggccgcggctgcctctccacaccgggagctcgtgtttgttttgcggagggagctgttgtttttgttctctgcaccggggagagggggacttggtggcggccgcgcgtggttttcgggatcacattagcgtccgcccggcgtggcccggtcgacattaaggggatcgaacctttccgcggcctcgtcggggtctgctcggaatcggcccctgggccaggcccgaggcgcaagcagatcgccaggttgggtcagagttgttgaaaactccccgctgcctgatttcaactttattatttttttcccacgccttcactggggtcccggagggagaggagccgccgcaacgctggctctgagtgtcagcgcccgcgggctcgtctcgaccctttatttcgagcctggaagctgggcaggccctgtggcaggggatgtttacgtttgggggtgtcgtttctcgagtagcgcctcggtctctaaaagccactgggggcgagcctccggtgtggcggtgtcacaagttagctgtcctttctgagtcaaacccaacaaaaaaggcaagaggaaaatcaataaagtccacgtgctccccggcctcctatggaaagggctggctgcgatggccggatgcccggccgtgggctgggtttggctccagtgggacaaagaattttcagaaccgtgagaaggggaggctttccaaagttgagatccaagtcgtcggtgtctcgggagctcccctggtacacagggtgcccggtgcccgactggagccatttaaaaatggcagaaacagctgcaggccaacacacacacgctggaaaacaacccgcagccccctctactgtgggattccccgcgggaagcccggagttgctcccctccttgcctcagcccctgtgcaaagaaagaactggtgtctgtgcctgggtcccttctgtcgccggcctggaggttgggaaacagccggcaagccgcctttctctgctcgaggaggcgtggtggggcctcctactccaggttcccggctggacagaggctcctgcaccctgacagctgctcccgcagagcggccagctgctctgcagggagggcagatggagagatggggcttcccaccccgcgggccccggggcggccggcctggaggccttccagcccgctgaccccgcggggaccaggcctgtagttggagcttgaggggctgtacctctgcgcctccctgggtttggggaaacaacacatcgtgtcctctgaagacctcaggctttgggatctcatggtccagcttccagttcacttcgttgccgcgaccttgggcatatcattgtcacttctctaaccatggtgacccggggttttgtgcttggcttccaggtcccctcgggttattgaggacgattgaggtcatgcctccgagagcaccgcgccctgggcgcaggaggagctgttgctcagtgttgtctgtgttgtaaggtggactttgtagaaacttggctttgaggttttttgtttttttttttttttggccccttctaagcgaaagccttggacttattgcccaggtttctctggcccctgagaagccatatctcaccttccccgcgccttcggattgggtcttagactcagcccatgagactgtgggttgtttattaattgtgtggtcaccaaccatgcatttcaccactggtgggggggtggggttgccaggtttaaccagataaaaatacagcacacccagttaaatttgaatttcagataaacaatgaaagatttttttaaaaataaatgtttttgagtatgtctcatgcaatatttgggacacacttatactaaaacattatctaatttatctgaaatgcaaatttaacagggcaccctgtattttacccagagggaagccgaagtgtttggcagatcatttggccccatgagccttgggtgggtttctcctcagccctagtgacccctaaaattacccccccgacccacccactgtcccctgatgcttcccccacccccggaaaaagctgtggcctccctctcatttggggcaggctgcctcctgttctctttttctggtgtttcagcaaggcaggccagtggaggtgaggtgaccagaagatggctaaagggaaaacaaaatggtgggcctctttttgggaaactgggccagggtttgggggccctgtgctggtggaggagagaagaccccagggcgatggtaggagacgaaagcttgggctgcagcgtaagcttggaggcccgctgcggtggctcacgcctgtaatcccagagctttgggaggctgagacaggaggattgcttgagcccaggagtttgagaccagcctgggtctcaaaccaaaaaaaaagaaaaagaaaaaaaagagccgggcgcggtggctcacgcctgtaatttcagcactctgggaggccgggcaggcggatcacgaggtcaggagatcaagaccatcctggcaaacatggtgaaaccccgtctctactaaaaaaatacaaaaaaattagccaggcgtggtggcgggcgcctgtagtcccagctacttgggaggctgaggcaggagaatggcgggaacccaggaggtggagcttgcagtgagcggagattgcgccaccgcactccagcctgggcaacagagcgagactccatctcaaaaaaaaaaaagaagaagaagaaaaaagaaaaattagtctggacgcagtggctcatgcctgtaatcccagcactttgggaggccgaggcaggcaggtcacctgaagtcaggagttggaaaccagcctggccaacatggtgaaaccctgtctctactaaaaatacaaaaaattagctggatgtggtggtacacgcctgtaatcccagctactcttaaggctgaggcaggaaaattgcttgaacctgggaggcgcaggttgcagtaagccgagatcgcgccactgcactccagcctgagcaacagagcaagactccatctcaaaaaaaaaaaaaaaaaaaaaagaagaaagaaaagagaaaaggccgggcacgttggctcacacctgtaatcccagcactttaggaggccgaggagggaggatcacgaggtcaggagatcgagaccatcctggctaacagtgaaaccccatctctactaaaaatacaaaaaattagccgggagtggtggcaggcgcctatagtcccacctacttgggaggatgaggcaggagaatggcatgaacccacgaggcagagcttgcagtgagccaagattgcaccactgtactccagcctgggcgacagagcgagactccgtctcaaaaaaaaaaaaaaaaaaagaaaaaaattagacaggcatggtgaccctcgtctgtaatcccagctactcaggaggctaagcctggaggatcacttgagcccaggaggttgaggctgcagtgagctacgattgtgccactgtactctagcctgggtgacagggtgagaccttgtctcaaaaaacaaacaaaaaaagtaggcttaggcccaggaccccttagcacctggtctgagggttccctcaatgacttgctgtgaggactgagaaaggtctgtgcctgaagagctcccgtctgtcccaggagaggtagaggtttgggcctgaggcctccctcacctcagctcctccagaggtttcatcatggagacattcctactgggcacatggcaggtcaggcagacctgggcctagctagggtgaggccagccatgggccaggcctcttgaggtgacagggactagccatgaggagtgagtacaaggacagggagtagagctttcctggagggagtcagcagggtccccttgagtggtgggtaaccctaagatggtcttgttggctaacccttggacctggacacaggagaacattcgaaattggccttagcctggagaatctgggatggattcttgtagtttatataggagtccgtgctggggaggagcagttggggctatattcctactgctgggacctcattttttcctttcctcccagaagctcaagtgtaatgggaagggaaaggtgttgaagtcagggtaaggtgacggggccgccaagacaggaggcgcggggcacacccagggccagctttgcagcaagttgggctgcagcctggtggttgtggggatttctgcacctggtgcttacaggtgtcaagagtgagggcatctgaggggggccagagagcccatctggggcaagctgtcgctccctggggcatgtgggcccaggtcatgttttcaagagtagccagaagtctggattcttatgcaaagcctgttttgttgtttgtttgtttgtttgtttgaagtttggcagcagatttaacatttttaaagtactgtgcaggccaaacaaaacacgcctgttgactggttgtttgccatcctaaatataaagtggggcccatgtgtggtggctcacacctgtaatcccagcattttgggaggccaaggcaggaagatcacttgagcccaggaggtcgaggctgcagtgagcagtgatcgcaccaccgcactccagcctgggcaacagagggagaccttatctcaaaaaaataacaaataggctgggcacagtggcttatacctgtaattccagcactttgggaggccaaggcgggtgggtcacctgaggtcaagagtttgatgtcagcctggccaacatggtgaaacccgtctctactaaaaatacaaaaattagccgggcgtggtggcatgtgcttgtagtcccagctactcaggaggctgaggcaggagaatcgcttgaacccgggaggcggaggttgcagtgagccgagattgtgccactgcactccagcctgggccacagagcaggagtccgtctcaaaaaaataaaaaaaataaaaaaataagaaagtgatgagtatagcttaataccctcattggggaagaggagcaacgcccttttttggggaggggtatgtgttctgtggtgatggttttggggggcaattgtgggaaacctcagctgctccgctgaacccgtgtgcccacccagtgtgtctgtggctgtgaaatcccatgtcctcctgggtgctcacttggtgccttaaacttgagctccatggcccctccgggtggctgcttagctgagcataggtccagctcagaggtagaattcttaatgttcttgcctctgtcccagagtcccctcaatgtccacacctagaaatacagtttctcatcactggggtaacttgagaactcggtgaagaggttgccagttggggcaaagagaggcacgaaagcctggctgcattcagcttgtagcctgcggtggcctcgagcctcgctgggaagcagctgcaaacttgcatcttggctgatttgcggccgcaaagcccagatctctggcacactttctgccctgaaaggtgtcctgtgtgttacaagtcaattacttttttttttttttcccaaacacaatcaaaccttgaatgggttgatttactgggaagctggtccagggctcatgagtaatgaatggctttggccaatctgcatggagtcctggcaatttgtcattcttcctccagcttctgttaccctggcgctcctttagaatgattcttggttttcatggccaacagaatagcaggaggtggtgtctggggtccgagcccaaatctaattctcttctgccacttcctgtctgtgagaccccaagctagtggtataacctctctgggcatcctgtttctgcatctgtaaaaagggtgacaatcgtccccctcttgtagcctgttgggaatcccagggagagagggtgtgtaagtagagtgcttggcgtggagcctggcatgtaatagcctgggcacacagtggctattgtgatggttgctctaacaactgaggttcttcccaggagcactcggtctcttctggacaccttctgattgctcagaattgaggaggggaaaggtgggcattgtggtttgtctgctctgcccacaggaggcaggagacgggccagtggacttagacactcgtctttcctgcatcgtttctgggtgaaaaggtgcaaggaggagggagcagagaggctggtctcaacagctgtgctgggtgaagggttcgagtgctggctctgggagaatgagttcaccttcaccgccctgtgcctcggtttctttatctgtcaaatggggaagttgccatttcctgccggatgagccggcacagtccttggtacatagaaggcgctaggaatggccactggtataataagaaaagccgggccgtagcgtcctctgatggaacacgtgggacccgagcgggcagggtttttgggggtgaggtgtctgtggtttcggctggctgggtttgagtatgctccgtcatcccgcaacccccgtggtgacagggtgggagtcctgtaacctgtcacaccagcatgtgagggccacatgccccacgagggggtgatctaaggctgagtttgggcagagaggccaaaaaaaggtgccaggcagctcacggacagaggtgctcgtgccacacagaattctcagttctgggaatttttgtcaccaaaattgctgaggactcgggcagctacgtcgcctgtaccaggggtgcgcctgccccaacagtgcctgctgggccccttaaatccgccagcctcctagctgagccatcagtggctccttggtggcctcgcaggtctcctgatctggcagagtcttgatttaggagcctcggttccaaccccagccctgcttctgggaggctctcctgagcctcagtcccctcaggggtgtggctgctgggtcttcgtggcggtaagggacaagtcggagtgcagggggtcaaggacaggaggtggctggctgtagcaataatcggaaaaatgacagtggctcggagcagagtggtggtggtggaggagagggtgggcattgttatctcgaatgaaaaccagtcctgtttgcttctgtggcttgtaagtttctcctcatccataaacctgcctctcacagtggggggtctggactccgtccttcaggcgtttgtaatgcagctggggtgaccttgcagacagggtcactaggagccctgaatcaggggtgcagttcccctcccacctggctgcacccacacattcaggctgtgtaacctcctttcgggccgaggtcaccactccctggctctccttggccgccacgaagggcattcttccggcagagtgtgggcggctccccggcttgcctgctcatgcctcccctgacctcagacgcatcgcccagagggcaggaggagccccggggtgtccttggtgacgactccaccccccatgagaggaatcggcctgctggcctgaagccctctctgctgcccagacaggcgcgggtggcccagtccactggctgcgtggcattggcagtgacacaggaggaacctgggcccgactcgtgccacccataggagtccttgtaatggcagccccaccctcagcctttttggcgacagcctggagagggcaaccaccctatgtggtgtaacgggtggagaaaccaggcttagatgggtgatgtggcctgcccagggcctcccgctagtgagggtggagctgggattccaaccctcatctgtgtgatctggagcttgctctcagccccaagggagtgtggcctgtgtcccccagggatgaagagtccccggtaacaggctcttcctcatcctcctcagggagaagaaatgggtgaccgttggtgacacatccctacgaatctacaaatgggtccctgtgacggagcccaaggttgatgacgtgagtatggagggctggtcccctggggtgggccacccattcgtgctcctcccaccatggggagggagattgtccactgctacccaccgtgctggggctctgggaccaagagcccctgggagtagaaggacccagattagacctggggaggctgctgtaccagtccccacccctcccactccagccccagagtctggccctcagagcggtggacggggggatcccgcaagctgtgtcttcttcttcttcttcttcttctttttgatacagagtctcactctgccgcccaggctggagtgcagtggtgtgatcttggctcactgcatcctctgcctcgtgagttcaagcgattctccagcctcagcctcccgagtagctgggattacaggtgcacaccaccacacccagccaattttttcgtatttttagtagagacgcagtttcaccgtgttggccaggctcgtcttgaactcctgacctcgggtgatccacctgcctgggcctcccaaagtgctggagttaaggcgtgaaccagtgcgcccggcctgcaagttgtgtcttctgggccgagcgccccccccagggcttggcactgtgttttggggcaggtgtggtggtgcccacagttaggcacgttctccccacctttgtggttctgttcctgagcctctgaccatctgccaggccctgggctgatgcctcacatgtggcatctccgttatttttcctactcagcctgtggagttgatctttttaacctctcctctgtacaagtgagggcacaggctcagagaggtgaagccacttcacatggctcacctcagagctgtgaatggagctcaggtctgtctgactccaaagcgcaggttctctctgcgcttggagaggcttctggtgagtggagctgctggtgacaggggtccccggtgctaggaaagcctggtgtagggatgcggggctccaggagggctccaggaggggtggcgccatcccgacttccaccactagagggaatgcgaggcgctgtcctgtgatggctggcaactgccccgagcagacagtgctctcccaacttcgtggttcccaggccagttacctccagagacccctctcatttccatcccaaatcaagaacagtctgccccataggcctttgcctgggccattcccccctgcctggactgccttccgtatttactcaaactcagtccttctacctgggaagatggcgcagactaacccacatggctgcggccactcctgggagtgacgtaaagtcatgattggtaggtttggggtgggggaagcatgtgggggtccagcttcctccaaaaagacaggggctaagtttctcgcccccatcttcagttatctgcccggcaagtcttgggtctctgggcagggctgtggctccattcttcaccccgtgatcacatgctcacccctgaacttgggcctttgttgtcccttctggttctagcctgggctcccggaatcaccagggctgctttccccaaagggactgagccttggtctctctccgcatctcccagggaagagcagggcaagctcctcgaaggcagttcctggctccggcccatgtctgtgccttgcccgccattaggtgtagaaatgctggttgcatttgagaagatgtggtccctgctctcaaggaatttctaatctcgtttggggaagataattatagaatagcatgaaacagatatcagggaagtgccaaatggaatatgatcaaggggaaaacgtaagccctgggccatcgggaaggaccgggcagctctaggcttcaagggaccgtttgatttggaggcagacagaccagccccgattaacctgtgatgttaggcaggtgaccccacattgctgggccttagttccctcttttgtgtaatggagcagtaacatccaaatcgcggtttctgcaacagagcaaaagcaatatatcaccacggagaatacttagcactgtgccggctgtgcagacggtgccgagaaatgcaaattccctcttcatctgtgagccatgatgtgccatgtgccactcccccaccccctttccctctagggcgatggttctcggcctggctgagcaccttcagaagatgcagattcctgggcccatcaccagccgctgagtctctgcaggttgaggctgggaatctgccttgtggagggagagctttttattgttttaaacactcagtatctatatggttatatccatttgttactttagaactcttgaaaatttcatccttttaaataggtaaaatatgttacaaaattcaaattcaaaacaattttttgattaagacaatttacatatcatagaagtcactttttttttttttttaagagacagggtctctgttgcccagtctggagtgcaatggcaggatcatagctcactgcagcctcgacctcctgggctcaagcaatccttctatctctgcctcctgagtagctgagactgcaggcatgcatacctggctaatttatttattatttttatttattcatttatttttttgagacagagtctcactctgttgccagactggagtgcagtggtgcaatcttggctcactgcaacctccacctcccgggttcaagcaattcttctgcctcagcctcccaagtagataggactacaggcgcgcgccaccacgtccagctaatttttgtatttttaatagagacggggtttcaccatgttagccaggatggtcttgagttcttgacatcatgatccgcccgcctcggcctcccaaagtgctgggattaccggcgtgagccaccacgcccagccacacacctggcttatttatttatttaatagagacagggtctggctgtgttgctcaggctggtctcaaactcctggccccaagccatcctcctgcctgagcctcccaaagtgctgggattacaggcgtgagccaccatgcctggccagaagtcactgttttattcagttcagttagtgtattcacaaagttgtgcacctgtcaccactgtaattccagaacattttcatcaccctaaaaaaggaactcatacccattagcagtcacttcccattcccctcgcctgccccggtaaccaccagtccactttttgtctgtttggatttgtgtatcttccgatgttactcttttactgcatatcttttataaatctgcctctcatccctgcatgcaccccccatccccaccccagttctcgcccctggaggcaaccagtgttgccaggttttgtttatccttctaaagggagacttcgctcgcaaacatgcatgtaaatacacgcatgcacatacagagcatgcacacacacacacatcctttgcttaccactggtggtgaggctcacgtatcctgcatctttcatatatatatatatatatatatatatatatatatatatatatatatatatatatcttggcgatattgacatatgttaagtgttagtattctgcagatcaccccatgttagtctgtgaagaaccaccttattccctgtaattgttgcatccgatttcattgaatgaatgtaccacgattgatttaacgagtctcctacagttcagccaaggttgtttctaacatgattcctttcgtaaaaaaaaaaaaaaaaaaaaaattgaatggccgggcacagtggctcacacctgtaatcccaggactttgggaggctgaggcaggcagatcacgaggtcaggagttcgagaccagcctggccaatatattggtgaaacccgtctctactaaaaatacaaaaattagccgggtgtggtggcaggcacctgtagctccagctatttgggaggctgaggcagaagaatcgcttgaatctgggagttggagttggagcttgcagtgagccatgatcacgccactgcactctagcctgggtgacagaacgagactctgtctcaaaaaaaaaaaaaagaaaaaaggaatggcacgaaaagcatccccatcctccctcctttctcccggggtcctccctcctttctcccggggtcttccttcctaactcctcttgcgcttttgtgctggaggtcagtggagtacactttgagaaaggctgccccagggggcctgcagctggtggaagtgagtgacctctgggtcacctggcattactttgtacctgggctgatggtagcctcttccccagatactctccctaaaagaggaggcaggtcctgccagccagggtgtttccacactgctgctgacagccccagaaacaggcaggcttattttccagggtgccggagctgggccagcctcagaaccctccccactgtggggctctctgattccacagtgggcgagacccagaggccagtccctaataggacgtgttcaaatgtgggcccaggaaaacctccagaggcctgggggctccaggaggcttcaatggaataaaatattcacaccactccccaggggctctgagcacgtgtgcgcacacacatgatctggtgacttggtttctgctccattttcccctgcagaaaaacaagaataagaaaaaaggcaaggacgagaagtgtggctcagaggtgaccactccggagaacagttcctccccagggatgatggacatgcatggtgagtgcccatggcctgccagcctctcctgcccagcccggggccttggccaagcactcggtcatgtttttgtttctccagcaggtttgttcacattccaggcaaggggtaggagggctgggcagggcccggcggcctctgtgccaaggagaagagtcagcggaggagaggatgtttcttttcccagcgtaccaagccaagagacataaactaagccagagacatagaaattagaccctctcctcacccagggacaagaaccccgcaggagatgtttctctcagcctcgtgtgtccaggaagattgtttgggcgtatgtttcttcgccccctcatataaattatataaatggctgtgtttcccattttgctttggctgctgggaatctccaaactggattttgtttgtttgttttgttttgttttgtttttgagatggagttttgctctgttgaccaggccagagtgcggtggcgtggtcttggctcactgcaatctatgcctcctgggttcaagcaattctcctgcctcagcctcccaagcagctgggattacagccatgcaccaccatccctgaccgatttttgtattttttagtaagacggggttccaccatgttggcaaggctggtctcaaactcctcgcctcaagtgatctgcccgccacggcctcccaaagtgctgggattacaggcatgaaccaccgtgcccggcctccaaactggatttctgatttcatgttaatcccaccaggaccttgggaactgcccttccacgtctacacctaacttcctttgctgtttaatttcaaatgttgtaacttagccgggtacaggaaacacgcacctgtagtcctggctccttgggaggctgaggtgggagggtcgcttgagcccaggagttcaaggctgcagtgagctatgattgcacctgagagtagctgctgcactccagcctgggcaatacagtgagaccccatctcttcaaaaggcaaaaaaacccaaaaaagttgtaatctaggtccatcaaccaaatccagatggtgctgtctgccattgtttcctgttggcggtgtctgtttctgttttgacctttttatttgagaggaaacgtgcaaatgatgtgtgtatgactccatgaaatgttcccaaactgcacacacccacgtaaccacccaggtcaaaacacagaacgttccgagctagtccccagtgtcccccgcaggtcctcacggttttctccatccacccaaggaaaatgccctcagagattcaaacctaaagctccttttttttttttaaggcagagtctcgctcctgtcacccaggctggagtgcagtggtgcgatctcagctcaccgcaacctccgcctcctgggttcaagcaattcttctgcctcagcctcctgagtagctgggattacaggcacgtgctaccatgcctggctaatttttttgtattttagtagatacgaggtttcaccatgttgcccaggctggtctcgaactcctggtctcgaacgcccgccttggcctcccaaagtgctaggatttacaggtgtgagccaccgcacccgtccctaaagcttcataaaaattaagttggttttccgtgtttggaaatcaggaaatctccgtcctgccatcccttgagaaatcagatctggcagccccgtggctgtgtgctccctcgaggcaagggctgcctggaactgcctgaagccagagccgccttcccttagcaagagtgtggcgcctccaggcccacctggctcacccactgcctctttgtcacctgcctggcctgctaggacaagagcctgcaacccctgcctttttctatctcttgaccccaatttcaacgtctttgtacttttgaccactggaagctttggtacagccaggtagtagtagacaaataactaaaaaaggaactggaagggaatattggtttgctggagtttctgatctctccagacccagggctgtcttgttctggggaaggaaggccagcgaacttccccacgtgctcaaatcgacctgtctggaaaacacagtcaccagctccaagggcagggggactggcaggtttctgaacgggctttagaaaagcacagtggcggtggctcatgcctgtaatcctagcactttgggaggctgaggcaggcaaatcacaaggtcaggagttcgagaccagcctggccaacatggtgaaaccctgtctctactaaaaatacaaacaatgggtgcggtggctcacgcttgtaatcccagcactttgggaggctgaggtgggcggatcacctgaggttgggagttcgagactagcctgaccaacatggagaagccctgtctctactaaaaaatttacaaaattagccaggcgtgggggcgcgtgcctgtaatcccagctagtcgggaggctgaggcaggagaatcgcttgaactcaggaggcagaggttgcggtgagcggagattgcgccattgcactccagcctgggcaacaagagtgaaactatctcaaaaaagaaaaaagatacaaaaaattagctgggtgtagtggcgggcacctgtaatcccagctgctcaggaggctgaggcaggagaatcgcttgaacctaggaggcagaagctgcagtgagccgagatcgcaccactgcactccagcccaggcaacagggtgagactccgtctcaaaaaaagaaaaaagaaacgcacagtgggagccaggcacagtggctcacgcctgtaatcccagcactttgggaggctggtgtgggcgggtcacttgaggccaggagttcaagaccagcctggccaacatggcaaaaccccatctctactaaaaatataaaaattagctgggcatgatggcgtgtgcctgtaatcccagctactcaggaggctgaggcaagaaaatcgcttgaatctgggaggcggaggctgcagtgagctaagatcaggccactgcactccagcctgggcaaaggagcgagactctgcctcaaaaaaaaaaaaaaaaaaaaaaaaaaaagagcagtggggctttgttgctggttaatgtgtcaagaaagcccccccaaccagccatacaatcatagttgggttatgtttcattttcagaaatagatatgtgagctgggatgtggcctgtctcagtggcattccttagcatcccctttccctctggggactggggagaccccacgcccgactcaggactgaggttggattacagacgcagaattacaccagagggccttttcgagctgaggccaggaccccacctgggttcacatcctaactctccctgcaccttcccctggctgtgtgatcttgggctatttgtttaacctctagctttggggtttgtttagttttaatctgtagaatggggatggtaatgcctacttcataaactcactgtgaggattaaattaaataatctcttaaaaaccttggcatgggaccaagcacagtggctcacacctgtaatcccagcactttgggaggccgagttaggaggatcacttgagcccaggagtttgagaccagcctgggcaacacagggagacctcatctctacaaaaaaaacaataggtggttcgtatctatagtcccagcattctgggaggccaaggcgggcagatcatgaggttgggagatcgagaccatcctggctaacacggtgaaaccccatctctactaaaaatacaaaaaaattagccaggcgtggtggctggtgcctgtagtcccagctactcgggaggctgaggcaagagaatggcgtgaacctgggaggtggagctttcagtgagccaagatcacgccactgcactacagcctgggcgacagagcaagactcagtctaaaaaaaaatagattaaaaaaaaaaataataataataataaatttaaattagcaggttgtggtgatgcgcacctatagtcacagctactctggaggctgaggatcatttgaacctgggagttggaggctgcagtgaacagtaattgcaccactgcattccactctgggcaacagagcaagaccccatctcttaaatatatatatatatataatatatatattatatatattatataatataatatataatataattatagtaaatattttattttgggccaggtgtggtggctcatgcctgtcatcccagcactttaggaggccgagatgggaggatcatttgaagtcaggagttggagaccagcctggtctctatggtaaaatcccatctctactaaaaatacaaaaattattgggtgtggtggcacacgcctgtaatcccagctacttgggaggctgaggcaggagaatcacttgaacctggaggcaaaggttgcagtgagctgagatcatgccactgcattccagcctgggcgacagagcaagactccataaaaaaaaaaaattattttactgtattcaaaaatagagacagggtcttgctatgttgcccaggctgtttccaaactcctgagttcaagcaatcctcctccctcaacctcccaaagtgctgggagtataggcatgatccactgtgcccagcctataataaaaattttaaaaaccttggcatgttaacagctcacatttatgaaaccgtcacaatgtgccaagtattgtgctaagcccgttacatcattgcctcatttgagtctaataaccaaccgcattttacagatggagaaactaaggcccagtgaggtgaagtaacatgcatggttagcaagttcataacttccagtgccattgatggcatttgaggttggttctttgaagacagaatccaggtttgtggctggccgtggtggctcacacccataatcctaggactttgggaggccaagttgtgaggatcgtttaaggtcaggagttggagagcagcctggccaaacaatggtgaaaccccatctctactaaaaatacaaaaattagccgggcatggtggtgggcacctgtaatcccagctactcgggaggctgaggcaggaaaatcccttgaatcgggaaggggaggttgcagtgagccaagattgcaccactgcactccagcctgggcaagagagtgaggccgtgtctccaaaaaaaaaaaaaaaaaaccaaaagatccagatttgtgacctggataaactctccagaaaaatctaggatgctgaacaaaccaggtccccagacacaggtgccctgttgactttctgattttcattttagtgcacgtgcagccgaaagccagtcagactgcagagtgtgtaaatgggaaggtcagggaaaggtgtgggccgggcaagttttctggaaggcttcaagtgggaggatgggtacagcaggggatgaaggagagggcggtgccccgggccctttagtccacaagactcagctgaagttagcccaagtatcagggtcacgctgttaccaggctaccaggctagaccagacgttaaacattagtgctcattgtcattcattaacagagcctcaggaacctacggggccagcctcttgcgcgtgtgcttgccataggaaggaagtctagtttttctcaagggagaaatcggggagcacacatccttcttttttttttttaagtcccagaattcacaagaggatgcttttgtgtaacgagcaccccagagtacagttaaaatcagatccaggttacccgtgtggggccgcctgactgcctggtgcttcctcggcaggttgaggtagaggaggggcgtggggctgggagttgggcagatgggtccggcaagtggctctgctgctcccagcctcagtttccccctccggaaagtgaaggtggtaacggtgcctttccaacgggttgtggggaggattccacgaggtgtccataaatgcttctgcccagtgcctggcatggtggcaggtgcccaggtctgttggggtgtctctgtctctttctcatgtttacaaaagtggccatcgccccgggtgcagcatggcccccagaaaggctgctttggttttgaaacctccacttgggtctctgctgtttaaaacgactctcctaggttgggcacagtggctcaggcctatgatctcagtgctttgggaggccaagacaggaggatcacttgagcccaggggtccaagacagcctgggcaacatagtgagaccccatctctacaaaaaacttaaaaattagccagatgcagtggcacatgcctgtggccccagctactcaggaggcagaggcaggaggatggcttgagcctaggagttcgaggctgcagtgagctatgattgtgctgctgtactccagcctgggcaacagagcaagaccctgtctctaaaaataaaaaatacataaatggctgggtgtggtggcttactcctgtaatcccagcactttgggaggttgaagcgggcagatcacctgaggtcaggagttcaagagcaagcctgaccaacatggcgaaaccccgtctctactaaaaaataataaaaacaaaagttaactgggcatgttggtgcatgcctgtaatcccagctacctgggaggctgaggcatgagaatcgcttgaaccaggaggtggagattatagtgagccgagatcgcgccaccgcactccagcctgggtgacagactccatctcaaaaaaataaatagagtgactctgtgcctgagaagggggtgcaggacaaggggaggtgcagcccgggccccagctctgcccccagcccaactgtaaatgccattgcccaattaccccttctctttcttctttgtattgtgaagggttttgttgtcaagaacagtagagagaggaatacgatccccctgtacactccaccttgattttcatgaacacggtgccacatttgtctcatctattttttcaatgtgttagatttttgtaattaaaatataattcacatataaaaaatacacagctagtggccgggtgtgatggctcacacctgtaatcccagcactttggtaggctgaggtgggcagatcacctgaggccaagagttcgagaccaggctggccaacatggagaaacccgtctctactaaaaaatacaaaactcagccaggtatggtggcaggcgcctgtaatctacttgggaggctgaggcaggagtattgcttgaacccaggaggtggaggttgcagcgagcccagatcgcgccattgcactccaatttgggcgacagagcaagactccatctcaaaaaaaaaaaaaaaaagtgtaaaagttcagggagtcctgacagtggccggcagcctgcactgaagtattttctggtaaatttccctgcctcatgacattcaagtctgcacctaaacgtcatagcatgcattgctgaaaatatgacgtttctacatacccactgtcccatgatcacttctaactaaattaacaacagttccttaatagcttttaaaacccagaccatattcaaattccccaattgttccaaagtgttacagctggcacgtttgaaacaggatccaaatcatttccatacatcatatttagtcgagtctcctagctttctttattctaaagtcatctcccctcccccaacttttttttttttttaaatatgatactgactttaagggagtggaccacgtgtcccgtggaatatgccacctcccgctgtctctctctcccttttatttcctatcaagtggaactcagctccaggctggatgcagtcagacagaacgccttggcaatcccgcctcacggaccatgccgtgtcttctgtatcgcttccctgccagacacacaagacgtctggtttctacacccagaatgaggcctcaaatgtccccccaggattttaaatatgttaggccaccatccccagctggctgcctccagacgcagggtacagttggctcagtgtggggaaggtcaggccagtgccggaattctttgcctctctggacacatgggatggctgtggtgcttgggtgggtgggtgggtgggggtcagggggcgggagtgagctcaggggtcccaggaggaggcgtatccagtatccagacccctaccacacggccgggtgcagtggctcaacgcctgtaatcccaccactttgggaggccgaggcaggaggattacctgaggtcaggagttcgagacgggtctggccaacatggtgaaaccccatctctactaaaaatacaaaattagccaggcgtggtggcaagtacctgtaatcccagctactcgggaggtggaggcagtgagccaagattgcaccacggtcctccagcctggttgacagagcgagatccgtctcaaaaaaaaaaaaaacggtaaccagacccctccccgggagagctgccatggggttccgggcattgaggcacagggatgctgagccctctgacctacccgtccttggcagctgtgggatttcatcctgtggttctgttcccaccccctacagacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaaggtatgtggcctctggaggtggggctctgacggcctccctgtaaccggccttcaggcagtctgtggctaggtgttccaggaggccctgtcatgtgccagccccagcaaggagacagtaaagagaggtgacacctggagtacatggtctcgtgggggaattaaaaaaatcagacaggccaggtgcagtggctcatgcctgtaatccctgcactttaggaggccaaggtgtgaggactgcttgagcctaggagttcaagaccagcctgggcaacatagcaagacctcatctctaccaaaaaaaaaaaaatagccaagtgtggtggcacacacctgtgatccagctactcaggaggccgaggtcggaggatcacttgagcacaggaggtcaagactactacagtgagccatgatcatgcctccgcactccagcctgggtgacaataagaccctgtctcaataataagtaaataaataaaaatcaaacaattggccaggcatggtggctcacacctataatcctaatgctttggaaggctgaagcaggaggatcacttgaggccaagagtttgagaccagcctggatagcatagcaagaccctgtctctacaaaaaaatgctttaagatgagctgggcatggtggcatgtgcctgtggtcccagctactcaagaggctgaggcgggagtatcccttgagctcaggagttggaggctgcagtgagccgtgatcacacaactgaactccagcctgggtgacagagtgagaccctggctcaaaatataattatattaataaattttaaatgtatttaaaaatcagacaacctagtattaggaagataagtgtggcagagaattataaagtaggaaaggggtggggggtcttgctgaatgacctggagagttgcagttttaaatggggtggtcggggcggcctttgaataagacaaggctcaaactgggcgactgagcaagccatgtggggatctgggaggagagcagtgtgggcagaggtaagagtgagtgaggagctggaaaataagatgggcaccaggcgcggtggctcacgcctgtaatcccagcactttgggaggccgaggcaggcggatcacttgaggtcaggagttcaagaccagcctggccaacacggtgaaaccctgtctctactaaaaatacaaaaattagcagagtgtggtggcatgtgcctgtaattccagctagtcaggaggctgaggcaagagaatcacttgaacccaggaggcggaggttgcagtgagccgaaattgtgccattgcactccagtctgggcgatagagcaagactctgtctcagaaaaattttaaaaagttaataataatacggggtcagacagcaggcagcgcctcaggtgtggggggctcgtaaggccactgcctggcctgggttttcatggtaagacgggagccactgggggcttgggtgacatgatctgaaggattaagaacagatgatggggtgattgtgtgagagtgtgtgtgtgattgtgtgaatgtgtacacaaatatttgtgtgtgtttattttgagtctctacagaaaaattaaaagaatggcataatactgtcctatatatccacctgctgaacttggcaattgttggcttttgggtttcttttgctttgtattttttctgggaccatttgaaagtaagttatagatctcaggacatttcatccctaaacatgtcagcacgtgtcttttaaaaataaagacattctgggctgggcacagtagcttatgcttataatctcagcactttgggaggctgaggcaggaggatcttttgagcccaggagttcaagaccaccctaggcaagaagacgaaaccccgtctctacaaaaaatataaaaatgagcccggcatggtggcatgcgcctgtagtcccaggaggatcgactgaacctgagaggtcgaggctgcagtgagccatgattgcaccactccagcctgggtaacagggtgagaccttgctaaaaaaaaaaaaaaaaaaaaaaaggcattctcttacagatttacaaataccgttactgcatctaagaaaatgagcagcattccggatggtctaacatggaggtatattttgaaggtgaggggagagcctgtgttgggcagtacataggggtgagtgcggacctgagggcaactctgggcacctggagggacagcagtggctgagcgggtctggggagggcaggccaggtctggagcgccttgcacacccatgaggagctggcgagcatggaatgtggaatggcaaatgtgaccagcctgcagctagggccaccccagggctcagggcgtgtgtgtcctgggagcagccagtgtggttctaggagaaaggctgtcccctgctgcagagctgatccgcacccctgtgcaaggaggctctgggctggcgccagggccccagtcatagctgcactctgcttcctgcaccccaagaacccataggtcagcaggggagacagacactggaacgaaggactcattggcagagatgcagacagactctatccagcccgtggtgtgagaatctggctatacagaaccctgcagtatcattttttaaatttgaatgtgatgtcaaaatttaaaaattgagcttaaaacaggattgatttctagcttcttttgaagaatcagctttgacaataccgggcctgctcttccctggggcagttaccagctgaagcagaagagacccttccctgttgtctctaaaccaaggccaaagggcgcttgccttgtgttacctcatggccactgttgtttttcttattgtagattttaaaaggaaaattaagatatttcttgggttttttttttttttttccagacggagtcttgctctgtcgcccaggctggagtgcaatgacgtgatctcggctcactgcaacctccgcctcccaggttcaagtgattctcttgcctcagactcgtgagtagctgggtttacaggcgtgcaccaccacgcccggctaatttttgtatttttagtagagatggggtttcaccatgttggccaggctgttctcaatctcctgacctcgggatccacccacctcggcctcctaaagtgctgggattacaggtgtgaaccaccacgcctggactatttcttggtttttgtttgtttgtttgaaatggggtcttggccgggcgcagtggctcatgcctgtaatccccgcactttgggaggctgaggcgggcggatcacaaggtcaggagattgagaccatcctggctaacatggtgaaaccccgtctctactaaaaatacaaaaaaattatccgggcatggtattgggcgcctgtagtcccggctactcgggaggctgaggcaggagaatggtgtgaactcgggaggcggagcttgtgttgagccgagatcgcaccactgcactccagcctgggcgacagagcgagaatccgtctcagaaaaaaaaaaagaaaaaaagaaatgggatctcactgttgcccaggctggagtgcagtggtacaatctccgctcactgcagccttgaactgctgggctcaggtgatcctcctgcctcagtctcccaagtaactgggactacagacatgcaccaccatgccctggtaatgtttatagttttttgtacagacggggtgttgctatgttgcccaggctggtcttgaacttctgggctccagtgatcctcccactttggcctcccaaagtgctgagattacagatgtgaaccaccacacccagccaagatgtttcttgaagctatttctctatcagaagtggaggtggaaaagtggaaaagaaaaaggctggagaaggctttttttttttttttttttttgagacggagtttcgctcttgttgcccaggctggagtgcaatggtgcaaccttggttcaccacaacctccacctcccgcgttcaagcgattctcctgcctcagcctccagagtagctgggattacaggcatgcacccccacacccggctaactttttatttttagtagcgacagggtttctccatgttggtcaggctggtcttgaactcccaacctcaggtgatccgcccgcctcggcctcccaaagtgctgggattataggcgtgagccactgcgcctaggctgagaaagctattttttttttttaagaaaactgggaaagtacatatttgaagagagtatttcttaacattttatttgtgaagcttatctatgtctgaatccaacagcccacttgactcatttgtggtattgcctggcccctcatggggcttttgagttcatagtcaccgctgtgatggacacagttaaaaagggattggaggggcctccaggaatgcttcttggaggagttgctgtcttgacctggtattagaaaggaggcaggctggccgggtgcagtggctcatggctgtaatcctagcactttgggaggtcgaggtgggtgaatcgcttgagctcaggagctcgagaccagcctgagcaacgtggtgaaaccctgtctttacaaaaaattttaaaattagctggatgtggtagtacatgcctgtggtcccagctacttgggaggctgaggcgaagatcacttgagcccaggagtttgagaccagcctgggcaacatggtgaaatcccatctctacaaaaaatacaaaaattaggccgggcacagtgggtcacacctgtaatcccagcactttgggaggctgaggtgggcagatcacctgaggtcaggagttcgagaccagcctgcccagcatggcaaaacactgtttctactaaaaatacaaaaaattagctgggtgtggtggcgagcacctgtaatcccagctactcgggaagctgaggcaggagaattgcttgaacccaggaggcggaggttttagtgagccgagatcatgccactgcactccagcctgggcaatgagagtgaaacgtgtaaaaaaaaaaaaaaaaaaatatatatatatatatatacatatacacacacacaaaaaaaaatacataaaactataggcatgtgcctgtagtcccagctgctcaggatactaaggtaggaagattgcttgagcctgggaggtggaggttgcagtgagcatggtcctcccactgcactccagcctggatgacagagcatgaccctgtcttaaaaaaaaaaaaaaaaagagaagaaaaagaagaagaaagtaagaaagtgtggtgtggcaggaccacagagctcaaaatagggagtgttgggaaagaaagctggaaataacaggaatttggaaggcctccctcgctcaatgggataagcaattgggtcttcaaatatgctggagaggccgggcgtggtggctcatacctgtattcccagcactttgggaggccgaggcaggtggatcacctgaggtcaggagtttgagaccagcctggccaacatagtgaaaccccatctctactaaaaatacaaaaaatagcccggtgtggtggtgcatacttgtaatgccagtttcttgggaggctgagacaggagactagcttgaacccaggaggcagagattgcaggttcatgccattctccatatcaactataatacttcccgttcaagtctgtgactgtgccataatttatgtgaacagtcccttagtgatggtcacttaggtgttcccgtcttttgttttgcacatgcagtcctgcggggggtctggtaccctcatctctcttcacttttgcccaggtgcaggtggctctgcaggctgcgtccctggaagtggaaccgtttagtcagaggctgcatatgcactcagaatgtcacaggttctgcctggcttttccccccgagaagtcatgggtaggatgacaccactagcacaggggttctcagcctcagcacccctggcatttggagacggatcattctttttgtttttctgagacggagtctcgctgtgtcacccagggcggagtgcagtgatgcaatctgggctcattgcaacctctctgcctcccgggttcaactgattcttctgcctcagcctcacgagtagctgggactacaggcgtgcatttgccatcacacctggttcatttttgtatttttagcagagacagggtttcaccatgttggccaggctggtctcaaactcctgacctcaggtgatccacccgcctcagcctccaaagtgttgggattacaggcgtgagccaccacaaccagtcttggatccttctttattgtggggggggggccatcctgtgcattgtgggacattgagcagcatctctggcctccaccaaaatgtttccagttgttaaccaatgtccccaggataggggcaggggtaaaatcaccccctgctgagagccagtgccctagcggctttgccatagccttcgctgcgtacagtatgtgtcgtcccctctcatctcccctcatggcccccgtgatcccagcatgcccaccaggcttccctggaaggtggttctgcaggtagaaggcagagggggtgagacgggggctgtggtcacatacagggggacactcaccagctgtgtgggcctgggcaggaacatcacctccacacaccctcctacttccttgtttgtaaaatgggatgaccagctactcgggaggctaaggtgggaggatcacttgagcctgggaggtggaggctgcagtgagccatgatcgtgccactgcactccagcttgggcgacagagcgagaccctgtctcagcagaaaataaaatgggataaacagaagctgcctccctcgccgggagcgaagggggcgagaacgccagcaaagtgctcggcctggagctggggcttaggaggagggtctgggagctgcagggttgccttgtccacccttctgtcgggggagcgattgcggggttcccaaggacggacatgggcttcgtgtgcagccgcgttcctgcttctttcccatcctggtttctttctggccgtggccttgtttctcccacgttgggggtgtgtgtctcctttgctctagaagcccgatttgagctccgcagcaggaattatgttttgagttagtgtgtccagttggttgctactttctcgccactaccaccagatgctaaattggtgggacgcaggtgggacctccaccagggtcctctctggccaccccaggcccctgggcctgcacggctgccctgcactgctcagccaggatccacctgcctgctgcccgagctgcccgtgggaagggcacaaggacagacccgtgtggccttcccaggtgggtgcgtgctgtctgccgggatggggcaggtcggccaccagctgttgaccttgctttgaacttgtttactgctgtgtgagttcagggaatgacataattcctgtccaagctccctggactaaatttaggtcccaggaaaataattttccctgggtgagttccagcaccgcagcgcccagagaatcggctgctgccctgagctcctgaatgctctgtgggttccaaggccagttcccaccaagctctagggcctggctctcaggagaggcctctgccgggcacctctctgcccagcacgggtcagcgtgagtctctgggtgactggccaccttcatgatttctaagcctacatctggggcacccacctcccccaccactctgcagagcctgctgtgcccggcagaaaaggagctgtggtcagatccaaagccacagatgggcaacttttctagtaaaaactttaaatatttatgttaaagcaaacatttattatgaaatagagtataacaataacatgatttctctctctctctttttttttttttttttttttttttgagacaaagtctcactctgtcacccaggctggagtgcagtggtgcgattttccgctcactgcaacctccgcctcctggggtcaagcgattctcctgcctcagccacccgagtagctgagattacaggcacctgccatcacacccagctactttttatatttttagtagagacggggtttcaccatgttggccaggctggtcttgaactcttgacctcaagtgatctgcctgccttggtctcccaaaatgctgggattacaggtgtgagccaccacgcctggcctggcctggcccctctcttttaaaaaaaaaaaataaataaactagagatgagatttcactatatttcccaggctgttcacaaactcctgagctcaagctatcttcccaccttggccttccaaagtgttgggagtacaggtgtgagcaactacacctgggtgatttttctttttattgagatgaaattcacataaaattaaccaggttaagtgaataattcactgacagtacactcacaaggttgtgcaaccaccacttctatctggttccaaaacattttaatcaccccagaaagaaaccttgcacccagccgcaatcattctccacttctcccttccccagcaacactgggtccctgcccagggcaaccacgaaactttctgtctccatgggtttgcctattctggacttttcatataaatggaatcatatactctgtggccttttgtgtctgacttctcactcagcataatgttttctttctttttgtttttttattgttttgttttttgttttgttttgttttggagacagagtctcactctgtcacccaggctggagtgcagtggcatgatcttgtctcactggaacctccgcctcctgggtttatgggattctcctgcctcagcctcccaagtagctgggattacaggcgcgcgacaccacgcctggcttacttttgtatttttttagtcgggggggggggggggtttgccatgttggccaggctggtctcaaactcctgacctcagccgatccacccaccttagcctcccaaagtgctgggattacaggcgtgagccaccgtgcctagcctgtttttgttgttgttgtcgttttttgagacagtcttactctgtcgcccaggctggagtgccgtggcatgatctcggctcccaatccaggaggtggtcctgggttcaaacgattctcctgcctcagcctccgagtaactgggattacaggcgtgcaccaccatgcctggctaatttttgtatttttagtagagacggggtttcaccatgttggccaggctggtcttgaactcctgacttcaagtgatccgcctgccttggcctcccaaagtggtgggattataggcgtgagccgccgcgcccggccagggctcctagtctgagaagtaagtgtcaaccctgctcagactccctgggaaggagggtcttgctgtcccgttcccccgccctctgtgtcccggcctgtcccaggccctgcactgtctccttcttcttcccatcttgcctgcttgcttttaaacttaagcatgggttattttcccctttgttattactctgcctcagaaaccccagcagggaagtcttggtcgcacaggcattctctaggattcgtttcgtgtgtgctttttaacatcagggtaccatggtgtccgggcctcgggtaggatttttgctgccccttcacgagtgtctggctctgtgtccagtaagctttaggaaaaaccgctgccgccactgcctcctcccaagctgcacccacccccccgccccatccagcctgcaccttccttctgctaaagaaaacttggggtggagcagcaggaagacaggcatgagaaatcacccgaataactgggttcattctactggcgattccttgatggaatggtgtgcggccatcttgtaagctgtgatatttaaagaacctttaaagacatgaagaattcctccgaaataccacatgacccccatttgggaagaggagaaaatttgtacgcatggagggaggggaaactggaaagacgggaattaatcctctaaaacattagtggggtggtccctgggtggtgacaggtgatttttaactttattttttctgtacttttctgtttcctgcaatggtcagtcattgctctggcaatcggaaaaatacccttattattgttattattttgagacggagtttcgctctgtcacccaagctttagtgcagtggcgcgatctcggctcactgcaacctccgcctcccgggttcacgccatcctcctgcctcagcctcccgagtaggtgggactacaggcgcccgccgccaccacgcccggctaattttttgtatttttagtagagacggggtttcaccgtgttagccaggatggtctcgatctcctgacctcgtgatccgccagcctcggcctcccaaagtgctgggattacaggcctgagccaccgtgcccggccaaatacccatattattaagagaaatgtttacaaaaggttaggacgaagccaccttggctgcgggagagaggaattgacagccatgattgttggtgcgcactgcggccgccagggggtgctgggtgcacgcagcacagagactgcagcctcctccagtcgcctcccagggccctcagcagctaagtgtgcaggagagggttgcagacgccagggtccgtgtgtgacctggctgctggaaacagcgccactgaaaaatcaacaggagactccccagccctccagccccccagctcattgtagccttcaaagaccactggccccaaaactacccgattcaaggtattttcagtatttggccccaccggccccgcctctcacgtgtctgaaaacagctcctgtcgtcttgctcttccctcagatgcttctgatgagcagaattcacagtcctcgatggaacattcgatgaacagctcagagaaagtagatcggcagccgtctggagactcgggtctggccgcagagacgtctgcaatctctcaggtacctcgctcgaggtctcagaggggcagccagatcggccgggagcccattgggttgtcgggggtacgttgaaaggtgtttcgtcattgtgttttgttgttttgtcgttggaccattggaactgtcatttgtccattgggctatgtccatgaacacagtcctgggctctgccttgggctctggggccgagggataatgagacttgtggcctctgccctcaaggagcctctgggtcggaggaggatgaagggaccttgaacccagcctcggctgctacgttttgtctgttcaggttcacacaggcattgcctcatctcagtgatccccagatcggtgacctttagagctgggaagacaagacttcagaaacctaagtggtggggcctccgacggagcggtgctgctggccccacttgcactgcatgggcccctctccagggcatcactctgtgttggaatctggtctgaatgagtcagcacaggtgcagtggggcccggtggttaggagcaaacctcccagagtcgggcccaagtttgaatcccagctcccaaaatgggatcacggaactgtcttagggccaccgtgaggattcgatgggagaacttgggtaaaacacttagcatggagcggacacaagatgcagaggtgtcattggccatgaccactattaggatttttcactgtaaatcctctagactttttttccttcgagacagagtctcactttgtcacccaggctggagtgcagtggcatgatcccggctcactccaacctccacctcctggattcaagcaattctcctgcctcagcctcccaagtaggtgggattacaggtgcctaccactctgcctggctgatttttgtatttttagtagagatgggtttcaccatgttggccaggctggtctcaaattcctgacctcaaatgatccactccctcagcctctcaaagtgctgggattacaggcgtgagccactgcgcctggcaacttcaaaatctttaaaccctttgattggcaggtccctttccagaacctcaccccatggaaccccctccacatgccctagctctaaggggctgcttagggaaatctggggtcttgtctgagacagactagggcgcagccatctagaagagcatggttgtgccttccaggttctgataaacattcttgcagcgtgcagtgagaaaagcaagctgcagatccgcaggcgtagcatgagcccatctggttaaaaacagtagaaaccaaagcctggtgatttatattaagaccaaagttgtcggctgggatctctgggcctcttgatctcagagaagaaaagctcagcttgaaactttgatccataccctgagagtatccaatgctcccccgcagtacctggaaatgccaggagtcccccattctcacatcgcccccactaccccacactcttgcttccaggagacccagacctaaaattgggcctcttccaccattttcacaggcacaccgacacacatattgtccacagagctaggtgtgtgagtgacatggaggatgtactccagtaaagcagacagcctgacatttcaagcaatacgtttttggccgggtgcagtggctcacatttgtaagcccagcactttgggaggctgaggcaggtggatcacttgaggccaggagttcgagaccagcctgggcaacatagcaagaccccgtctctccaacaaaaagaaaaagaaaattagccaggcatggtggtgcgctcctatagtcccagctactctggaggctgaggcgggaggattgcttgagcctgagagttcaaggctgcagtgggctatgatcctaccattgccctccagcctgggtgacagagcaagaccctgtctcaaaaaaataaatacagaaaaaaggagagaaaggacagaaaggtagccttcctgactccctgcgatccctgctcccagggtcccccagaaggggctcatgtcactgtctctgcaagtccatcgcatgtcctactcgaggcctctcctctgcaacatttatctctgagaacccaccatggaccaggggctatacctaatccctgcctgccacagtggggctgacaatgggctcaggataagcagacacaagtaggtcacagagtcccactaagtgccgtgagagagtgaaacagggtgacgtgaagaagcagaacaggccatgggtagagggtgctgtggctggcgtcagcagggaggggctggctgtgagccggacatgaagggggcccaggctgggacggtgagctctccaggcaggggcagaccaaggtgcagagacctcaagacaggagccagcttgaagaacgaaagagaggccagggtggccggggaggccagaacctggtgggtgaggaagagaatggtctgatgagggaagaagtgggccaggcttgtcactagggccttcttggtcctggtgaggaactgggtttgttcagaagtcagtaggaaagttgtggaatgctttgtatttgtaagttgtggtttctattggaggaaggttgctggggccatcctgttggccacaagcaggctgctccatcagccaggccagaggccgggttggagggggggtgcgggcggagaggtggcttcagggggtgtccaggcctgggtctttctcccaggctgatggggagcaccagttaggatggctgcggtcaggagtttggtctcaggtgacaggttaggtttgagaggcccaagacaattgtgtgatggatgagtgagtgttaaaccttttctggtgtcctgggtttcatgggaattcagtgacaactacagaccctttcccccagaataacacacacacatatgtgtatacccagcaaatgctgagagtccagcccagaccaggcactgtgcccagccctgcaggagcaggaatctacatggcagagtgggtctgggcctctgggagatggcctagaacttgcagagattgccaggcatcatggctcacacctgtaatccaagcagtttgggaggctgaggcaggaggatcccttgagcccgggagttcaagaccagcctgggcagcatagcaagaccccatctctacaaaaaacttaaaaaaaaaaaatcatccgggcatggtggcacatgcatatagtcccagctactcaggaggctgaggcagggggatcctctgagaccaggaagtcgaggctgcagtgagctatgatgaccactacaccccagcctgagcagcaaagcaagactctgtctctaaaaaaaattataaaaagaacttggaaaagctggtgcggtggctcacgcctgtaatcctagcactctgggaaggtgaggcgggcagatcacctgaggtcaggagtttgagaccagcctggccaacatggtgaaacatggagacatggtgaaaccctgtctctaccaaaaatacaaaaaattagccaggcatggtggtgtgcacctgtaatcccagcactctgggaggccgaggtgggcagataacctgaggtcaggagtttgagaccagcctggcccacatggtgaaaccccgtctctactaaaaatacaaaaattagccgggcatggtggcgcgtgcctgtaatcacagctacttgggaggctgaggcaggagaatcacttgaacccaggaggcggaggttgcagtgagccaagattgccccactgcactccagcctggcaacagagtgagactccatctcaacaacaaaaacaagaacttggaaaggtgaacttgaaacaataatcacaagtaatcaccctagcaatgaatcatagatgggaagattgataacagcaacttctggtccagtctgaatgagtggggagagcctagggtccaaggcagcagtgtaggaaatgctcccgagttaccagccattggcatgtgatagggtcaggcaggggccaggggacaccgcgctccatagctccaggaagagtttgggtgtgagggtctccataggtcctcaaactctctggagtccacgcttgggcctcgggtctggaactgctggtctgaaccacaaagccgcccccgctcggttccttccttggctgaccttcggcctcacgcctggcctaacttgctctcctggcccattaacctgtgttccccttttctcctctccccaaggatctggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggcgggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaaccacaactttgaaaatcttaatgttgaagttagcaatgccgaaaggtttctgtcttaaaaaaaaaaatccttgtacttatcaattttgccccttaggcagtcagttttgttgagaactgtgtcctgcatcctggcgcagaacctacctgatgcggttcctctccacgcatctcgaggcggcgttacctccagattccgtagagttagagtcacatttttctttgcagcgaaactccatcttggtgagagatgaatttggatatttatttccttctctgtttttgggaaatgagaggctacaaccaagacagctgaaggagaatgaaacacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctccccccaccacagaatctaagacctttcagcttcgagccagggggcgggggatcccgagcaaaagccttccgtggacatcaggccccgtggcctcaagggctcccagggcaaacctaattccccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattccatcagtagatatggtttgtacaatgtacaattgtttcatttcagaaaataaaaatttcaaatcatgaataccttgtggttttgtctcattttaagtaaggtcagatcgatggtgacggtgtccctctccagctgctccggcctctcttgcttggccgtgtggccctgattctacaagacacacaagttccttgcacacaggagctgttgccttccatagtcataagagctgccattattaagcaccagctggatgccaggcaagccactagttgctcctttctgtgggcaggtattgttggccaccttgtgcaggtgagaaaacagcaggacagtcccctgcagggctctcatgccgggtcaggcccccaggttgaaagccacacctgaggccaggcgtggtggctcatgcttgtaatcccagcactttgggaggccgagaagggcgatcacctgaggtcaggagttcgagaccagcctgggcaacatggcgaaaccccgtgtctactaaaaatagaaaaattagccaggtgtggtggcacacacctttaatcccaactagttgggaggccaaggcaggagaatggcttgaacctgggaggcagaggttgcagtgagctgagatcacgccactgcactccagcctgggtgcaacagagtgagattctgtctcaaaaaaaaaaagccacacctgatccgcctaccccgagacctgggttccagcagggacatgttttcagcttccctgtctctgaggggactctggattgtggtagggactcaggggcgttagtgcatgggtggactgcaacctcggcttgacttgtcctaacagcctctagtgacttacatggttgggctggaaacagacctttcccagggctgtgaccctttcagcccagactccttcccccacgctgacttccccacctctgtccagcgtcacctggcccttgggtcagcccctaaagagagctggcaggggtgggggtgttgtgtcagcgggtctaggccaagctgcactgcgtggaccggctgcaggcagatgctctctcctgtttgttctgtctgactctccttcctacccgttcctttttaacatgttccagtgtttttaccagaattggctgctcagctaaataaactcctgatatggaaagttcagcctgacaaaacacaaatcatagaggccttgtttgcttaaggaaaaaaaatgcctgagctggcacacgttcccgcgcttcctttctgccctccctgcgtgtctgttcccagctctcactctctggatcggtccctccctcctctctctaaggcttctgccctttccccctgcctcccttgtctccacccgcctagatcactgtctcacagtcattctgtggaacttcctctgtgtctctcactggagccgcctaacttcctctcccacctcccttcatcaaggagcagtctcatgcccaggagctagaaatgtaggctttgccggcattggttgagctgtgctgggccctaggcagcgatgactcaaacttgacccttaacccccaggcaggtaagtgagccgcagtgctttacgatgccgaccacagtttggaattaggggatacagacattctgatggcaagggtcagggaatctcctaggacactggaggaataccaggcctggggctaagcagctcgtttttcctttttgacacaaaggaggggctggaggcttctgagccaaggctctgctggactagggatggtgttgccaatgaatagcatggattggaaaagaccagactggaagtgggagccgggcaactagggaactggaacaataggccaagcggggggccagcggttggcaacagggcccatgtggccccaggcaatgtgaaggcggtcagtaggcagggaggtggggtgggaaagggatcagctgggggaggtaggcagaaaaggctcaggtccaagttccaggccatgctaaggcaacaagtgtcacagaggtccgtggtggggccgaggatggactgcagaccctaaaggccaagtccaacttccctctatcgctcctctgggtgaagaatgcatgtttcctccagagtctcagattagatagacatcctttgaccttgtctatccagttctgtttccctcttcttcccataggggtctccctccctccccgtccttaagtggggcgggcacttagcccagggtggtgatatgacccagtcctatccaatcaccatggtcccgcctcctggctaccacaattggctcagggatgagcacgtggcccatagcagcccagtgagagtcagccctgggtgggaactggtgggaaagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcaagagattctcctgcctcagcctcctgagtagctgggattacagccgtgcccggctaattttgtatttttagtggagatggggtttctctgtgttggtcaggctggtctagaactcccgacctcaggtgatctgcctgactcggcctcccaaagtgctgggattacaggagtgagccaccgcgctcggctgatttttcacttttatgtggtcaaaacacccatggtacaaaagaggtatctctcaaaaacttcccttttagaggcggagcttgcagtgagccgagattgtgccactgcagtccggcctgggctaaagagcgggactccgtctcaaaaaaaaaaaaaacttcccttttataagccctttcccccccttcttttcctcctctctctcttgttcccttctttctctgtctgctttactttagaacctgatgtgacaaattagctttgattcctattctgtcatctttttggactataggttcagactataggttcacacttaagtgtgagatgttggccaactggcatttccatcgcttcacttgctcttctttttcaaggacttgcctgttgcccaggccagcccctggctgggaaaagtagcagcaaggttgggactttgatcctaggctctgcactgtgggtggtgttatctcaacttatcctctgtcttcaaagctgcagacccatttatggtggtgatggagaagggagggaagagcatgggccagaagccaaagctgctcgtttctggagaaggcctcctgattccctctgcctgaaacccttttctctcccttctctttccctggttaactcctgcccgtccttggagactccgctcaggcatcctaattaaggaaaacaccactgggtgcccctccattgcacttccatacactccacacatgcctttgctcactcaaaggaagacctttctgtcttctgcattagctcgtgaggtcctgagggcagagccagggatggcattgtcactgtgttgtcactgtctgtgcagagcctgacacatcgggcttttggtaagtgttgctgggatgttccactccctggcctgcagagggtttctgtatggtgtggatgcatttgattcctggtggtgaaagcaagatggaatcgcaggttctttttttttttttttttttttttgagatggagtctcactctgtcatccaggctggagtgcagtggcgcgatctcggctcactgcaacctccgcctcccgggttcaagtgatcctcctgccgtagcctcctgagtagctgggactacaggcctgcaccaccaagcctggctaatttttgtatttttagtagagatggggttttactatgttggccaggctggtctcaaactcctgacctcaggtgatacacccaccttggcctcccgaagtgctgtgattacaggtgtgagccacagcacccggccttcactgctcttgattcccatagattcatggagctgaaagagaggtagcagcatcagctgcaccagctgcactagcttccgggtgcaggactccaactgggcccacgcctctcctctgagagcactggcaggggttcaacgtcaccagccctcctccttgtgttctcctctgtctgtcgccctctcccaggttgtccactctgtagcttgactaagaggcacttgataagggtcactgctgtgaagtgtgcctgagagctgatggtgcaggcagtcatcaggcccttggtggcatttcctcgcggcgggagctgggggttcaggtgacaggacagctgtgaaacccccagctgcaattcctgtgtaagggctaataaagacatttctgcctgtgctgtcgctcttggtgggatgcatttgcattttcctggatgtacctaatctcacagctctggtgctctccagctccgcagcacctttgttcagcatccccccacagtcgttccccctcttcccatccagagtcacggtgaggcttggccacagtggcctagaggctttaattgtgcggttcccacagcacagtgagtcagacagccctgaacgtcttgggaagcatcagctgaatgtatgaattctttttactgagaacctcctgtgttccagatagaaagtcagtctgctctaaatacctggcttcatttcattcttaccacagctctgtgaagtagttttctttttttcccaaagaaagtgaagttctgaaaggccaggtgtctgtccaaggctgcagagctggcaggcagttggacactgactgccctctcccggctctcctgtggctggtggtgacagggtggttagaaaagtgtcttttccgagttggccctgattgaaaagggggatttggggggacattgtcctcccccagctctcctgtgaccagtggtgacagggtggtgataaaagcatctttctgagttggccttgattggaaggtggggggttgcggggacactgccctctctggctctcccctggccggcggtgactaggtggtaataaaagtatctttccaagctgaccctgattggaaggtgcgccatgtgtcccctgcgaagggcagcctggcctgtgatgctgctgatggagaagatgaatttttatgacattaagacagaatcagggccgaaaggggtggttcacacctgtaatcccagcactttgggaggctgaggcgggtgaatcacgagttcaagagatcaagaccatcctggccaacacggtgaaacctcgtctgtactaaaaatacaaaaattagccaggtatggtggcgggcatctacaatctcagctactcaggaggctgaggcaggagaatggctttaacccaggaggcagaggttgcagtgagctgagataacaccactgcaactctagcctggcgacagagcgagactccatctcaaaaaaaaaaaaaaaaaaaagacagaattagatttcctcagtaaaatctgggattttgccatcagaggaatcatattatcattcttccttatgtcaggaaagggtagcaggcccttgtacataacatgaggactgaaactttatagtcaaaaaatcaacataaatggttggcttcaagttttgttcataattactctctccctgctcgactcctccccacctctaaatgcacgctggcccccaaagatctgcaggaaggagaagacacaaaatctccttcccatgtgggtcacgccctttcattagtccgtgagctcctgcaaggcctgtgttttgctttcacttgtgtgtggagggaaccagcagtacatcagggacttcggttttgagaaatcagtgcccatcactgtctaggcagacttctttttcctgctctgtagtttttcttaaattatgtgtgtcttacaaattctcattccattttagtctattcttccaggaggccttcaagcaggggtaaatgaaagagagagacattagtcactctgaccttgacttttagtgactaaacctgtgctcaccctcatgtgaaactataaaaaatataatttcctttttaggtggcacaatctcagctcactgcaacctctgccttccgggctcaagtgattctcctgcctcagcctcctgagtagctgggattacaagcgtgcaccaccacacctggctaatttttgtatttttagtagagatggggtttcaccatgttggccatgctggtctcgaactcctgacctgaagtgttctgcccaccttggcctcccaaagtgctgggattacaaggcgtgagccaccacgcccagctaatttttgtatttttagtagtgacggggttgcactgtgttggctaggctggtcttgaactcctgacctgaagtgatccgcccgccttggcctcccaaagtgttgggattataggcatgagccactgtgcccaactactttttgtattcttagtagtgatggggttttgccatgttggccaggctggtctcgaactcctggccttaagcgatccacactgggattacaggtgtgagccaccgtgcctggcccaaattgttgcttttcacagacaggaaagaaatgtagatatatggaatgctgacaaagatgtaatccgttcatacgtctcaggagagacagaagggctgtttgacctcagatgggttggctgaggagatttgcagcatgtctgaaatacaaaaactgtttctacagcttgccttcgatttagagtaggctccaactcttctgcccatcccaaactcctctgctacttggaaggttaataagttgactaaaaaacacccatgggaagaggatgcaaaggagagatttaggttgacaactgattctcagtagcagatgggagaaagcatctttagcaggcaaagggaaaatggattttattttggaatttctattatgtgatgagggcagtacaaagttgttcgtatgcttttttgaatcctcttcctcaaataagccagaatcctgtggttgcagtgggtgttacaggatccagctattcttccttttgccgaatggaagtgggtgtgaccccaacgcatccctgctctgggtgcctctcatttttattctttagggccaggaactctctttctggggagggatacaattccagacccttaaaactgaaaataattgggaacaatctttactgaattatctcttgtctcaaaaagggaaaaacctatttaaagcctatttaggtttagggtcaggtacggtggctcacgtctgtaatcttagcacattaggaggccgaggcaggaggattgcttgaggtcaggagttcgagatcagcctgggcagcatggggagatgcttatctctcttttttttattttttgagacagagttttgctcttgttgcccaggctggagtgcaatggcgcggtcttgggtcactgcaacctccgcctcctgggctcaagcaattctcctgcctcagcctcgtgagtagctgggattacaggtatgtgccaccacgcccggctaattttgtatttttagtagagacagggtttctccatgttggtcaggctggtctcaaactcccaacctcaggtgatccacccgcttcggcctcctaaagtgctgggattacaggtgtgagccactgcacctggcctgggagacgcttatctttaccaaaaaaattaaaatttagctgggcatggtggtgcatgcctgtagtcccaaattcttgggaggctgaggtgggaggatcacatgaacccagtagttcaaggctgcagtgagctatgatcatgccactgcactccagcctgggcaacagagctagatcctgctcttcaaaagaaaaaaaaataaaaaaagggctgggcgcagtggctcacgcctgtaatcccagcactttgggaggccaaggtgggcggatcacgaggtcaggagatcgagaccatcctggctaacatggtgaaaccccgtctctactaaaaatacaaaaaattagccgggcgtggtggcgggcgcctgtagtcccagctactcaggaggctgaggcaggagaatggcgtgaacccaggaggcggagcttgcagtgagccgagatggcgccactgccctccagcctgggtgacagagcaagactccgtctcaaaaaaaaaaaaaaaaaaagtctatttataggtcttggctacctggcgagtgttaccttatccttttaaatgcatcagacagcttcagatttctttgacttgtaagtaggctgtgtagctggcagtgccttgaaatgactaatagtggtgataatatcaaatttgttttttgtcagtcttcataggtgcttagaaacatttgcaagtatgatctgtttttattacatctctggtagccaatttctagagtcttgactccaggtgtgtactctggctagagaatgctgttccttgatttattgcctctttaagccaggtgtctgcaattgggtagagtttttcattctttacataaacattttaccttggtgaatatttaaaccaactaccaactgaattacctttttatgaaggtgctagggaaaagctgtattctttggggacagtcatgcttagtactgaatataatggaaacctttccctgctgcctgtggcttagccgtttggtcagggtgagggtggcagttgccatatcagctaggtggggctatgtcaaacacaataaaatgaggatagtgcttgtgtttgagtggtataactgcgtgatttggttttgttttgctgttttttctttctaaatttcctttttatattatttagaaatgttagaaaaatatgatcagaaatgtgaaggaggttcatgaagcaaattatagcaaaccagatagctttggatttctctttttaagtaggttaagtagtgtaagtagaataacattccttaatttggtatggtgatggcccaatttgaagtggggtgctgcctacattaattgatttattaaacataatcccaatcaacatattaaaatagttttcttttttcttttagaatagttttattttgagatttgtcaacatggtcataaagttcacttgaaagaatagtaggcaagaattctaaaattgttttaaaagatgatgggtgctaaccttacttagatagtaaagtatagcacagagttgtggtgattaaattagtgtgatggcagcacaggattggacacaggtcagtggtgatgcagggcccagaacaagccctggtataggtgaagatgcaacatatgttcagagaagtgtcgtaagtcattgtgggaagatgagacaatgagataactagttggaatttgtttttgtgagctgtgtaaagaactaaattgattttctccccagatgaatcagagttatgtaaaaagtgaaatcattaaaaatgtatgtacaggccgggcgtggtggctcacgcctgtaatcccagcactttgggaggccaaggcaggcggatcacaaggtcaggaggtcgagaccatcctggctaacacggtgaaaccccatctctactaaaaatatatatataaaaaaatagccggacgtggtggtggcgggcgcctgtagtcccagctactcaggaggctgaggcaggagagtggcctgaacccaggaggcagagcttgcagtgagccaagatcgtgccactgcactccagcctgggcaacagagcgagactccatctcaaaaaaaaaaaaaaatgtgtgtacaaaacccataagaaacaacatccagaagtggtcccaaatatatgtatctatgggaagggggtgtatgatgaagatggacctttagtttaatggggaaagatggattatttaggaaatcttacctaaagcaggatccctacatcatccctgtacattcattccaccaaataaatcctagttggctttattgaattgaatgtaacaagggaagccgtgaaagttctagaaggaaataggtaagtgttttcaaagtcttaggctaggaaaagccttgttaagtacgacacaaaaaacagaagcataaaagaaaggacttctaaattttgactatgttaatgaaaattagtgtttatcacagcattgtttatttgaaacagcacgtctgttaatataaatgtatgtctgtggggaaatggttaagtagattatgataaatgtgtacagtgaaatattctgtatataaaaataaaataatataaaactttattggcataagatgtctgtgacatataagtgaaaaatgggttataaaacaaacctgttcctacctatttaagcattatgttattcatatatatatggattttttggttttttctttttgttttgagacagggtctcactctgccacgcaggctagagtacagtggtgagttcacagttcactgcagccctgcagcttccacctcctggactcaggtgctcctcccacctcagcctcccgagtagctgggactacaggcatgtaccaccacacctggctaatttttgtatcttttgtagagatatggtttcgccatgctgtccaggctggtctcgctcttctgggttcaagcgatccactcacctcagcctcccaaagtgctgggattacagatgtgagccaccacatccagcctatttatatatttttatctttatttatatacatacatagtcagatgaatatgtattgccaagacttaagggccaacttcagagttagaacagtccatataactgccttcatttctttttttttttttttttttttttttttgagacggagtctcgctctgtcgcccaggctggagtacagtggtacgatctcagctcagtgcaagctccgcctcccaggttcatgccattctcctgtgtcagcctcccgaggagctgggagtacaggcacccgccagcatgcctggctaacttttttgtatttttagtagagacggagtttcactgtgttagccaggatggtctcgaactcctgacctcgtgatccgcccgcctcggcctcccaaagtgctgggattacaggcgtgagccactgcacccggcctttttttttttttttttttgagacagcatttcactcttgttgcccaggctagagtgtaatggcgcaatcttggctcaccgcgcaacctctgcctcccaggttcaagtgattctcctgcctcagcctcctaagtagctgggattacaggcatgtgctaccacacccggctaatttttgtatttttagtagacagggtttcatcatgttggccagactgttatcaaactcctgacctcaggtgatccacccacctcagcctcccaaagtgctgggattacaggcgtgagccactgcgcctggctgactgccttcatttctaataccaaatgcaagttggggagttcccaaaaccaccctcagtttcaataattcactagaaaaacagaacgcactgaaaagtattatattcacggttgcagtatattataaggaaaggattcaaattaaaatcagccaagacgcaagtttttactggacttgatccattctacccctgtggttgacctttagtctctagccccgcccagatgtctggctaagacctttagttagcctttcctctggaggttggaactgataccctgtgctccaggcccccattgtaagtcagattggtaactgttctgtggccaaagcccccaggcaaacaaagacactcccatcaggcagaactaatttctaattccaggggcctagaattcacctcccagcagcccagggcaaaggctggacctctctttgggaaggtgacttctttttttttttttttttttggttgggggggggacagggtctcactctgttgcccagactggagtgcggtggcacgatcttggctcacctcaacccccacctcccgggttcaagcgattctcctgcttcagcctcctgagtagctgggattacaggtatgcgccactactgcccggttaatttttttatttttagtagagatggggtttcatcatgttggccaggctggtcttgaactcctgacctcaaatgatccacctgcctcagcctcccaaagtgctgggattacaatcgtgagccaccgcacccagccaggaagactacttctttgctacacaatattatcaccaaaatgtaacaggttatttctaggtggcggaattgaaggtgagtttgcttttgttctttgcacttttcctttttgtttgaattttcttttattatggatagatatatattttaatcaataaaactacaaaagcttaaaagataaaagtgaaaactaaatctctgaatgggtgggagggcaggcagggaagcagtacaagaaattataaagaaaaaccagtagtggccgggcgcggtgtctcacgcctataatcccagcactttgggaggccgaggcaggtggatcacctgaggtcgggagttcaagaccaccctggctaacatggtgaaaccccgtctctactaaaaatacaaaaaattagctgggcatggtagcgggcacctgtcatcccaactactcaggaggctgaggaggagaactgcttgaacctgggaggcagaggttgcagtgagtcaagatcgcaccattgcactccagcctgggcaacaagagcgaaactccttcccaaaaaaaaaaaaaaaaaaaagaccagtagagatgactacacaaatatgtaacctacattcaaaagacatgccataaaaacaagtaaaagacaatgaaaatcctaggggaaacatttgcagaaacatcacaaagcattagtaccactaatattataatattgcgaatataaaatagcaagggaaacaatggctgacacctgggcacagctgtaatcccagtacttcgggaggctgaggtgggcagatcacctgaggtcaggagttcaagaccagcctggccaacatggcaaaaccctgtctctacaaaaacacaaaaattagccaggcatgatggcagtacctgtaatcccagctacttgggaggctgaggcaggagaatcgcttgaacccgggaggtggaggttgcagtgagccaagatcatgctgctgcaatccagcctgggtgacagagcgagactccatctgaaaacacacacacacacacacacacacacaacattgacatttcaatgactgtaaatgacgtgtagtctgtttaccagtaatgtcccaaagccaatttcccggctttgacattgtgctccagcgatacaagagccaccactggggaaagctgggtgaagggtacgtggagctctttgttccatttgtgtgacttcctgtgagtctataattacttcagaataagttttttttttaattttattattattatactttaagttttagggtacatgtgcacaacgtgcaggtttgttacatatgtatacatgtgccatgttggtttttagaaaaggcaaagggcatgggcaaacagctcagaaaataaggggcacatggctaaagcgcaggtttttaattatgaaatttcattaacaaatgatgcaaattgaagtgaaataccaagtttgcctcttgcaaatctggtttcatctccagtccggaggagcaccttggggtctgattggggtttactcttctggcgaggaaacctaggactctggctttaaatggtgccctgcccaggggtccctgcccctgcccctgcctgaaagtccacttatggcttgaatctgacaggaaacttaagaacatgcccaagaagctcctaaaactcaggagcatgcctcaccatgcccagcattgaccgcgtgctgggcccaggccctcatatctgctatggctgacccagctgtccagtgtggtggatgtggtcactgttttgcagaaggtgggctgggccgggccagcctgggtgacgaggccagaaatggaaccactctgctttctttgttggttagaagtggtctagacatggtggtgtctgtcctctagtggaaggcctggacacagcccatcccaggcagggtgaagtcaccattgcaggcaggcacatcttgcctggtatccactccctcaagttgccctatttttgggtggtcatggaaatgattactccctgcttttcacacagaaaagacaaacatacaccctcacaaacaagctggcacgcatgtgggcggagcacctgcaggcactcgaacactcgcacactggagtgtgcaccagccttcccgccacagccctcggatcctacttctccaacaggatgttctttgaatgtaagaaaaaagatgccaagagatccacgaggaggatggagcaggacctgaaaccccctggggttcctccataggagactctctgctcgggcaggtggcccgacatgcacactgcccctcctgtcaagccattggcagtggcccctcccgcgtgccagctcctcaatgaacctttgttcgtctgtagcctgttagctttggctgctggcagcctgtgggaccaggcccacatcccaggactagccgatagagactgcccttttgaagcaagtgaattggactcctggaagagtcattcctccactccctcattgaaaccacctaataaccgtgatcctcatatctggatctggtgcacagaattgactgatatatctgtttttgtgatgaattgccttccgcaattaactagaagccctagaatgtcttggaccttgcctggtcttttttccttgtttattttgaaaaagtaatacagtagtccccccttatctgagggggtgtgttctaagaccccagtggatgcctgaaagctcagatagtaccgaaccctgtatacagtacatttttttcacatgttagctctatacttgtgataaagcttaatttataagttaggcacagtaagagattaacaacaataataacatagagcaattatgacaatctactattcacaattgcatggatagaaaatctgtttttaccatagatcttagcaacctcagccttgttaagttgagaacttgcaccttttcacttaatgaaagcactttaaggcttctctaggtcatatctgaattgccagcatcactactcttatgctttgtggccattattaagtaaaataagggctacctgaacataagcactgtgataccacaaccatggatctgatcactgagatggctgctaagtgacttagcaggtgggtggcaactacagtgtggatctgctggacaaagggatgagtcatgtcccaggcgggacagagcggtacggcgtgagattttgctattccaaatggtgcacggtttaggatttatagattgtttattttctgcaactttccatgtaatattttcagacagcggttgatcatgggtaaagcacaataccgcagaaaagggaggaatgcagtacattccagtgttatatttcaacaatacaaaacggtgatcagtgaacactccttctcactggaccccttgcttctccagctcatctctgcaaagggaaatcgctgtggcactcttaccttttcttatgtatccatcttggctgtcttttctcctccctcctctcctacatgtctgtgtggatatctctgaatataaacggtagccataccaggccgggcgcggtggctcacgcctataatcccagcactttgggaggccaaggtgggtggattgcttgaggtcaggagttcgagaccagcctggctaacatggtgaaaccctgtctctactaaaaatacaaaaattagctgggcgtggtggtacacgcctgttatcccagctactcaggaggcttaggcaggggaattgcttgaacccgggaggtggaggttgcagtgagctgagattgccactgcactccaacctggtgacagagtgagactcccatctcaaaaaaaaaaaaaatagataataaaaataaaaaacacatgggctgggcacggtggctcgtgcctgtaatcccagcactttgggaggttgaagcgggcagatcacgaggtcaggagatcaagaccatcctggctaacatggtgaaaccccgtctctactaaaaatacaaaaaattagctgggcatggtggtggcgggcatctgtagtcccagctacttggaggctaaggaaggacagtggcgtgaacctgggaggtggagcttgcagtgagccgagatcgcgccactacaatccagcctgggcgacagagtgagactctgtctcaaaaaaacaaacaaaacaaaacaaaacaaaacaaacaaacaaaaaaacagaaaaaagaaaaacaaatggtagccataccatatatcttgtaccttggttttatttttgttttttcacttaacagtgcatcttgtaggtcttccctatatgttaccacatagaaatgtgttattttaaaaattaccccgtagtgttccactgtgtagatatgccagtttttttgttttgttttgttttgtttttgagatgagcctcgctgtgtcgcccaggctggagtgcaatggcgcaatctcagctcactgcaagctccgccttccaggttcatgccattctcctgccgcagcctcccaaatagctgggactacaggcacctgccaccacacccggctaattttttatatttttagtagagatggggtttcaccgtgttagccaggatggtctccatctcctgaccttgtgatccaccctcctcggcctcccaaagtgctgggattacaggcgtgagccaccgcgcccggcgatatgccagttttgactggttccctgtgatgaatatctaggttatttccaaccttttgctgccgcaaacagtgctgcagtttaatgtccttctcttcacgtctttgtgcccatgtgaggtggatctgtcgaatcacttcctaggagtgggcttgtgggtcacagggatgtgcagttacagtgttgatgggcagttgtcagcttgcccttcaaaaaggctcacaattgtttttgcccatcattctatccccagcaccagcttagtgacgagaactcttccccaccagagctctaaactgattgggaagtaaaacggaggaatcactttgtagcagcgctattcgctgtagcccaaaggtggatacgacctgtgtcctactgatgatggataaacagaatgtggtccatctatacatggaatatgattctgccttgaaagtaatgaagttctgagaatatttttttctttctttccccctccctcccttcttctctctttctctcttcccttccttccccttctctttcttttctcttttcttttcttcttttgagacagggtcttgccctgtcacccaggctggagtgcagtggtacaatagtggctcactgcagccttgacctcctgggctcgagcaatcctcccatctcagtcttctgagtagctaggaccacaggcacatgccaccaagcccagctgattttctgattttttgtggagatggtggtctctcactacgttacccagaccagtctcaaactcctgggctcaagcagttctcctgccttggcccctcaaagtgctgggattacaagtggggaactaggtaatggtgctggttataaaacattgtgaatgttcttaatggcactgaatcatctactttaaaatggttaaaatggtaaattttatatttattttactacaagaaaaagagtcagcagatggtggccaaaatattacctttgttgttgaccaagctgaggatatggcttgtaagagaaccctggactgaccttccacctccaccccctcttcaggagcaggggaaggagggaacgaccccagcccaggttcttcttcagcactcattgtacctgtcctgcagcactcactgtgagatgccccactctacctgtctgtcagggagtagggaggaagccagggatgttttgctaaggggtgtccctctaagaagcaccaggaatggtgaagaaacgttgtcccatgacaaacaaatatggttgaatgaacaaatgaatgggctccaccactgttctgagacctataacgatagccccagagccctctgcatgcttgttttttttttttttttttttttttttgaaacggtgtctcactctgtcgccaggctggaatgcagtggtgccatcttggctcactgcaacctccgcctcccaggttcaagcgattcccctgcctcagcctcccaagtaggtgggactacagatgcgtgccaccatgcccagctaatttttgtatttttagtagagatggagtttcaccatgttggccaggatggtcttgatctcttgacctcatgatctgcctgcctcggcctcccaaagtgctggaattccaggcgcgagccactgcgcccagccttttttttttttttttttttttaaattgagatggagtcttgctctgctgcccaggctggagtgcagcggcgaggtctcagcctcctgagtagctgggattacaggcacgtgccaccatgcctgactaatttttgtatttttagtagagacaggatttcaccatgttggccaggctggtctcgtgaccctcctgaccctcgtgatctgcccacctcggcctcccaaagtgctgagattacaggtgtgagccaccgtgcccggcctctgcctgctttcttttggagagaatggtctgagcaggagtcaggagttcgtcccagccggaccgaacagaattagggacccctgacctggccatgcccggcctgccctctctgcctgcccctgttcttacttccagcttggtctgtgcaaggcttgcaatttaatttccttccattccaaagcagtctcttgccagccctctgaggaattcatagtttgctagtttcatccaagaaaagttttgagagagacctttgttgtactgtgaatttcctgtttcatgtcaagaacctgccttctaggaagggcagctgtggcagggtggtgtaaagattgttcttcatggaaaatttagcattcatttaataactgcatatttaaaacacctcccacgtgccaggccctgtgctggcgaccctaggcgatggccttcccacagagggtgaggagagggctagcgaatgggtgagtgcagttggccttctctgttctgatgggcagatggcaggggcgggttcaggaggtggaggccagaggaggattgcgtatcttgggggaagccagtggtcttgcagaaatggtcagaacatgtttctggtctgctttaaagaaggaatggagcataatccaagttagactaagaggcagcccagtcacctttgtctggaagatgttgagctggcagcatgagttaggggagcagaagtccccccagtcacagatgctttctggcggtgcttccctgggggctctgccagggagggctgccctccactgctgcaggctcccttgtgggctttttaaaaaaaatttttagacagggtctctctctgtcacccaggctgaggtgcagtggcaccatgatagctcactgcaccctccaactcctgggctccagggatcctcccacctcagccttccaagtagccaggaccacaggcacaggctgccactccctgctacttttttctttttctttttcttttttttttgagacggagtcttgctctgtcgtccgggctggagtgcagtgatgcgatctcggctcactgtactctccgcctcccgggttcacgccattctccggcctcagcctcccaagtagctgggagtacaggcgcccgccaccacgacgcctggctaattttttttgtatttttagtagagacgggggtttcaccatgttagccaggatggtctcgatctcttgacctcgtgatacacccgcctcggcctcccaaagtggtgggattacaggcgtgagctgccgtgcccggccttcttttctttttcttttttttttttttaaagagacgaggtcttgttatattgcccaggctggtctggaactcgtgagctcaagtgatcctcccacctcagccctccaagtgctgggattacaggcgtgagccactgcacctggcccattgtgggacttttagagcagcttttcctgagtaccctgtgaagaagggtccccgtggaggtctgcgtaggaaatgtccctgctcctctccttgaagattgacggggcacagcctaacagctctgccaggcccatcaggagcctgcccagggtttctgggcatgagtcgtccagggtgtcccttcctttgtgacacctgacgcattcattgccaccttgccaccttctgaggcatcacagaacttcacgcgttgcctcctcagatcttgacttgaaattgccttgggggcgggctgggggtgcaggccgtcgaccctttccggcccgccgtggctggtttgtttggattttgagttggacgcccttctttgtgtttgttgagcgccacctgttggtcatagagatattaccgaaactcggggtggaacggtgatcccagttgggagttctggtctctgtgttgctgctgaagtctgactgtgtttgacgtaaacacccaaagaaaagggaaacatttcagctcacggagaggaagaagaggggaccctcaaactaaactttgaggtttctagcctgtaaggctaaatttccctgcgtcttgccgctcccctcattatgtgtgattaaagctgttggtatgacaccctctgccctccagctttgtctgctataccccctgccttcagactcccttttttggttggttatttttgtttgtttgttttctgagacggtcttgctctttcacttaggctggagtgcattggtgccatcatggctcactgcaacctcaaacacctgggctcaagcgaccttcctgcctcagtctccccagtagctaggactacagacgcatgccaccatgccctgttcacacattgagggcttttcactgcctcgatcaggctgagttctgctcactggggccaccacaggccaggcagaaggaactgtgtgggcttcgtcgagctggctttccctatccactaggcctttgcttaaacgccacttcctccagaaagcctcccctcactgctctggtcaggttggctatccaccttgtgcccacagccatctgcccttcaggacgctgagcgcagaggcatgacgtgtgctcccacccaaggcgtgctgcatgaggggaacctccccgcctcagctgtcccccaccctcagccgtcccccgccccagccgtcccccgccccagccgtcccccgcccttagccgtccccctcctcagccgcccccccgccctcagccgtcccccacctcagccgtccccctgccctcagccgtccccctcctcagccgtccccccgccctcagccgtccccctcctcagccgtcccccgccctcagtcctcggctcttcacagtgcagagcagatgaggcttctgcagctacgcaatcccaccctcagggctggcctggcactcggagctgacctctgcccaggtctctgttcctggtgttggcagagggcaccggtgtcaccttttccacctgtggagaaagaggaaccacatggcaatatggcaaacataagagaaaggacttcagggcgggggttgttaaaaacatcatacccttcaatatatgtacctactatgtactcataaaaatcaaaacaattttttttttaattatgccttttgccaggcacggtggtgcatgcctgtaatcctaccacttttggaggccgaggtgggaggatcacttgaggtcaggggttcaaaaccagcctgacgaacgtggtaaaaccctgtctctactaaaaatacaaaaattaggccgggcttggtggctcacgcctgtaatcccagcactttgggaggccgaggcaggcagatcagctgaggtcaggagttccagaccagcctgaccaacatgatgaaatcccatctctactaaaaatagaaaattagctgggtgtggtggcacatgcctgtaatcccagctatacaggaggctgaggcaggagaatcacttgaacccgggaggcagaggttgccgtgagctgaggtcgcgccattgcactccagcctgggcaacaagagcgaaactccatctccaaaaacaaacaaaaatttggctgatgtggtggtgggcacctgtagtcccagctactcggttggctgaggcggcagaatcgcttgaagccaggaggcggaagttgcagtgagccaagatctcgccactgcactccagcctgggcaacagagcgagactccatctcaaaaaaaaaaaaaaattattcctttcagtaataacttaaccctagatcattgagattgttattaatatctttgtgtttgctttagggtttaccagttgtgtgtgtgtctaagcatgtatgtgtgtgtgtattttactgtacacaaatgtgctttcatttagtccttattaacacactctagaggaggaggcgtcattctgattttacccagggcactgctgtggtaggcagcaggtacgccatgacacagcagtggctgtctgattccgtagctgcctgctgtaccaccggtgaggccaggccatcagcatggaggtgggttagatgagcctttgaacttgggagagaaggaaggaaggaaggtgtgtgactactctgagtccctgacccgttgtgcagaggctgctgctgtctgcgtgtctcttgtgtgctgagaggatgcactgtgacatttttctgggggagtcataaccttctggcctgtattgcccaaagcctgggctccttgggggtttgggtggggataggcacaagggtcctgccaggggcacagccagggcatctgccttccagggcaggttccaggttcacagaatgtttgctgctcaggcgcctcctgtgaagactgcagctactgttggcaaatctcggcttgccacgtggcctttctgagtgggactggagaaggggcagggctgtggcctgtggtcagatcaaacctccacagccgcactgtgatatggaccagaaatagtgccttgcccatctcaagccatctgaaaaagagaaaccctatgcgggctgcccagagatggctcccggcctagcacttggaaaactgagctgcccaagacagctgtgccaccagggaggctgggtttacaagtgctctggacttattgaatgaagaattgttaattgagcccctactatgtgccaagccaccaaacgtcctccctagaggagctgcagtgtcaacagggaaaggtgcttgtgtgcagacactactacataagagctcccgtgagaccatccccgagtggaggagagcagaggggccctgaaggaatcagcagcagcctgggagaggccaggccagctcagaggagatggtgtcgggggcagcatcttgaaggattaggaggtggctgagtggagggccatcaagagtgaggaccatgtcagaggctctgggaggcagaataggccctgccctgcaggtgctcaggccagtgggatgctcgggtacttggattgtgaatgcctcgtgggggctggtggcaaagcaggcaggccacgaccaggtcacaggagcctggttttcactctgtggtcaacagatttcttctaatttttagttatggaaaatttgtaggatatgccaaagtagacggaagaatgtagtgaaccccacatgctgccaccgcacacaccagttgctgtgtgacccatgactgcccttggtctgcccctctctggaaacaagaatgactttgaatccaggaagggaggctggtcaaatgtgaataacaatgaacagcccaaatgtaacctttgctcctcctggagggcactcactgcatgcccagtgttcagtttgttagtctggttcatggaatcctcccagcagccctctgcagaggtgtttgggttaaagtcccttcaacagatattggtgggtggctccaaggctgcaaaacccccacggccagtcctgccctctgcgccctgacagtatccccgccatgccctgccctgtgtggttctgaagaaatcccccagtgacctgaattccatgaagccgggtgtatggctgggggtggatcagtcaagagtttggtcctggaatgatcgggtggcactttgtaatttcacttcaatttcagagtaaccactgagtctccccgctttgccttgcctttcagtgggaagttggtgtctccaaagtggaagaatttcaagggcctgaagctacagtggagagacaagatccggctcaataatgccatctggcgggcctggtacatgcagtgtaagtgccgcccagcctgggcgccggtggtggtcagaacttcacggcctggaggcctgggcacccagggaccagagtctgctcctgggacctggtgtttctaacagaagttcagtctgtgcagacaggaaacccaagccatcaggcccagcagaggggtggcatctgaagagtcagggagcaggtctaggaagactcaggcatgggccttctctctccagcccgagtgtcatggacccggtagcttctccgggagatgagtgtgctagggcaggcttgtgttgggctggtctttctctgagaagccacactgcctctctgactgaggcgttcgttattgacagattcctctcctttcacctggactcctttatttccctgaaatctccttttcctagggaaggagaaggaaaggatacctgggaatgtggtctgccctatgggaggggtgcagcagacaggctggggctccctcaggggtctggatcatggtgctgactctcaccctctctctgctcagatctggagaagcgcaagaatcctgtgtgccactttgtgacacccctggacggctctgtggacgtagacgagcaccgccggccggaggtacttggcagtgaccaagggtggctgagagtggaaacataccagcacctcaccgggagtggctcaccgcgggctggtcctgcaggagaggctgccgagggtagtgcagggcctgccctacgccatccatgccctgggggccaggcctgggagctggtggcctctggcaaccccaggctgcagagcctcccccttctcagagggactggcccagggactgagggggttaatatctttctgttaatttttaaagtgtgtgtctatgtgtgattatacatgcacaggaagtgtctagaggaatatatagaagtgtctttattaagagacttcaggaacctctggggagtaggattagggctgccagatgagggggagatgctttcttcactgcatactcttctgtgtggctttaattttgtctaggcatgtctcactgttaacgataaagggggaatttagaaggtaagctaatgaaagacagttttgagacaggtataatctggtattagacagtatcaagggatatcattttgttgggtatggcaatattgtaatcagttctttttaacagaaaagcatctttgctgtcgaggacacacacacagtgtttgtaggtgaggtgatttgggccttgagatcagaaagtgaggcaaccccaggcattggggctccttatctctggagctcgaaggctgtcatgcaaggcatccacactggcatcacgcgaaggttggatgagaggcccctggagggcacattccatctgaaacttcctggaattggctgttcatttttgccctttgaatgtggcagaggctgtggggaaggggcatttatgggggggcttgggaattgctgcagcgttcccctgcttcttcctctgtggagcattctgctctcaccctgtcctcctggacagagcctcaggaccgtgcccccaaggcctttggctaccttaggtcttgaaatgacagcgcattgttagctagagggtctgctatagcatggaagaagtgggacgtaccttctgagtgatgtggtagccactgtggggtttcccgctggattgcctaaggcctgattgtagtgccggatactcagtacaccagttgagctttgctaatcaagcagagccccctcttcactctgctctctgtccctgtcctaggccatcaccacggaagggaagtactggaagagccgcatcgagattgtgatccgggagtatcacaagtggagaacctacttcaagaaaagggtatctggctggagtgttcaggcagcccgcctagggagggagtgggcagagtccctggttcagggccctggccgaggcggtaggctccacagccgccccacctgaacgtggagcgtcaagcagtaaatctggggcccagcgtgccagactagcctgggcaatggcctgcctcggtcaggttgtctttgctctcagtttccccatctgtgcactgggtggaagtctcctttgtgcaggcatcggcctggggatggtgtgagcaggacccctacctgcctccctgagatttctgtatattctagagcccttgggccctcctagggccattggtgaccgccgtgtcctgtccctttgcccacagctacagcagcacaaggatgaggacctctccagcctggtccaggtgggtgagcctgggagctctgaggacccccacttgacatgagacagcagggacttcggtggcccaccagggagccctgcaaaaggcggcaggccatgggccctccctggagtctcaggaatggctcaagaagcagtccagctctctctcctgggtgggctggagggagccgctctccaaatgcctccaccctgctgcctcacttccacggagcacccctttgacgaatttccccaggtgacaggcgtgggaattcttcgtcccactgttactctttgatgcttcctcccctgtgttggtgttgtgttaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaataggtaacccaaaccagggccttgggctttgaacagccagccgcttccttctctgccaggccccctctgggccagggttccttcagggccatctctgagctgctgcacgtcacggttgggggcaggcagtaaggaagggaaggatggctggcctcatttgacatccaggccgcacgtaccgagtgggtggggtctgcagagtgggcccactgggcagctgccattcccgtagtgccatggtgggaggacagctgcagggtctagtctgagtcattggcacatttcagataccgttctcttcacggggtacgtgtgccgtgcctaagccgaggcggccgggccatgactcatgctaaagaaaatcagaagcactcccgggtgtgaccgctcaccttggtggcattcagtcttccagttaacctctcagggaagagcccaaagattgaaaattagaacagtgttcggggaggtctctgttctctcttgagctctttacagcttcctggggtgtccattccctgatactcaattttaccttcctggcaaaaacttactttcctgccttttgagggtgcggaatggccacaaaccctgagaaggtagaaatcccagccagctccttggaagactctgggatgtgagcagggccaggaagttctgttccaggccttttttacgttcctgcaacattgtctgagaagacaaaatggttcctctctctgtgattcttgcagcacatctgggaaatgcagacatgatccagccgggactgattcctttgcagcctaacctggacttcatggacacctttgagcctttccagggtgaggaccagaggcagagagagcacggttgcctccatctcccccagcccagcacagagcagatcgctgccttcctttaagaggcgagacttggtagaatgggcaagggggcgagcaaagaatttttttttaaactgaactgttttttgtagtaactgcaaggtctgggaagtttttctgggacattgttcagcaaggaaattggctctggatttagccgtgactgtaagcagttctccctcgaagcagcagagggcactgatgacacagccagctccctaccaaggccctgcagttagatgggtccttgagcacctgccattgtgacagcagcagaaacgtcaggcctgggagtgtttcagagcccaggatagttgccaacatgtgtggttccaaccagagccccctttctacagaaaaaaaggtgtctcagggtaataccctctgtccatggcatccccctgggccatgtggggtttaggggtttagtccttgatttgtttgagtctttttttttttttttttttttttttagagacagggtcttgcactgtcacccaggctagagtgcagtggttcaatcatggttcactgcagccctgaactcctgggctcaagcgatcctcccacctcagcctcctgagtacctgggactacaggcacacaccaccacacccagttcatttcttcatttttttgtaaagacgggggtctgctatgttgcccaggtgatcctcctgcctctgcttcccaaagtgctgggattacaggtgtaagccatcacacccagcctgttttagtctttgttattttgagacagagccttgctctgtagcccacgctggagtgcagtggcaagaacacggctcactgcaccctcaacctccctcctggacttaagcgatccttccgcttcagcctcctgtgtagttgggaccactggtggcaccaaccaggcatggtggttgtggttggcacctttttttttttttttttttttttttttttgagacgggaatctcgctctgtcatcaggctggagtgcagtggtgcgatcttagctcactgcaacccctgcctcctgggttcaagccattctcctgcctcagcctcctgagtagctgggactacaggcatgtgccactacacccagctaatttttgtatttttagtagagatggagtttcaccatgttagccaggatggtcttgatctcttgacctcatgatctgcctacctcggcctcccaaagtgctgggattacaggcatgagccaccgtgcctggccctgtttgagtcttgattccagcaaatgctgggcacactgagctcagaagacccctgctgttgtttttcagacctcttctcttctagccgctccatttttggctccatgctacctgcatctgcctcagcacctgtaccagatcccaacaacccacctgcacaggtagaggaagctgggggatgggtgggggaaggggctggcaggcacagggctgctcatcaaaggtttgctgccagagcaaggctaatggcatagccacacagtcaccagcaaagcgccaagcagtgctagaccagcactaatgtgcagaggcacgattccatccctcttttacagcatccttcagcacccatggggtgggagactcttggtccaggtgtgcttctgcctgagtgccaggtaacctatgtgcagctagctctgctccgactaattaacacagaattagctagacagagaagaaaaacatggattactaataaaaataacttctgtatatttctttcacgttttactaagcaatccaaaaagttgcttacaggtgcttggggctacagagctgagtgaggtaccattctttgtccttacggagccctcatgcttatgcccatgaccagttagacactggtaacctggcaccatcttcaaacgggctccgggaagaattgctactgcagagactgggatctgaaccattgattcctcgtagcttttcttatttaggaagaggtggcctgatgaccagttgacacgtgaaattgtcctcggggattcccgagcagctgcaatccaggctgcctctgctcagtaatagaagatggcagagactttggggagactctgctggactccagaaacaagatattcccaggctgctagccagctgtgtgagggccgttgccttatctgagctctgagttatttagtttttaatggaaacaagacccccgcagacacgcagggaaacacaaatccctatcagatcagcagccatggacgtggagacgtggcctttgtccctctgtcccagcgcccggcctgtgtagttggacttggcagtgtgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccaggtgagccaggcggggagactcagtgcggggctccccccgacccagagggatgttttcccatcccaaaggctttcaaacttgtgaccaccaccaccaccctggtgtgcacgtgcatgcgcacacacatacacttaaatgaaacaaaagtgtcatgaaataatacatggccatgatctagtccgttttctatgctctatcttttttgtttttttgtttggtttttttttttttgagacagtctctgttgcccaggctggagtgcagtggcataatctcggctcactgcaaccgccccctcccgggttcaagcgattctccttcgtcagcctcccgagtagttgggattacaggtgtgcgccactatactcggctaatttttgtttgtttgtttgttttttgagatggagtctcactctgtcgcctagctggagtgcagtggtgtgatctcggctcactgcaacctccgcctcctgggttcaagtgattctcctgcctcagcctcccgagttagctgggattacaggcgcccatcactacacccagctaattttttgtatttttagtagagatggggtttcaccatgttggccaggctggtctcgaactcctgatctcaggcgatctgcccaccttggcctcccaaagtgctgggattacaggtgtgagcccccacacccagtctctattctcttttttttttttttgagacggagtttcactgttattgcccaggctggagtgagatgacatgatcttggctcactgcaacctctgcctcccgggttcaagtgattctcctgcctcatcctcctgagtagctgagattacaggcatgtgccaccacacctggctaattttgtatcttcagtagagatggggtttcaccacattggccaggctggtctcgaactcctgacctctggtgatccacctgcctcggcctcccaaggtgctgggattacagatgtgagccattgcacccagcctctctatcttttttttaaagttagtcacaacctacagtgtgaaaacatggtcctggccatctctttcctgggtctataacatgtctccttcaagaagtcacacaaatggttttaggtgccttggtggctttgtcttcctgtcccctggggttgagaacaagctgtctcactggcagagaggcagcctctgcagggtgggccaggccctgtggcccagggctgcacctgaacatcctccttatcctggcagctgccttttcaggccaaccacaagcggtgatcatgacgtcagggcctctgaagagagaagggatgttggcctccaccgtgtcccagtccaacgtggtcattgcgcctgctgccatcgccagggtgaggagggccctaggcagacctgcagtgtccttctcaccccggagcactctgatcttgggcggccctcacctgagacgactggtgtgccgccctgctgtatatcagcagtcaggggtgacctgtctcccatgtcactgcaggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtgagtgttcactcggcgggatggttggggcatcgcaagggaagtaactgggcctgccgtagaccatggggggtgcttgctgggtccccaggacggagcctgggcttaggacacacagtgaggtcttgtaggcctgctgataacacagtctgggaacacgctctgtgggtggcaggatgaaatgtggtggcactggcagggcaaaaagtagtgaacatgtggcagtgtaggtgacccgtgtgctcggggagtccctgctgactgcccacgaaggcctggtactgagctgctgatctcacccagagaagggattgaggagccctgggcttcctgtctctgggagcatcagcctggggttgctgtggccacagaagccgtccagcctcatctgggcaccaacgtggccttccccagcaggtctcagcactacaggtctgtggcccatgtccactcttaggccatccaggggcaagatagtcagagcaggactgattttgcccagggacatctgaggagccaacaggccagatcagggacaaatggtgtgcccgaggctgtgctgctggtagagggtgtgggcagatggggccccttccctcaaatgcctgccataccaggaagggaaatggaaatggcctcttttcttaaataaatgcatggtgtaggccaggcgcagtggctcatgcctgtacgcccagcactttgggaggctaaggcaggtggatcacttgaggtcaggagttcgagaccagcccagccaacatggtgaaaccttgtccctatcaaaaaatgcaaaaaaaaaaaaaaaaaaaaaaagcagggcttagtggcatgcacctgtagtcccagctactcaggagaccgagatgggagaatcacttgaatccaggaggtggaggttgaagtgagctgagatcgagtcactgcactccagcctgggtgacagagcgagactcaatctcaaacaaacaaaggcatggtgtagctgctcctggaactctgagcaaacagttgtctccctcttccctcaggaagacgcgaatgagggagggtctctgacttagtgggctcagccagcaggggccttttccaaggacaggctttggagagtaaggactcttcagtctggaaagatagaaacaagagagttgggagtcaggcccctcaaataatcgagggagaggttagggccaaccattgccttggtctccggagtctcagaacacagaacttagagcctgctgcacagcctcacggggagtttggggaaaataatccagcagagaggaaaggaagcggaggcatttgttacagtaaagcagaatgggccgagaaggccgagtccacctgggactgagcacggtcactcactcctctaatcctagcactttgggaggcagaggcaggtggatcgcttgagcccaggagattgagaccagcctagacaatatagtgagaccttggctctataaaaaatgttttttaattaaaaaatataataataataaagagcccacctgcgaaatatctcgtaaagcgacaccagtgactggaacacgtcacacagggttgctccatcgtgttctgtgtggattaagggtgtttttgttgttgttattaatttaagattttcagggagtgaataagaataatctaaggaagcatgtgtgtgcagttgaaagaaccaagtgcaatacgtggctagcagcgagcacctcataaccctgcagagaccccaggctgcctcctggtggcgttgaggggccaggcctccgcccctcagaggagtctgttcttaccaggtcgggactgcccaaactcagggcaggcctctccgtgtgcatcggagcagagccccagtcctcaatctccccagaacaactgctcagggaaatccgaccccaaaaatgtggctgcactaaaggtaccgcatgtctcctcttggttcccttgggaggaggggagaggagtgcaggacatcaaggatctgtgtcttgtctggaacggagacctcagacccagccagagctgcccaggcaggggtggatcagaaatgggcttctccttgccccatgccacgaaccagccctgtggggatggtgggccccctggaggcttttgggtgagccccaagcctgggagccaacgctgagtccacgtagtgtgcaggtactgctcaggctgcccgcatcagttgcaggaggggtgtggccaccaccagagctgtgctgtggggaggaggcagggctgggtggggaaggcggagcttgcagcacctgggatgcaccggttcagccctgccgttcccagccccagctgtgcaccattctgcagagcgggttttctgtggttcccagtcttgtccctccggctcctcattggagccttcagcttctcgtcgtgccctcctcccacgtagctctctagccctggcccttgggcacccaggatcagcgtagggggtgaggaagggtggacagtgtgcctgcaatgtgcctgtcttagtgaccagcgggttctccagcagaaccggcagatgaagcacatctcagctgagcagaaaaggcgcttcaacatcaagatgtgcttcgacatgctcaacagcctcatctccaacaattccaagctggtgagttgccaagagcgtgggctgtggcagggcaggggagctggcaggacgtgctccctgcgtggtcattgctggtggcaggcctgctggctgtgggtgctgcctccagccacctgccccttctgcagaccagtcacgccatcacactgcagaagactgtggagtacatcaccaagctgcagcaggagagaggccagatgcaggaggaggcccggcggctgcgggaggagatcgaggagctcaatgccaccatcatgtgagcttctgggccttggggctccaaccaggcaccccatcccgatgcagggcctgcctcagaggtggtgggaccctgtggcctcatcactggtcagtgcctctttgctgcagtagttctgctctttgtcaacctccttccacagacctctcttctctgtgcctggctgtggcccggcactgggccagccctgccatcttttgtcccagggtccttattggccactggctgctccacagctcccacggctcctgtcatttcagctcctgccagcagctgctccctgccacgggagtccccgttacccggcgccagtttgatcacatgaaagacatgtttgacgaatacgtgaaaacccggaccttgcagaattggaagttctggattgtatctttgggttttctttttgctcttcccggccctcagccaatgcactgaagccacagaccgtggcactgtagttactttagaaagactctttaaatgcctgtcaccaagctcctcacgacaggcagtgctagtgtctatctcgggagagagtggtccggcctggcctgctgtgtgggctggaggtgctgatggggcttcagggtgctttgcaggaagggctagggaggtagaacggtgggcttcgctctctaggtccttaagaaatcaggacaatgctagagccacttgcagaaggtgcaggggaaggaggcatggttccacacagcctggcagccagctcggtcctcgaagccacagggagggtgagtgccacccctgctgtgacaggcggaaaccaggactccctccactgagtggtagagcccaatttgaagcctaatggagcatgtccacctctaggggctctcgtgccaaggccaccttgcactcagccttccaggtggcagcacggctctcacggggagtggttcccgcctggtcactccccaccctgccaccgctctgcctctgagtaaacggtcggcacatgtgttgggttgaccgtggcattggggcaagggtctgacagtcagaggtgacggtcgtgcaggaggagagaatcccagctgcagctatcgggcagggcagggcgcagcacctgtgtgtgctggaagggacagagtgtttttgtttgtttcttttttccccctgagacagggtctcactctgtcacccaggctggagtgcagtggtacaatcacagttcactgcagcctccaccttcccagactcaagtgttcctcctgcctcagcctcctgagtggctggaactacaggctcatgccaccacgcccggctaatttttgtatttttaatggagatggggtttcaccattttggccaggctggccccaaactcctgacctcaggtgatccccctgccttggcctcccaaagtgctgggattacaggcgtgagccaccgtgcccggccataagaggcagtttttaattgaagagatgacaggcaccagctctgattcctctgtgttgctgttttactgcctgccctggtcctgatccctgtcattaatagagctgggtggcgtctggaatgaatcagagcttctttgatgaaatggcatactccccatcatcaggccgaggtggaggaactgtgagtgccgtcctgatcaaagtccgaggggaaacatgcctcaggccttcactaagatggtctaggagactggcatgcacttttgcatttaacacagaaggcaaacgccactttcaggcagatggctcctgcctttatttatttatttatttattttgagaacagagtcttgctctgtcacccaggctggagtgcagtggtgcaatctcggctcactgcagcctccgcctcccgggttcaagcgattctcctgcctcagcctcccaagtagctgggattataggcacccaccaccacgcccagctaatttttgtattagtagagatggggtttcaccatgttggccaggctggtctcaaactcctgacctcaagtgattcacccacctcagccccccaaagtgctgggattatagacgtgagccaccgcgcccggctggcttctgcctttccacctgctctgtgcctttgatgttcctggcactgtatgtaagaacgattttgatcgcatgtttgtgctaggacctgttccagactagagaccttctgtgtccctgtcccctgcctgctcggtgcttgagcggccctgttgtccaggtacagttagagcagagtgttttcatgaagtggaagacacaccttgcctagagatctctccctcttttccccagtgatccattctctgtgggcagatactttccagccccaggggaaaggagtacgccagtccaaccaccttcgggtctgcagtccccagcccctctccgtgcttgccttttctttaaccacacactgcagttcagcatcatcatcaagccgctgtttgagtcgttcaagggcatggtgtccaccagcagcctggaggagctgcaccggacggcgctctcctggctggaccagcactgctccctgcccatcctcaggccgagtgagtggggcagtgccagggtggggggcttcatgctagtcctggagggaggacagccccaggctgaggacagtattagccagactccactgcaggcagccaggtggggccggggcaggggcacagtgctgtccaggaggtcctcagtcaggagcgcccagtgggggcaggaggctcctgcccttttgtgtctcccagcttgttcagacccagcttgcatggatctagtgccaactatttgccaggccctgtatcaggtgccttcaggtgtgttttcttgtttaattcttataacaacaagcaaagattatcccatatgttaaggttatagaagcttaatatcagaacagctggcagccccatggcaccaggaacagcataggatgctccacctacggcagctcctggatttggggaggcttctggaggcagaggggtgagtgcccaggtctcggtgtcggcccctggcactcctccctgcagtccagcatggctgctgctcgccccgtgcctgagcattcccacatgggttgtaggtacaaagccgagtgtgcggtgtgtggtgggtctgtgtcactgcctgtgtctgaccctttctgtcttgcagtggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaaaaaaaaaaaatttagccgtgtgtagcagtgagtgcctgtggtcccagctacttgggcctgaggctggaggattgcttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccatttcccgcccatgggccctgaccacactcccttttctagaagtcaatcctaaggtttctctgctctggctaagaggatgtaaatttggattcttagagggcatggcacccccagtccctgcccagataaagtagcacagtggcaggcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgtgcacgcgcgcgtgtgcgtgttgacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagcctgtgatgtgtggccttaaatactatcctgttgcagcagtggaagagatgggaaaatgaagagatctgagcatagcgatgcccttggccagctcactccttctaacctcgggaggtgtgataagcctgggatggaggcattgggtggggaagaggcccagggtgggagggcgattctagaggtgtgtccagaaagtcggtgctcctcttctaaagacaggcctccccacaaaggctgatgagaaaggcccagtgtggcgggttctgcctgtggcctcagcaggggctagtgaggcaggccactgctccaggccgcacccagatggacagaactcactggtgcccctataaacctcccgtttcctcatccgggacttgggcaaagagcaccaggcctgcacgcttgacagtttcacgtgaaatcacatgtgtccaagtgttcagtagcccgtggagctctgtgcttagagagtgcagtcatcagcacagccagcactggcccagctctgcaagatcctcagtcacagtgggagcctccaggcactgtggttcccctcctcgttattgacccaataccagagatgggaaagactagaaagctggccagtagaactgttcctttgttcaggtgctgagaaggtttggctcatcttcgtttaatgtagcagcttttctctgtcgttttcctgggccccgcgcccacccatctggcgccctgtgcctggacagggtgacccagcgagaagacacagccccgcacagagccatggggttgcttcaccagatgactgcccagatctggatctcgatgtagaatgcagtgggttgatacacaagctcttgtctgatcaaacccccatacctcccccgaggagacacaaagcaagcctgggccttgagagccgggggtcctagagggaaaggtgagcgcctcacagactcctttgggctggaaggaactcggtttccactgagctcagcagcaggggtctgtgttaatgttttgagcgcagctccatacctacctgggatcctaaaagatggtaggggcatgattggaggagaaagcagagtttggatgggttggggagggagtagcagcgacaggagcaggacaggagcaggatccagagggagcgaggccggtgccctggagtcctattccttgatgttcactgggccctgctcaggcttaacatttccggctgctgcaggggcacgtacagctctgcacatttctcaaggtggtggcgtggttaattccattacagacaaaccggagtcatgtccgaggtagcgaggctacatgggtcagagaagcctaaccgggcttttccctcttgtaagtggcctcaccatccaccactcacccaagcccaaatccagagaattatccctgatgtccttcctctcccctcccaataccaagtcctgccaagtttctcttctcagtttcttctaaatacacatccgcttctctccatccctgctgccatcacccccatccaagtcacgtcattgcccaagcagctcaagtagtggcctcatccatcctccacatcatagcacgagctttaaaaagcccaagtctagccaggtcactcttctcttcagtccttccagcgctttccagataaaggcccaggccctcagggaagcccctcccctgctttctttgctgtttttttcgttttctgaacacaccaggtttggtttggttttgctgtttacagttttcccaaggtctgtctcctctgtcccagcccttccccatctccactcttttccttcaggtctttccttaaacatcagatcctcagaaaccagccttcatattccctccccaccacacaggtgcacgcacacatggagtcgggcctcggagcggctctcaggacaccgatcatgttgaattactcagtttctcttccccaccagattctgagcccaccaggacgagggcctggtgccgtacctcgcacagacctggcaggaagcagatatcgagacagcctgtggatgaactctcctggagcccatcctgctccagctgcctctgcccacaccctgggactggtggggcaggggaggaaagggggatcagagggggtaggttgagcgacagtaggcgttgactctgaagactgcgtaggtaatttcaaaacttcaacttgagtaattgtagctataagactaatctctaaatggtgtgaaaagcatttcatcttgatgtggactcgattctgtagaacatggtttcccttattttcggtaaagatctgaaattagatttgtatagggtggtgtgattgaacttatcctgaagtttaatgcatgtactttctacctttttagttcagaaaatcttcagtacacagaagtggagaatagtataatgagccccttcatcataatgaatgaccactatccagtttaacaatgatcaactcagggccaattttgtttttttctaagacctcacgcccacctccattattttgaagcacattccagacaccatatggatttcatctgttaagtatgccttttttttttctttttgagacagggtctcactctgttgcccaggctggagtgcaatggtgcagtctcagctcactgtaacctctgccttcctgggttcaagcaattctcgtaccccctcctcccgagtagctgggactacaggtgcctgccaccaggctgggctaatttttatatttttagtagagacagaatttcaccatgttggccaggctgatcttgaactcctggcctcaagtgatccacccccacctcggccttccaaagtgctgggattacaggcatgagccacggcacccggccgtaagtatgctttttaataccatttccagaattgcatatatacctgcaaagttggtcatttaaaagttcccaaaggctttgtgaaaagcaacaaaatcacagttaatgagaaatctggggaatggggcattctgattgatcagattttctgtttcactgaaaatcgttagctagaaaacccttattgtgtagaggggggaaaagctttttaagataagagtctactttcctgccttaatgggcttggtacagtgagcagtctaatctcttcatctagtctgactgattttctctcctgggggaagtactgaacagagctggttggttgcattacaattttgcattgggggtggagcctgaatgatcaggggttagcggtcctccccaacttgccccccacacctgtcccatagccctgactccaacgtgttggtgtctcccaagttcccagcgccacccatcagtggactataatgatgctgtgtcaactctcctgtatgtactgagatctgtgtttctctagtttctgtccctcctttccctaatacttgctgtgtatttaccgactcttcctttttattctctgaccaagatgtgggtactggctaggtgcggcggctcacgcctataatcccagcactttgggaggccaaggcgggcggaccacttgaggtcaggagtttgagaccagcctggccaacatggtgaaaccccatctctacaaaaaatacaaaaaattagccgggtgtggtggcgggcacctgtagtcccagctactcaggaagctgaggcaggagaatcgcttgaacccgggaagcggaggttgcagtgacccgagattgagccactgcattccagcctgggcgacagagcgagactccatctcaaaaaaaaaaaaaaaaaaaaaaaccacccacaaattagccaggcatggtgacgcacatttaataatcccagctacttgggaggctggggtgggaggatcgcttgaacacaggaggcagaggttgcaatgagccaagattgtgccattgcactccagcctgggcaacagagcgagattccatttaaaaaaaaaaaaaaagggccgggcaccgtggctccacctataatctcagcactttgggaggctgaggcgggtggatcacctgaggtcaggagttcgagaccagactggccaacatggcgaaagctcatctctactaaaaatacaaaaaattgctgggcacggtggctcacgcctgtaatcccagcactttgagaggccgaggtgggtggctcacctgaggtcaggagttcaagaccagcttgaccaacatggagaaaccccatctctactaaaaatacaaaatttgccagggtggtggtgcatgcctgtaatcccagctacttgggaggctgaggcaggagaatcgcttgaacccgggagacggaggttgcagtgagccaagatcacgccattgcactctagcctgggcaaaaggtgtgaaactccaactcaaaaaaaaaaaaaaaaaaaaaaagtagctgagcatggtggcaggtgcctgtaatcccagctacttagggtgctgaggcagcagaattgcttgaaactagaggcagagctcgcagtgagccaagatcatgccattgcactccagtctgggtgtcagagcgagactctgcctcaaaaaaaaaaaccaaatgtgtgtactgaaggttgtattttaatgagactcagagaatacaacagtgactttattgcaaatacaataaaatctttgttgatacctgtgataggttgtggtatttggcttctgagccaggactgagctggatgagcagagatggaccagcaaaggggttggggccagggcgaggaggcagaagcgacctcccatgcagagccctttagggaagggcaaacttcacagaaacagtggccaaatctcacatctgcagaggttttgtcttttcctggacattccctttgctgccccctggggctttctcttgtcagttatctcttctgtcccttgcatttttctcctttttcattgactcattcctctctattcacaagttttctctttctcaagtccctctacctctaactaaccttactttccatctctgtgcccaaaacttgctcatctgcaaacactctgcatcctgataaatggcattgacgtctccccaaatgttccagccagaaactcagacttcaccctagcctcttcctttccctctcttcccacgttcagcctattagcaagtctcgccaataacacctccaaaatacagacggccctgacttaggattctttttttttttttgagacagagtctcactctgtagcccaggctgtagtgcagtggcgttatcttagctcactgcaacctccacctcctgggttcaagcgattctcctgcctcagccttcctagtagctgggactacaggtgtacaggtgcccacctccatgcccggctaaattttgtatttttagtagagatggggtttcaccatattggccagactggtcttgaattcctgacctcaaatgatccacccgccttggcctcccaaagtcctaggattacaggcgtgagccaccacacccggcgatttaggattttttgactttaggatggtgtaaaagcaatacgcactcagtagaaactgtacttaagatgttgaattttgatcttcttccaggctagtgacgtgccgtatgatctcttcgtggtgctgggcagtggcagtgagctgaatgaaggcagacagccaacactcctgcatcctgggctgccaggcacttttgcccaactgtaggctgctgtgagtgttccgagcccttttaaggcaggctgggctgagctatgatgttcaggaggttaggtgtattaaatgcattttttacttaacattttcagcttacagtgggtttattgggacgtgaccccattgtaagtccatgagcatctgtaatcacagacccagccacctctccccattcccactgccatgacaataaccctcttgcctggacaatttgaatattcatgttgttgttgttgttgatgttgttttgagacacagtttcactttgtcacccaggctgcagtgcagtggcgcaatcttggctcacagcaacctccacctcccgagttcaagcgattctcatgcctcaccctcctgagtatctgggattacaggtctacgccaccgcgcctggctaatttttgtattattagtagagatggggttttgccatgttggccaggctggtcttgaactcctgacgtcaagtgataagcccactttggcctcccaaagtgctaggattacagaagtcggccaccccgcctggcccatgttttgcctcttgctgctttcagtcaattctctattcagctggaatggtgtttttaaaagatgctgcttcaacttccaggggcttcccattacatttagaatgaaatccaaagtcatcattgtgaagtgctattagtcccacgagatttgggtcctgagtgactgcctgggtgacagctgtcctgtgcctagaagtcttcttctatgaagtgtggataataatcacacctcgaatttgctgattttgtagtcagcacgtataaaggcagccgcttttcttcctctttttctttttttttttgaatggagtctcactctgtcgccaggctggagtctagtggcatgatctcagctcactgcaacccccacctcccaggttcaagtgattctcctgcctcagcctcccaaatagctggtattacaggtgcacaccaccacacccagctaatttttgtatttttagtggagacagggtttcaccatgttggccaggatggtctcgatctcttgaccttgatcccaaagtgctgggattacaggtgtaagccaccgcgcctggcccagcagcaactttttttttttttttttttttgagatggagtcttgctctgtcgcccaggctggagtgcagtgacacgatcgcggatcactgcaagctctgcctccctagttcacgcgattctcttgcctcagcctcccaagtagctgggattacaggcgcatgccaccatgcctggctaattttttgtattttattggtagagactggctttcactgtgctggccaggctggtctccaactcctgacctcgtgatctgcccgcctcggccttccaaagtgctgggattacaggcatgagccaccatgcccggctgcaactttccttattcttcatctctgtttccccattcctgacaaaatgtctcagtttatatcaaggccaccacgaagactgtccagctcagtcagtaacaccctggcagcatttctgagttttcttttttcacggcagcctgcctgtcccttcccatttgtcacattttgggtggtgaattctttctccaaaatgttgctaactgtggtcccatcccatgctgtgcacacagctggtataagtcagaattcagttatctcctaacagaactctcccagcgctgatcaaaaaagatcaggaaacatcatcctgctttctaacacccatccctttttcttttttctttttttgtagagatgaggtcttcctatgttcctcaggctggtctcaaactcctgagctcaatcagcccacccacctcagcctctaaaagcactgggattacaggtgtgaaccaccacacctggcctttccccattcctttttcttttcttttcttttcttttttttctttttcttttttttttctttttgagacggagtcttgctctgttgcccaggctagagtgcagtggcacgatctcggctcactgcaacctccgtctcccgggttcaagctatttctggctaatttttgtatttttttagtagacagggtttcaccatgttgaccaggctggtcccaaactcctgacctcaagtgatccaccctcctcagcctcccaaagtgctaggattacaggtgggagccaccgcgcctggcttcttctctttttttttgagacggagtttcactcttgttgctcaggctggagtgcagtggcgcaatctcgactcactgcaacctctacctctagggttccagtgattctcctgcctcagcctcctgggtagctgggattacaggcacgagctactatgcccgtttaattatttttttttttttgtatttttagtggagacagggtttcaccatgttggccaggttggtctcgaactcctgacctcaggtgatccacctgcctcggccccccaaagtgctaggattacaggcataagccaccatgtccagctcccattcctgtttcaaaactctgcctccctcctctcctgccctcagcaggagcacttcagtttataagtcttctaggagaagtccccccacccccgtccattgcttgcattcagtgcaacggtaacttcaatcccattgcttcccgattacgattaggattacgcagcccaggtcccagcaagaggagctctctgtggctactcaaccgcaccccacacttcttccctctgtgctgccgtgcattcccctccctggaaggcccagcgctctctctccgctgtggcctggcccagccctccctgctgtgcccccggaaccaccgccagtgctccatttctgctgctgatatcaagtgcggtgtagctgtcagtaccacattttatctctcctttttcaggacaaggaccacatctcattttatctgtcatctatcatagcacacagcttctatgtcccaggcacttggtaatctcgcaatgtaaatcacatctgccgctgcctgccagtgtgagccctaggaggtagatgctttataatacccatgttagagataaggaaattgaggcttacagggttatatcagatatgccccaggcgtgagccactgcacccggccttatgttatcccattttcaacttcaaaaaactctccctatagagattgttgtcctcattttacacatgagaaaacaggtttacctttcaacataagaacatttaacaaaccaggagtagatggagtagaacttccccagcctgatgaagagcatctacaaaaagtccacagctaacatcatgtttaatgtgagagactgatgcttgcccctaagatcaggaacaagaagtggatatctgctccttccccgtcaatattgtcaatatcagtattgtcctggaggttctggttagggcaattgggcaaaacagagaaatataagacttggccaggcgcagtggctcacgcctataatcctagcactttgggaggccgaggtgggcagatcatttgagcccaggagttctagaccagactgggcaatagtgagacctcgtctctacaaaaaataaacaaaattagctgggtgtggtggtgcatgcctgttgtcccagctacttgggaggctgaggcaggagaatctattgaacccagaggcagagattacagtgagtcaagatcgcgccactgcactccagcctgggcaacgagcgaaactccatctcaaaaacaaacaaacaaacaaacaaaacacaaaaaagaggccgggcatagtggctcacacctgtaatcccaacactttgggacactaaggccggtggatcacctgaggtcgggagttcgagaccagtctggccaacatggtgaaaccctatctctacaaaaaaaaaaaaaaaggtaactgagtgtggcgatgggcatctgtaatcccagctactcagaaggctgaggcaggagaatcgcttgaaccagggaggcagaggttgcagtgagctgagatcgctccattacactccagcctgagtgacaagagctaaactctgtctcaaaaaaaaaaaaaagaagaagaaagaaaaagaaatacaaggctttcagattggaaaggaagaaaaaccatttgcagatgatacgatggtatgcgtagaaagtcctaaaggatgcacacaagccctttagagcgagtgaatgggatcagcaaggttgcaggacatgggatcagtatacaacaatcagctgtctttcttttttttttttttgagacggagtttcgctcttgtcgcccaggctggagtgcaatggcgcactctcggctcaccgcaatctccgcctcccaggttcaagcaattcttctgcctcagcctcccaagtagctgggactacaggcatgtaccaccacgccaggctaattttgtatttttagtagagacagggtttctccatgttgaggctggtcttgaactcccgacctcaggtaatccacccgccttggcctcccaaagtgctgggactacaggtgtgagccaccgcgcccggccaatcagctgtctttctgtacactggcaagaaatagcccaaaaatgaaattaagaaaacaatttcattttcaatagcatcaacgaagacaaaatacttaggaataaatttaaccaaggaggtgcactcagtatcatactgaaagttatacaacagtgttgaagaacattattcaaccatacaaaggaatgaaatactgttatgtactacaaagtggaagaccctcaaaaccattatgctgagtgagaggaggcagacacagaaggccacatgttgtgtggtcctatacaaatgaaatatccagggccaggcgtggtagctcacgcctgtaatcccagcactttgggaggccgaggtaggtggattgcttgagcccaggagtttgagaccagcctgggcaacttggcgaaaccctgtctctacaaaaaagtacaaaaattagctacaaaaaagtacaaaaattgtagtggcacacgcctgtagttccagctacttggaaggctgtgatgggaggatcacttgagcctgggaggtcaaggctaagattcagtgaaccatgattgcaccactgcactccatcctgggtgacagagtgagacctgtcccccgcccaaaaaaaattaaaattaaaattaaaaaaagagaaattgaccaggcacgatagctcatgcctgtaatctcagcactttgggagagtggatcacctgaggtcaggagcttgagatcagcctggccaacatagtgaaaccccatctctactaaaaattcaaaagttagccaagcgtggtggcaggcacctgtaatcccagctactcgagaggctgagacaggagaatcacttgaacccaggaaatggacgttgcagtgagctgagattgcgccactgcactccagcctgggcaatggagtgagactatctcaaaaaaaaaaaagtaggctggttgtggtggctcacgtctgtaatcccagcacttcgggaggccgaggcgggtggatcacaaggtcaggagatcaagatcatcctggttaacacggtggaaccccgtctctactaaaaatacaaaaaattagccgggcgttgtggcgggtgcctgtagtcccagctacttgggaggctgaggcaggagaatggcgtgaacccgtgaggcggagcttgtagtgagctgagatagcaccactgcactccagcctggggtgtgtgatccagagctggattaaaaaaaaaaaaaagaaagtaagaagtagtgttgaaatgtcagttaaggtatagagatattgaaaccctcatacatggctaatgggaatgtgaaatggtgcagccaccatggaaaacagccaggcatttcttccaaaagttaaaagtagagctaccatgtggcccagcaattccactcctgggtatatacccaaaataaatgaaaacagggatacttgcaggtaaatgttcgaagcagcagcattcacaaatggccaaatatagagacgacccaagtgtacttgaagtgatgaaagaataaacaaaatgtgatctacccacacaatggactgttactcagccgtcagaaggaatgacgtgctgacacacgctgcaacatggatgaaccttgaaaaagggaagaagtcagacataagaggacaaatactatatgattctcttcatgggaaattgtggagtaggctgggcacggtggctcacacttgtaatcctagcacttcgggaggctaagatgggcagatcacctgaggtcaggcatttgagaccagctggccaacatgctgagaccctgtctctactaaaaatagaaaaattagccaggcgtggaggtgggcccctgtaatcctagctactcgggaggctgaggcagaagagtcgcttgaacctgggaggcagaggttgcagtgagctaagatcccgccattgcacacccccctgggcgacagagcaaaactgtctcaaaaaaaaaaaaaaaaaattgtggaacaggcaaatccatcgagacagaaagtagattagtggtttccagacactggggagactgaaagcaagtgggtagtgactactaatggggagataagaatgttctggaattatatagtgacgataggtgcacaactctgtgaatacacacacacacacactgctaaactgtataattgtttaattgtaacttttagagatgaagttgtttgtctaaggttatgtcacatatagtaagtaaaggaccagaaactgaatccaagaatagctgctcttagcactaatgctgttgggggaaaatgtttccagggccattgaataggaaattaataacgttgggatcttgaagagcctcagaattgtcattctaagtattccttctcactataaagtactgtcattttgggtagtgcgtaaaagggctgagagaaataatattgcattggttttactgcaaaattggttctacaaggagtcacgccaggggactgctttgtccattcagcggggagatccgaagagcagataaagagctggggacagtggagctgagcctggtgtcagagatggttgagaagaaacaccaatgtcacaaacccactgctacagtaagacacctgggggtgctaaagtcttttcttaccttattaccaacacttggaaaagccttcacacctctccatttctcaccttctctccaagtgctatttcttttttaaaacttgaaatcatgtttatttgactgatttctaaaataatacatactaactttagaaaatttggaaaatacattaaaatataaagaaaattcttggccaggcatggttgctcatgcctgtaatcccagcactttgggagaccgaggtgggtggatcacctgagatcaggagtttgagaccagcctggccaacaaggtgaaaccccatcgctactaaaaatacaaaaattagcctggtgtggtcgtgggcacctgtaatccccgctactcaggaggctgaagcaggagaatcgcttgagcccaggaggcggagattgcagtgggctgagatcgcaccactgagatcaaaaagaaaaaacaaaaaaagaaaaattctccccctgcccaaagatttttttttttttttgccagtcttgctttctgtctatatgtaagataggtggacacacacacacacacagacactttattttaaacttatattttaggttcaggggtacatgtgaaggtttgttacatagcaacatggtatggttaggctttatgtccccacccaaatctcatctggaattgtaatccccacgtgtctagcgagaagccaggtggaggtgattggatcacgggggcagttttccccatgctgttctcgtgataatgagtgagttctctctgatggttttataagggggcgcttcttcctttgctcaccactctctctcgcctgcggccatgtaagaagtgtctcttccgcttctgtcatggttgtaaattttctgaggcctccccagccctgcaaaactgtgagtcaattaaacctcttttctttataaaatagcaagtctcggatatgccttttttttttttttttttttggagatggagtctcgctgtctctcccagtctggactgcagtggcacgatctcagctcactgcaagctccgcctcccgggttcacgccattctcctgcctcagcctcccgagtagctgggactacaggcgcccgccaccacgcccagctaattttttgtatttttagtagagatggggcttcaccatgttagccaagatggtctcaatctcctgaccttgtgatccacctgcctcggcctcccaaagtgctgggattacaggtgtgagccactgtgcctggccccaggtatgtctttatagcagtatgaaaatgaactgccaggcgtggtggctcatgcctgtaacctcagcactttgggaggccaaggtgggtggatcacctgaggtcgggagttcaagaccagcctgaccaacatggagaaaccctgtctctactaaaaatataaaattagccgggcgtggcagcacatgtaatcccagctacttgggaggctgaggcaggagaatcacttgaacccgggaggcagaggttgcggtgagctgagatggcgccactgcactccagcctgggtgacaagagcgaaactctgtctcaaaaaaagaaaatgaacaagtaaacttgtgtcatgggggtttatttatacagattatttcatcactcaggtattaagcctagtacccaacagttatcttctctgcctgttcctctccctcttcccccccaccctcctgcccgcctccaccctccccctccagtaaaccccagtgtctgttgtttccttctttgtggtcatcggttctcatcatctagctcccacttataagtgagaacgtgtggtatttcgttttctgttcttgcgttagtttgctgaggatgatggcctccaactccatccgtgttcccccaacagacatattttttaactcaatgggggatcgtcataaatatattttataacctgcttttataaattaacgtcatacttgaagcattttaccctgccagtaaacattctttgataaaatgactttgagcggccactgtttgttcattgccttattttcagtcatcggggttgtatagcagccgtgaaagtgtgcccctcagatttcccactctgggaagtataattgacccagggcccccagctgctgtgcccggaaatccatcacccagcacatggagaccccgcttcccgcaggcttctcccatctagagacagcatggcagggatgctgaggctggctcgttcctgggagacccaggcttctcttaggattttcccacattcgtgctgaagtctcccaggatggcaccgtaggctgagacgctgcccccaacctcctttccttccttcatcctgtcctccagcaagagtcagacctgcctgtggtgggacagctccctgaatcccctgctccctcctcttttccctcccaggcctggctctgatgaatctctttatttatttagtattttttcaagacagagtctcactctgtcacccaggctggagtgcagtggcgccatctctgctcactgcaacctctgcctcccaggttcaagcgattctcctgcctcagcctcccgagtagctgggattacaggtgcccgccaccacgcccggctaatttttatatttttagtagagacggggtttcaccatgttggccagcctggtgttgaactcctgacctcaggtgattctcccacttccacctcccaaagtgttgggattacaggcataagccaccacgcctggccttgatgaatgtcttgcatggcaaagaatcccatcttggtccctgcttctagaggacctggactgacacaggtcatctccacttcggtttgcttgtttggttttggtgttaccctcaatgctattatgagcatgtaagtgtgcatatcccatccaaatctaggattattgccttaggaaattatgtgaggcaggaattccaggagagggttactgggtggagaccgaatccctgtgtaaggctctgatgcgtgtttcagaagtggctgagtgggcctttctcaccctcaggctttctcacttgtaaagctctgctgatgtgaaggcataagaaacctcctgtttatttgcctttcttggttacttgtgaggttgagcagtttcacatttactgcctatttaatttctggctttatatgtaagcatttcttttttgttgttgttttttgtttgtttgtttgttttgttttgttttgagatggagtcttgctctgtcgtccaggctggagtgcagtggcgtgatctcagcacactgcaacctccacctcccaggttcaaatgattctcatgcctcagcctcccgagcagctgggattacaggcgtgcaccaccactcccgcccaagcttttcttttgtttttctctcccttctcctccttcttttctcatttgtctctctttatctgatcacctcttctatttgctttgtctcttttttttttttttttttttttttttgagacagagtctcactctgtcacccaggctggagtgcaatggtgtgatctcggctcactgcagcctccactacctgggttcaagtgattcgtttgcctcagcctcccaagtagctgggattacaggtacccgctgccatgcccagctaatttttgtatttttagtagagacggggtttcaccatgttggccaggatggtcttgatctcctgacctcgtgatccacccgcctcggcctcccaaagtgctgggattacaggcatgagccactgcgctcggcctttttttaatttttgtttttttgagacagagtcctgctcagtcacccaggctggagtgtagtggcacgatctctcctgactgcaacctccgcctcccgggctcaagccattctcctgcttcagcctcccaagtagctgggattacaggtgcctgccaccatgcccggctaatttttgtatttttattagagacggagtttcaccatgttggccaggttggtcttgaacccctgaccttgtgatccgccgcctcggcctcctaaagtgctaggatattacaggagtgagtcaccatgcctgacgtttttttttttttttgagtcgggttttgctcagtcgcccaggctggagtgcaatggcacgatctcggctcacgcaacctccacctcctggattcaagtgattctcctgcctcagcctcctgagtagctggggttacaggtacataccatcaagcctggctaatttttgtatttttagtagagacagggtttcaccatgttgaccaggctggtcttggactcctgaccttgtgatctgcccgcctcggcctcccaaagtgctgggatattacaggagtgagccaccgtgcctgacgttttgtttttttgtgtttttttgagaccggttttgctcagtcgcccaggctagagtgcagtggcatgatctcggctcactgcaacctccacctcccggattcaaacgattctcccgcctcagcctcctgagtagctgggattacaagcacccgccatcaagactggctaatttttgtatttttagtagagacagggtttcaccatgttggccaggctggtcttgaactcctgacagcaagtgatccaaccgcgttggccttccaaagtgctgggattacaggcgtgaaccactgtgcccagtcctttttgcctctttctaggttttggcggattatcatcaacataaattctagtgacttgagagtttgtgctagttgcgttccaggtaacttaggagttatcacactcacccctgcggtgggttctgtcccatgctgcgtctttcgggaaaggcaaatatgagttagattttttcctcttgcatatgttgtgggaggtgatcttgatttacatacaaatgtctgcccctaatctccttccctatctccctttgacatttttcttgtttctgagaatctgtggggaaaacaggcatcaaggcaaacatttccatacgggtagaccccctgcatcaggcctcagggtcttgtgccaaaaacagcgagcaccatgaatgggagcgctgccacaggctgcagcccaggtgaaccttcaagacaccatgctacgagaaagaaacagccacaaaagaccacatgttgtctgattccatgtatgtgaaatggccagacaggcaaacccatggagacggggagtggcttagtggttaccagggacggaggccagggaaggatgggaagcgtctgcccatgggcacgaggtttatttatttatttttgcagagatggggtcttgctgtgtttcccaggctggtctcgaattcctgggctcaagcgatcctcccacctcggactcccgaagtgctgggattacagatgagccaccattcccagcatagtacagagtttcttttggggatgataaaaatgtcctggaattagatagtggtgatgtggcacaactgcgaatatctttaaaaacatcaaattgtcgctgggtgtgctggctcttgcctataatcccagcacttcaggagagtgagctgagaggaaggcatgagcccaggagttcaagaccaacctgggcaacatagtgagacctcatctgtataaaaaaacaaaacaaacacaaaagacatccaattgtaaactgtatgtatgtatgtatgtatttatttattgagacagtctcgctctgttgcccaggctggagtacagtggcatgatctcagctcactgcaacctccatctcccaggttcaagcaattcacctgcctcaccctcctgagtagctgggattataggcacaggccaccacgcctggctaatttgtgcatttgtattagagatggggtttccccatgttggccaggctggtcatgaactcctgacctcaagtgatccgcctgcctcggcctcccaaagtgctaggattacagatgtgagccaccacacctggcccaattatacactttaaatgggctaactttacagtatataaattatatgtttaaaaatgtttaaaatactgattccaggctgggcgcggtggctcatgcctataatcccagccctttgggaggctgaggtgggtggatcacgtaaggtctggagtttgagaccagcctggccaacatggtgaaactccatctctactaaaaatagaaaaattagctggtcatggtgacacgcacctgtaattccagctactcaggaggctgagggaggtgaattgcttgaacctgggagccagaagctgcagtgagccgagactgcgccactgcattccagcctgggtgacagagcaagagtctgttaaaaaaaagaaaaaaaaaaaaaaaaacctgattccagggcccagccaaaactactaaatcagaacctctgggtgtaagcctaggaatctgcatttcacctccctctcagcagtaccggctgtgtactttgtttagaaatcactaagcatttcaagacagtgatgagaacagagggtgaaaacaagctcagggccctctgagctctgggccccatgactgagtaggtcacaggctcgtgaagctggccctgcagcccagaatgaagcctgcatgctctacccaaaggacgacggagcatttggttagcgggtttgcctcttcatccaaggacctggaaggagaggagaaattagcaactttaaaggtttcctctccctgtaagagcagtgcggtggttttagtgagaagagtgcagcggagtcccccggcccgtggctgagtcatctccagaactgcgggctttcagtgacagaaggagaaaggctgagcctgcgctagatctgcgggagctccttggtcaatccatcaatccaatagcattaaatgactcttctggcagattggatcagaatgggaattcattaaaggagaccaggtggttcgcagaatcgctgtgagcctgttgctcatgggaacccgtctggggtggggggcaccaggcggccactgagagctcagcccctgttcctccagagaggggatcttgttgcaattgccacctctccgtgcaacgaagcacctgccaccatctccgctgctttgtgtcaccagcgtctgatttgaagtctgattgcattgccgcggtctcaggcccacaacctagctaagagggaggctgggaagacaagtgttgcatttcagtttctgcagcagacagcaggtccctctgcccaccaaacaacccttacccagagtgggcacatgtcaagcttttattcaactcggtgttgagggaatcagcgtaacacagctgattcaaaggaggagatgagagactagtattggtttctcatctgtctgtctgtctgttgtcagtgaagataaagaatgccagaatcaaacagctctgttagatgcgaaagtggttcatgccctacagtaaatacaaccataacctttggagtcatcttctctactgggtagagatcatttgcatcttatctgttttctctaagttcaaagaccctggggcctaatgaataatatataatacgtcaaacaaagttccattctctgagaacaatgccaaagttccattctccgagaacaatgccatctaatagaacttcctgcggtaatggagatattctgtctgtgctatccaatgaggtcgccactagccactgcagctgtcgagcacgcaagatgtgagtgacactgagaaactgaatttttttaaaaagttttttttttttttgaaatggagtctcactctgttgcccaggctggagtgcagtggtgcaatctccactcactgcaacctctgcctcccgggttcaagcaattctcctgcctcagcctccctagtagctgaaactacaggtgtgcaccaccacacctggctaatttttgtattttttagtagagatgaggttttaccatgttggccaggctggtctcaactcctgacctcaggtgatccaccagcctcagcctcccaacgtgctgggattacaggtatgagccaacacacctggcaaaaaaaaatgttttaagtaattaaaaaaaaaatagaagtgggaaggccgggtgtggtggctcacgcctgtaatcccagcactttgggaggccaaggtgggcggatcactcaaggtcaggagtttgagaccagcctggccaacctggtgaaaccccatctctactaaaactataaaaattagctgggcgtggtggtgcatgcctgtaatcccagctacttgggaggctgaggcaggagaattgctagaacctgggacgtggagattgtaatgagccgagattgcatcattgcactctaacctgggcaacaaaggcaaaactctgtctcaaaaaaaaaaaaaaagaggtgggttctcaccatgttgggatctcgccatgttgcccaggctggtctcgagctgatcactcaagtgatccacccacctcagcctcctaaagggctgggattacaggggtgagccacagcacctgacctattttaagtaattttagatttatagaaaatttatagacagtacagagagttcctatatacccttcacccagcttcccctaagtgggaatttgttaagtaactgtgcacgtttataaaaactaagcgattaacactcatacaatattaatcactaaactaccaactgtctgaattttctccatttttttcactaatgtctgttttctggtccaagagtcagtccaagttcccacattgtgcttagtgcttgtatctccttagtcttcaatctgtgaccatttcttagcctttccttgtttttcatgaccctgacacttttgaagagtgccagtcaaggattttgtgaattgaccctaggttgggcttggcaggtgttttctcctgatgggactgggatggtggttttggaagatcacagagaagtgagggaggtaccttctcattgtgtcatgtgaggggtgcgtgatacccaagcgtgggctcactggccagaggtggtgtctgagatgcatctcccctgccaccttaccgtattccctcttgtgctctgttctttagaagggagtcaccaagtcccacccgccttcaagatgagggaagttaagccccacctcctggagggaggaatatcgaagatttgtggacatatgttaaagccaccaccatggtttgaagggagattctttgaggctatgcagatttcctgtttctccttaaagtttcacctgctaacttcagcattcttctgtggatcctgcctgaggcagttattactgtggtgttctaatgatgattttctatttccctcattccttctatatttatgatttattaattagaattctagttgggcgcagtggctcattcctgtaattccagcactttgggaggccgagacaggtggatcacgaggtcaggagatcgagaccatcctggctaacacggtgaaaccccgtctctactaaaaatacaaaaaaattagccgggcgtggtggcgggcgcctgtagtcccagctattctggaggctgaggcagtggaatggcgtgaacccgggaggcagaggttgcagtgagccgagatcgtgccactgcactccagcctgggcgacagagcgagactccgtctcaaaaaaaaaaaaaaaaaaaaaaaagaattctataaggaacatttgaaccttttccctaatttatttatcttgtcaaccatttattttgttgttgtttgttgttgttgttttgaaacaaggtctcactctgttgcccaggctggagtatagtgacgccatcttggctcactgcaacctccacctcctaggttcaagcaagtggtacctcagcctcccaagtagctgggattacaggcatgcaccactacacttggccagtttttgtattttttgtggagatgggatttcgccatgttgcccagcctggtctcgagctcctgacctcaagtgatgttcctgcctcagcctcccaaagtgctgggattacaggtgtgagacaccacggctggcccaactatttgtttatatcaaaatgaacttgtgggtatttactttattctttgaaaggacataggtcatctttttgccttatttcccagttttagataatttttctaatatgtgtaaaggtgttctgatgtaggacagtcaaaaagagagatagaagtccaccacactggatattttctggaaagatcaccaaaaccttgtcattggaaactaggatatctgggggcttaaatgcctgctacggggccgggcacggtggctcacacctgtaatcccagcactttgggaggccaaggcaggcggatcacaaggtcaggagatcgagaccatcctggctaacacggtgaaaccccgtctctactaaaaatacaaaaaattagccgggcgtggtggcgggcgcctgtagtcccagctacttgggaggctgaggcaggagaatcgcttgaacctgggaggcggagcttgcagtgagccgagattgcaccactgcactccagcctgggtgacagagtgagactctccgaaggaaaaaaaacaaaaaagcctgctaggggctgcagtagaaatacctgtgagaataaaaatgagaagtccaagactgaagtgcgtgtctcagagtcctaaccacatccctccttacatatggacttgtgcaaaccacacctcttcggtcctcagtttcccccgagataagatgaatatataggtgctggtagactcaagattagtggttctcaaacttgagggtgtattagaatcccctggagggccccataaagcccagatttctgtctccacccacagaccttccgattcagtaggtctggggtgagacccaatgattgacatttctaaaatgttgccacgggctgctgctgctgctgctgggccagggaccacgttttgagtccgggtgatctctaagaagccttaacagttgtggacttaacattgattcaaatgacaaaatctttggacctggctaggaagaagtcccctaggccctgaaaacccagtggggagttgtgcagaggacactgtaagattgctgcatgccgcgcctggcattgacagcctgtgaggcccaaccactgcccggggagggtcaaagcctgagtaaggcagagaagctcaggctggaaactgggctccaccccttaacagctgtgtggccttgagcaagtgactgactgacttcctgcctcagtttccctacctatgaaaagaggatggtgcttaacatgacctggcataaagaaaatgctcaatgagtgtttattgctgctgaggtcttgctttgtctctggagtgagtggtgctgtcctagctcactgcagcctcgaactcctgggctcaagcaatcctcccacctcagcctcccaagtagcacaccaccatgtctggctaatttttttgttttgttttgggttggtttttttagagatgggatcttgctatgttgcccaggctggtccgaaactctggccccaagcagtcctccagccttagcttcccaaagtgctgggatatctgatctgtgttacaaccctatgaggctgtggccatcaccatcgccatttccagacgaaactagccaccgtgtaccaccagggtcattatttcttttctctttcttttttttaaatagagatggggtctcactatgttgcccaggctggtctggaactcctgggctcaagtgatcctcctgcctttatctcccaaagtgctgggattgcaggtgtgagccacagtgcctggctcagggtcattattttttattgagcccgtccagtgggaagaaatgacagtggtagaagcgatacctctttctagagcatgtccatctgccctctgccacaactctacccagcttggagtcccatttgccaatgtcaagcccctcacaaaatgtgtcacagattatgagaaaaattcaatataatttattaaatagattccgagggctcccccagggagcattgacaactcttagtacaataaatatcaataaattaacatagctgccacctcccaccctcacgagggtataataagtaagacttaagcctgcagaagaaaagcattccataaataccaagactaataacaataacctaatgtttttcaaggtaattcacaaattcacatctcagccctcccgggactagcccatatgaggggtccctgagattattcattggaaaaatgtacttaaggaatcacggcagagttcccacacttagctgtcggtcatctttttaaggctccttaagttcctgccaatccgaaaggaagagatggccttaagtggtggcctgttgggctccagaggtcaatgattttagtgcgaggtccatgcactctgaaaactgttgagaaatagtcaggatgaagcgtttacattcatgggtgtctgttggcacagaaatgtttgtttctggtgcatcttgaaatatgagtttgtcgaggtgctctatgatctcatcaataacagatttgttgtctagctgtctgattgtcttgagatatgcccggatggctgggctgtggatgttgtttggcggctgggcgtcagggctgagacacggcagcgtgtaattctgggacacgagcacgcccttctcttcctccacctgtggaatgaggagaaatggtcagtgttgggtttgcaatgacagctgcaagtcttaacagtgaatgtttgcatgcttcctccgtaacccgcctcgttgatatatttatctgatcaatgtcacaaccctatgaggctgtgccatcaccaaccccatttccagatgaaactagagcttaggtggctgcagtcctgaagcctgtgctcagaaccactgatccatccagctgaggcctcccagccttccagaacccactctcacgtgctcagggtggtgggaattgcagcacatctggccttccatggcagctccccgccctttgggactctgtgttaaagccacgcacgctccacttataaaggagagtgttaggcttgtccggaaaggcctccgagatgcaggcgagagttttccccaacaaaccaaggagtccggaccactccctcccttcctctttctaagtactaactagagtcagaccaaattgccagcagcacctcatcaacctgaactgcccagtcatcttgggttggtaacaacctctgccttttataaaagccaaggctaaggtctaaataccaaggcagatgagaagagtaatgccaattttatgaattgtttccaagtttgggcatttgtttgtttgatcaaagctatcttggctgggcacagtggctcacgcctgtaatcccagcactttgggaggccaaggcaggcggatcacttgaggtcaggagttcaagaccagcctggccaacgtggagaaactctgtctctactaaaaatatgaaaattagctgggcgtggtggcgcatgcctgtagtcccagctactcgggaggctgaggcaggagaatcgcttgaacccaggaagcagaggttgcagtgagccaagattgcaccactgcactccagcctgggtgacagagtaagactctgtctcaaaaaaaaaaaaaaagccatctttgcctgtctagtttcccccatcccttcctggcatagctacagccctggtttcaggtccggagagaggagcctctttggagggcaatggaaggcatttttaagaaatcgtttagaaaagaaatctctaggacactcacatctttcaaaagcatcttcgagagggactgtaattcctcgactattttctgtacatcatcacttggtcgtagtaaacggacgggcaacgtgtgggaggccagccagcctcccaggcagcagaacagaaagagcacagacgtcgaggggcctggagagagaacgatgccgtgagcgcatacatcacacacccctgcccaccctggctccatccctgcagccctgctgagccaaccctgggggtagtgcttccagaatcttcctggtgagataagatgatgcccaagactccggaagcaccaggaccagtgatacctgagtgagaggccatggcgagagagagcaaggccagcttcagtgggggcttctggagccagatgtgttcgccatggctgcctggaggtatataaagggccagggtgaggagaaagagcagtcagcgtcccgcccatggcaaaaccatttactcagcttttctccagaaaacactcaaaagttctactggccacggctgagtgaaagggctgaatggaaatgctgaggttaccctccaggtgggcagatgcctgactcagacacacacatacttcacaagaaggcacatgaatgcatctttgccattcttcttggaaggagcctgttgatttgactagacaaaattttgaagcccagggttgacagacacgaccataccaccaaggagcgggtgacttccaggagttcaaggccagcggccacagggaatttctggggaggaaatgcgaagccggcatgagatgtgcagaatgcggtatctctggaaatttctgcagcatatgcccacgccggtgtgcagggacggccccataactgctgtgaatgtggcgggtcgaaggcttcatctcaactccatgtggccttggacatcactggactctccatcgtgcctctgcaatctcagggcccagaaccagagactgtgatccagagttattgcttgaaatccttgttcatatcttttttcttttttttttttttgagatggagtcttgctctgtcacccaggctggagtgcggtggcgtgatcactgcaacctctgtctcctgggctcaagcaattctcatgcctcagtctcagcctcccaagtagctgggactacaggcacgtgccaccatgcccagctaatttttgtatttttagtagaaatggggtttcgccatgttggtcaagctggtctctaactcctgacctcaggtgatctgcctgcctcggcttcccaaagtgctggaattacaggcatgagccactgcgccagcctagaaactttattgcttttctttctttctttctttctttctttttttttgagacagagtcttgctctgtcgcctgggctggagtgcagtagcgcaatctcggctcactgcaacctccacttcccaggttcaagcaattctcttgcctcagcctcctgagtggctgggattacaggcgcccaccaccacgcacagctaatttttgtatttttagtagagacggggttcactatgttggccaggctggtctcaaacgcctgaccttgtgatccacctgcctccgcctctcaaagtgctgggattacaggtgcgagccaccactctggccttagaaactatttctaagttcattagctttctttttctttctttttttttttttttgagacagggtctcattctgtcacccaggccagagtgcagtggcatcatcacaactcacggcagccccgatcccctgggctcaagtgatcctcctacctcagcctcccaaatagctgggaccacaggcacaaatcactatgctaatttttttttttcttttttgagacagagtttcgctcttgttgcccaggctggagtgcaatagcacgatctcggctcactgcaacctccgcctcctgggttcaagcgattctcctgccttagcctcccgagaagctgggattacaggcacccaccaccacgccgggctaatttttgtatttttagtagagacggggtttcaccatgttggccaggctggcctctatctcctgacctcaggtgatctgcccgcctcagattcccaaactgctgggattataggcatgagcgactgcacccggcctccttattcatattttagtgccagctttgatcaggccattttatagggtatcgggaatagcggtgaagaagttagagttcctgcccttgtgggcccgtcattgctgtgggctgcggacaatagcaacaacattcataaataagctagaaagcactgtgacggttggagagtgacgggcaggatactttaagtcaggtgatcagcaaaagtctctctgagaggtgacattgaagaagagactgaaagacaagaaggagccagttgtgggaagacctgggagaagagtgttccaaggcaacgggacaggagtgcaaaatcctcaggtgaaaatgagctcgatgctgttcctagaacgggaagagggtcatggcagccacagtgacgcgagaggacaggagggtagtggggaggtgggcagcggctccatcacagaggcctgaggctgggacaaagagcctgggttttattccacatgtgacgaggcagtgctgggcggctttcagtagggaaacataagatcagatgcactttatttttttcttttcttaattgttttgtcttttgttttgtttttttttttggagagaagatctcaagcgatcctcccaccttggcttcccaaagttctgggattacaggcatgagtcaccatgcctagccctgatgaactttatttattagtagtagtagcatttttttttttcttaagacagagtctcactttgtcgcacaggcaggagtgaagtggcgcaatctcagctcactgcaacctccacctcccctgttcaagcaattctcgtgcctcagcctcctgagtagctgggatcacaggcatgtaccaccatgcctggctaattcttgtatttttagtagagatggagtttcaccatgttgggatgaggtcagtctgggcagcccacagaactcaaggtgcacagaggggacacagccaggaagccctcccacccatcatcccaagtccccctgccgccagccaccactgactttttctttacttcccaaactgccacaatatggctttcaccaccccactaatgtaatcaatatcctctagcagagtccatggtaggcatgaccttcatccacaggtgtttactgccataattatgttgcattgcatggcaaaaggggttttgtggatgtagtcatgattactattcagtttacctaaaatagagagattttcctgcattccctgggcctccccaatgcaatcccatgagcccataaagcagaagaggaagtcagagagattacgagcaagagaagggctcacctgctgttgctggcttgaagatggtggggggcagcgtggaaagcacgagaaggaaataatttggtcaataaccactgagcttggaagaggatgctgagacctagatgagaaccctagccagccagcacctttatttcagctcagtgagttcctgagcaaagaatctatccatggcatgctagactttgacctacaaactctatgagagagaaagtgtgtgtgtgtgtgtgtgtgtgtgtgtgtgtgtgtgtgtgtttaatagaaaggatcttgctctctcacccaggctggagtgaagtggtgtgatcacggctcactgcagccttgacctcccagactcaagcagccctcttaccccagcctcccaagtagttgggactgtaggcctgcaccaccatgcctggctaatttttctattttttgtagcgatgggatctcaccatgttgcccaggttggtgttgaactcctgggctcaagcagtcctgcctcaccttcccaaagtgctgggatcacaggcgtgagccactgcgcctggccacctttgtggttttatttatttatttatttatttatttatttatttattattttgagatggagtgtggctctgttgcccaggatggagtgcagtggcatgatcttggctcactgcaacctctgcctcctgggttcaagagattctcctgtctcagcctcccaagtaactgggattacaggtacgtgccaccatgcctggttaatttttgtattttttgtagagacagggttttgccatgttgtccaggctggtcttgaactcctgacctcaagtgatccacccaccttggcctcccaaggtgctaggattacaagtgggagccaccacgcctggctgcatttgtggttttaaactgctgtttgtgatatttgttatggcagcaatagagaactaatacagtacccagagaccacatgtcagccttactggggtttcagccttcattttacatgacccctctatagcatgaaacattgccaaccacttccaccttcttgacaacctctcgtaacaacctctcctgtaacaacgtcatcctgatcccttttgcccctctccctagctccacggtgtccacccgtgatctggattcctcacactttactgtctgtctccttcacactccagacctaaatgtccacctgaatgtcccagtgatacctcaaaatcaacatgcccaaaggtgagggtgagaagagggtaatagtgatagtggagatgaagaggtgtggatgggttgtagaaatgtttaggaggaaaaatacgtaagaggtggctttctttttttttttttttttttttttttttgagacattgtcttgctctgtcacctggcctggagtgcagtggcatgatctcggctcaccacaacctctgcctcccgggttcaagcgattgtcctgcctcagcctcttgagtagccgggattacaggcgtgagccaccactcttggcgtttttttgtttgtttgtttttcttgtatttttagtagagatggggttttttcatgttggccaggctggtcttgaactcctgaccttgtgatccacctgcctcggcctcccaaggtgctgggattataggcgtgagccatggtgcctggccagggtggtgtttgattggatatggggatggtggagagggaagagttgaggacaacctctgggtttctggtttgagcaactggataaatgatattggtacaaacgaagaggatcacaggcctcaggcctttggggctcgggtgaggtgatgaattctggctctttgcttgttggttggctggtttggtttggttttcttttctttaagaggcaaggtctcagtctgtcacctaggctagagtgcagtggtgtgatcacagctcactgcagcctcaaactcccaggctcaagagatccttccgcctcagcctcctgagtagctggggttataggcacacggcataccaccaggcctggctaactttttaattttaactttttgtagaaataagatcctcctctattgcctaggctggtcttaaactccggggctcaagcaatccactcaccttggcctcccaaagtgctgcgactgtaggtgcaagccacgtgcccggcctgattcagcttttgacacagtgaatgggaagtgttatggatgctcagctgaagacacacagtaggctgttggacgtgtggatctgaagcgtgtaggaaggaactacagatgtaaatgtgggtgccatcaaggtattgtggcagataaaactgtaagccagtaagagatgagcagtgtgaggtgtggaagtcgtgtggagccctgggacatgcttccattaacaggacaaggagaagatgatgatttaatctagaacatggagaaggcactctcaagagaaaaagaaggctgggtgcggtggctcacacctgtaatcccagcactttgggaggccgaggcgggcggatcacgaggtcaaaaggtcgagaccatcctggccaacatggtgaaaccctgtctactaaaaatacaaaaaaattagctgggtgtggtggcgcgtgtctgtagtcccagctactcaggaggctgaggcaggagaattgcttgaacccagaaggtggaggttgcggtgagccgagattgcgccactgaactccagcctcgtgacagagtgagactccgtctcaaaaaaaaaaaaaaaaaaagagagagagaaagaaaagtaacaccagaaatacatgttgtcatggaataagatgaaaagcagtttttcaaggaggaaatggttggcatcatcaaaagccatgaagaggtcaaataagataaaggctgaggagattcactagattgggcaacatgaggtcacagaaactttgctgggagagtttgaataaatttttggtgtggcagttatattgtggtggtttgggaagtgaggaaaaagtgagcataggccaggggcgagtggctcacacctgtaatcccagcactttgggaggccaaggcaggtggatcacttgaggtcaggagttcgagaccagcctgaccagcatggagaaaccctgtctctactaaaaatacaaaaactagctgggcatggtggcgggagcctgcaatcccagctactcagaaggctgaggcaggagaattgcttgaacccaggaggcggaggttgcagtgagccaagattgcgccactgcactccagcctgggcaacagagcaaaactccgtctcaaaagaaaagaaaaaaagaaaaagtgagtatagaccactgtgtcaagaagcttggatgagaaggaagagaaaagagacagtgttggctgcagggggacttgggatgaagggtggaagggcttcctggctgggcctcttctgtgtatcttgggctctgtggtctgcccagacctgacctcattcctgagctcttactcctaaccaatggctgatttgacacagtagacgcccattggcatctggaccttaacttgttccaaacaggatgcttgatttcccctctcagtcttctcttccttcactgcacattgtccatctgttgctccatcaaaattgcaggagccatatctgtgattcatctccttgatttatttatatcactatggactcatagatatttattttattctttgagagccaggcatggtggctcacgcctgtgatctcagcactttgggaggctgaggtgggtggatcacttgaggtcaggaattcgagaccagcctgggcaacatggcgaaaccccatctgtactaaaaatacaaaaaaattagccaggcatggtgatgcatgcctgtagtcccagccactcaggaggctgaggtgggaggaccgcttcagttcaggaggtccaggcttcagtgacctgtgatcacgctactgcacagtagcctggataacaaagggagaccctgcctcaaaaaaaaaaaaggatattttcttctttgaaaggacatatggttggctgggcccggtggctcatgcatgtaatcccagcactttgagaggctgaggtgggcggatgacgaggtcaggagatcgagaccatcctgactaacacggtgaaaccccgtctctactaaaaatacaaaaaattagccgggcttggtggcgggcgcctgtagtcccagctactcaggaggctgaggcaggagaatggcgtgaacctggcaggcggagcttgcagtgagccgagattgcaccactgcactccagcctggacggcagagggagactccgtctcaaaaaaaaaaaaaggaaaagaaaggacatatggtcatctttttgccttaactcccagttttggataaatttttttttttttttgagacagtctcactctgttgcccaggctggagtgcagtgatgtgatctcggctcactgcaacctccgcctcctgggttcaagcaattctcctgcctcagcctccgaagtagctgggactataggcatgtgtcaccacgcctggctaatttttgtatttttagtagagacggggtttcaccatgttgatcaggctggtctcgaactcctgacctcaggtgatccacccacctcagcctcccaaagtgctgggtttacaggggtgagccatcgcgcccagcctaatttttctaataacagtaaagttgtcccgatatcgtatagtcaaaaagaatgagagatgttaatgtgttcctccaaaattcatttgtcagaacctgatgcccagtgtgatagtattaaaacgtggggccctttgggaagtgattaagtttgggggctcctcaggaatgggatcaatgtccttataaaagaagcttcatggctgggcgtggtggctcacgcctgtaatcccaacactttgggaggctgaggccagtggattgcctgagcccaggagtttgagaccaacctgggcaacatggtgaaactccatctctactaaaatacaaaaaattaggctgggtgcggtggctcacgtatgtaatcccagcacttggggagaccgaggtgggtggatcacctgaggtcaggagttcgagaccagcctggccaacatggtgaaaccccgtctctactaaaaatacacattagcggggcgttgtggcaggcggttgtaatcccagctactcgggaggctgaggcaggagaatcggttgaatctgggaggcggaggttgcagtgagccgagatcgcgccattgcactccagcctggacaacaagagtgaaactcggtctcaaaaaaaaaaaaaaaaaaaaaaaagccggaagtggtcatgcgcgcctgtaatcccagctactcgggaggctgaggcaggagaatcgcttgaacccgggacacggagattgcggtgagctgagatctcgccactggactccagcctgggcgacagagcgagactctgtctcaataaaataaaataaataaaaaatttaaaaaatgaggtctgggtgattaaacagttatacaggtggacagtgataaaatccctgactccagggttagagagaccaccctggaacccactggctggttggagtcgagatgtttgaccttgggccctcttctcctttctccatctgtcagatgggtataggatgactttccgtggggagtgcttgacaggagctaagaaacaggtcagctatggcgcttactgcctgcgggagctgccgcacttagaaccaccagctgttatcccatttttatagatgagggcagaagagaaaacgcaggtggttggggccaggctgtctgatccggatgggggacttttccctcggggcaggtgagagcgcctggagaggcccctgcccccgcgcacgcgtcctagcggttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctgggtgcgggcgccggggccggaactctgggggcctggaccggctgcggggaggcacgggcccgggcgagcggagcgggctggtccctggggcctgggatctgcgcattctgggggccgccgacatgggggcgggtggggcttgagggtgacggtggggcccgagtcgcgggcactgcgcggggaggagagcggggcccgtcctgagcacatcagctgacctgggctggggcctctccctgacttgaagacgtcaacaccccagatttctagtgggcaggctccttttggggtgaaaagcttttgttttgggcaaagagttccacaacttttcccagcctccgagcatttaataagagcctgaggcagtgtgagaggtggctcagcctgaagcctgcgaccttgagtccaggagaaggggttaccccccatcctgcctccctgtctccagagtcctagacccttccctcccgtggcttcaaccacgaggggcgcccaggtgtggcccaggaaggcttactgcccaggctggagcatagtgacgcgatgtcgacttactgcaacctccgcctcccaagtagcagggattacaggcacctgccaccatgcccggctaattattgtatttttagtagagacaggatttcaccatgttgcccaggctggtctcaaactcctgacctcaagtgatccacctgcctttttaaaaggaatggcaccttttaattattttgtatctcacctcatctgtagttatatccatggctaataatccatcaaaattattgattattcactgtctagatttttttttttttttttgagacggagtctcgctctgtcacccagcctggagtgcagtggcgtgatctcggctcactgcaacctccgcctcccgggttcaaacgattctcctgccttagcctcccgagtagctgagactacagttgcgtgccaccacgcccggctaattttttgtatttttagtcgagacggggtttcaccgtgttagccaggatggcctcgatctcttgacctcatgatccgcctgcctcagcctcccaaagtgctgggattacaggcatgagccaccgcacctggcctactctctagatttctaaactctatccctaatcgtccagttttatgatctgttctgttttgagagtttggtgtccttaagggggctgtgtcacacctacagaaaatccctcctctgccactgcagaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcagtgctgggcacgtggtaggtgatgttagggtggccgctcccctaagggaggttgtggggagggcacccttccccacagcgcgtcagggatcctgctttcagggctgaaacgaaggccagcctgccctccatctgcttcatctccctggcttgtgtgccaggcagggccggctactcggtcagccttgcgtttcttcttcctttacccctggaagccatcatggcacagcttccacccctgagttctgcagtggaccctcctgggtcctagtaaaggttttttgaagggtctgtgttagttttacttcgtttaaaccgtgggggtcagggtaggggaaggttggtgtagttctattttaatttgttaccaaaaagcattctttgtttacatcagtagcagagcccagtctcggcatggtggctctctggtgcttgtaatctcagcactttgggaggctgaggcaggaggatcgtgtgagtctaggtgttagaggcccagcctgggcaacatagtgggatcccacctctgtaacatctttaaatttagccaggtatggtggtgcacgcctgtagccccagctactcagaggcttaggcaggagaatcacttgaggtggggaggtagaggctgcagtgatcatgatcgcaccgctgcactccagcctgggtgacagaatgagaccctgtctcaatcaattaagcaagcaagcaaacaagagtgagactctgtctcaataaataaataaagccagcaagccagcccaaaaattgcctggaaacttggtctcagccttcccaacccttggctttctttttccagagccactgggaagtgacacggcactaggggacaaatagggtgactgactggtagcagtttgccagggactttcagtttcagtgcagaaggtttcgtgtcctggacagactggcacagttggtggccctggagaagcgaggccccgctgggaagggccctgatgtctttgaggtcacaggaactgaggagtcacggatgggtcactgcagcttctggtcggaccctgctctgggtgattcctggacaccttgactgacttcagtgcccagagttcactgtggctctggggtagacagaaaggagagaggttcctgccctcgcaggtggcttatggtccaacaaaggacacaggtcattggcctagaaatcatgcaccacctatggtcagaggaaggatggaggttgggagaggctcttggatcctggcagagcgatgcagtgcaggaacggcttccggggagcagggggtgggaagggaggggaagtaactctgatggaggagccgctgtcttcctaatgtggacatgggttctgtgcccgtgctccctctcctgctacagccctcagcttcctctcccctcttccaggtcaccctggtggataaagacctcctgaaatttctaaagctggaggagttggtactgagcgccaatcgaatcaaggaggtggatgccaccaatctgccccccacactcaaggtgaaggagccccggtctgtgttgagtatttgggcctccgctgcccagaggccttgccttaccctgccccacatagtgtggccagcatgggtggagggtaaggcccagctccaggcttttaaaatgtaggtcactttcctagaaaagttcaacatagaataaccatatgacccagtgcttccattcctaggtgtatccatgaaggaactgaagacagggatttagccagattcttgtactccagagttcagagctgcgttactcacaatagcagaagggtggacacaactcaagggtctataaacagatgaatggataaacaaaaaaatgtggacaggccaggcgcggtggctcacacctgtaatcccagcactttgggaggccgaggcaggtggatcacctgaggtcaggagtttgagaccagcctggccaacatggcgaaaccccatctctactaaaaatacaaaaattagccgggtgtggtggcatgcgcctgtagtcccagctgcttgggaggctgagacaggagaattgcttgaacccaggaggcaagggttgcagtgagccgagactgtgccactgcactccagtctgggcgacagagtgactccatctcaaagtggtctatccattcaatagaatgctattcactcatagaaaggaatgaagtaggcctgaatcccagcactctgggaggctgaggtgggcagattgcctgttctcaggaattcaaaaccagcctgggcaacataggaatatcccctctacaaaaatacaaaaattagccaggcgtcgtggctggtgcctgtaatagcagctactcaggaggctgaggcaggagaatcgcttgaacccaggaggcggaggttgcagtgagccaagattgtgccactgcactccagcctgggcaacagagcgagactccacctcaaaataataataaataaacaataaataaataaaaattaaaaaaacccaaaccaacaagcaaacaacaacaaaaaaaggtgggtgaggccgtggataagaactacaagcaaggaaggttagctttggatttattccttatccatctaggagcccttttggcctcccagagacgcattcctatgggttgagaaggtgccagatgttatgcagctcccccactgccaatccagcatcaccccccattccagatgttgaagtgtctttcacaaaaggaaaagaaacttcccaagacctgctgcaggaatcttttcttcctgggtttttaaaagggagtcggggtggtgccagggaggccaggtgtgagtagtttgtgattcctctactaagttttgcgggacagaggggaggggcctgatcctcagcgctgacttggggccccatcgtcccgggccttccgtgtggtctcccaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggtaactcgggagcccagatggaaagtgagagggagggattaagtatcaggttggggcgattctaccccagtggcttgagaactcagctttggtcttttttgtaactcccagttggctgctaaatccagacttatggtttatttctctgaatcccccttcagtgggattttgtaaacaaaaagcccggggaaggagaacaagaggtagtaggtgtgagtcagagcctttgctttggtgccgtattttaattttttaatttttttatcttatttttttatttttttgagacagcatctcgctttgtcgcccaggctggagcgcattggcgccatctctgctcattgcaagctccgcctgccgggttcacgccattctcctgcctcagcctcccgagtagctgggactacaggcacccgccaccatgcccggctaattattttgtatttttagtagagacggggtttcactgtgttagccaggatggtctccatctcctgacctcgtgatccgcccgtctcggcctcccaaagtgctgggattacaggcgtgagccactgtgcccggcctaatttttttattttaatttttttattttaattttttattttaatttttttttgagatggagtttcactctgttgcccaggctagagtgctgtgcgtgatctcggctcactgcaacctccacctcccagggtcaagcaattctcctgcctcagcctcccaagtagcgggtattacaggcacccaccaccacacctggctaatttttgtatttttagtagagacggggtttcaccatgttggccaggatggtctcgaactcctgacctcaagtgatccacttactttggcctcccaaagtgctgggattacaggcgtgagccaccgcacttggcctggtgccgtattttagaggagggttgctcaccttgggctcgttggcatcggaaccccatcaccctttgatgtggggctgtcctgggcatggtgggatattgagcagcatacctggcctgcacccgcagatgccaggagcacttccccattagttgtgacaaacaaaaatgtctccagacagtttttgtctgagcctgatgtcccctgagcagcaaaatccccccaagctgagaaccaccaccctggaaccaagccctagcgccagccgctccatcgctattgaaggttcaggctcattaggagcctgcagatggttcagctcccagttgatattcaacttgatctcctcagtgggtgagcggtagaaaacttaacatcctggacctgaggggtaggaggggatcagagaccacccagaaaaagccatcaaaggaagctgggagaggaaggctttgcaaaacatgctgtgagaagtcccaggacttcagcagcccagcaaggatggaaggggtagaaccacctcccctctctccttcccccgaggaacctggagggcatgcccttggggggtccaaccctctacatgcctggagcgggcggacgcagcagggaagggaagccccctctctgaccctggtttcctcttcctccccttctcttctgctcttaggggaagagtgaggctgggattgggagatgctgtgctgacagcggccgcttgtgtttttcttctgttctcagagccgagatcaatttgctttctagtttgtggcagcaggaaagtcaccctgcccctgccctgtgtcttggtctggccacaggccttggcccgtgctctttgcaggcccctcccaggcccctttcctcctggggtcccgccccagtctggctttgagaagccatctcctgcttctagaccgcccagccctccagcctctggctccctcctcccactccccagcatcaaccccactcctgccctgtccactcctgccctgtccacaactcccccacggtggctgtcccctgctgtgccgtccagtctgcctgtactatttgtgcagagcctcctagacgcacgcagtgcgcgaggctctgtggaagctactgagaggtttggccaagaagagaggagccccgtgaagggaggtcggtgggggcgtctctgtgactccaactgtgagggtggcagtgctacggagagtggagatgaagagccaggcactcgttcccgacccggggttaacttgggtcaagggtaggacaggggtgcaggccgtggatgggcagaatccttagccccaggctccccgtccgttttggccacaggctgcttgccccctgctcacctggcttcttgacccccagacggtcctgctcaccttccaggcccaacctcgtctccctggacctgggcttcaacgacctgacagacctgcagagcatggtcaccagcctgaggaccctccggcacctgcgactcctggtgctgcagggaaacccactggccttggtgccctactaccgcggcctcaccatcgacagcctggcccagctctgcgtgctggacgacatcaccgtgtctcccaatgagaagcatctcttccgggggctcagcctcaatggcggtgagggtactggcatgcagggagggggtggcatgtgacaccccagcctgcgcctggctgtgccccgccctcctgggtccgtgtacccgtctgtcctgcaactccccatttgacccagaccctattcaggtatagcctctcttctgggtcagagctttccaccaggctttgattcctgtgattgggatttggagacagaagtgatagggggaggccgggcgcggtggctaacgcctgtaatcccagcattttgggaggctgaagcagacagatcgcttgaagtcaggagtttgagaccagcctggccaacatggtgaaacctcgtctgtactaaaaatacaaaaattagccaggcatggtggcaagtgcctgtaatcccagctactcaggaggctgaggcacgagaatcttttgaacccgggaggtggaggctgcagtgagccgagatgacaccagtgtactctagcctaggtgacagagcaagacaaaaaaaaaaaaggtggtgtgggaggatcacttgagcccaggaggtggaggctgcagtgagctatcatctcaccactgcactctagcctggcgacagagcgagaccccgtctctaaaaaaaataaaaagtcaaaacaacctgtggggacttgggacagttatttcaatcagcttcttcacctccctggtggcttgagatcacccccttgtggttcatgccgcaaggtgcaccggaggcttctccaggtcactgtgacgtgctagataatgctaaggtgacctgcagagtagcccttatcactcccatatacagatcaggaaaacaaggctgaagaggggtataatgacacctggatcactccaggccagcttgccagagctgtgacatgaacctgaccgccccaccaaggctcagccctgagtgctggagagaatctagggacccgtgccttcccagccctcttgctttctatctgccaacttccattccatgggcccccctgtcctgcccattcctccctgcagatctcttggcacaggaggcgcagtttgtggtgaccatcggaaacatcagaggagtcctggacacctctgtcttagacccggaacccaggcccgaaggccctttcatcacttacaactattacgtgacctatgattttgtgaaagatgaagaaggcgaaatgaatgagtccgcgggcgtcctggccgaggtgtgccctggtctgtccctaggagtatggggggctcttgtgaaggctgaactgctttgtgggccccaggaaaatccttttaattaattaattaatttatttattgaggaggagtctcgctctgtcacccaggctggagtgcgatggcgtaatctcagctcactgtaacctctgcctcctgggttcaagcaattctcctgcctcagatccccagtagctggaattacaggtccccaccactaggcccagctaatttttgtatttttagtagagatgagatttcaccttgttgaccaggctggtctggaactcctgagctcaagtgatcctcggcctcccaaagtgctgggattacaggtgtgagccaccgcgctggccaagaaagattcttaatgtggaatctggtgattcatgcaaggacctggcttcagctcagcctctttcttgcagctagagcaattttcaaccatgcacactccccttgcccccttaaaatctgagcctaacaagagagccacccggcatttcataagtcagccccttgttcccagccccattctgcaatttatttcttttttgtgtgtgtgtgtgatggagtctcgctctgtcgctcaggctggagtgcagtggcgcaatctcggctgactgcaacctctgcctctgggttcaagtgattctcctgcctcagcctcctgagtagctgggattacaggctcgcgccaccatacctggctcattttttgtatttttagtagagatggggtttcaccatgttagccaggatggcctggatctcctgacctcgtgatccgcctgcctcggcctcccaaagtactgggattacaggcgtgagccaccgcgcctagccccattctgcaatttctacaactcctcccatctccctccacatcagaagaaaacccaaggataccatccaaccaggagaaacctgtctcctcctcccacatagaagtggttcttgcttttactcttaatgtaggtctttcagaaaagacaaaagtgggtttctaagcgccttcctgcctcctagcgtggtgtgtctgctcatgcgtgaacctcatccagatgtcgggagctgtgttacagacacccccggcatcagctgagcacatcctgaagacggcagccttggacgagtttctgtctcttcctgcagatcgtcaagccctctcccagcttagaattattagttgaggaatctcctgaagaggtcgtggaagacgtcatcgaagacattgttgaagaggttactgaagaggtcgaagggtctctggagtctgaggtggaggagtcaggagagtcggagctgtctgtcatctcggggccttcgaccatcttgcagatgccgagggcctctgcagaagagctggccaagttgaggctgcgtatagatccccggctctgcccgtccccagggtaaggatggaaatctgaaccagggcaagtggtcagagcagtagggtcacgagcctagaccacactgcgaccttccattaaaagtcctgaggctggcggggcgcggtggctcacgtctgtaatcccggcactttgggaggcagaggcgggcggatcacgaggtcaggagatcgagaccatcctggctaacatggtgaaaccccgtctctactaaaaatacgaaaaaattagccaggcgtggtggcaggcgcctgtagtcccagctactcgggaggctgaggcaggagaatgtcgtgaacccaggaggcggggcttgcagtgagccgagatcgtgccactgcgctccagcccggcgacagagcgagactccgtctcataaaaaaaaaaaaaaaaaaaaaaaaaaaaggcccactagactgttagctgtgctggcggcatttagatttcgtgttcagccctcttctctggagggttcaacttagctaaatccttctactctaaccatctactcaaagtacaactgagtcccacttccctgaccagccaagattttcggaatgattgaatttcttttttggcggggacagtctcactctgtcacccaggctggagtgcagtggtgcgatctcagcttactgcatcctccatctcccggattcaagcaattcttgtgcctcagcctacagttgggactacaggcatgtgctaccatgcccagctaatttttatagttttagtaaagatggggtttcaccatgttgaccaggctggtcttgagctcctggtctcaagtgatctgcccgcctcagcctcccaaagtgctgggattacaggcgtcagccatcgcgcccagcctgaatttcttgagtcgatcgagacatgataaattaatagcccttttcatttcagcccttgggtgtgaaaaccttttttggtttaacattttaatccatctaagatgtattctcacacataaagtgctgtaaggatcttccatcctgtataccatgttctttcttgccagtctagctccattccttctctcttttttgtgctacttttgttatgaagattgtagagtaattgttataaatattaattttattataaacataaatatgttacagacccaacaatacattgttataattactgctttatataatccatgtcttgcagagaagaaaggagagcacaaatataaagttgtttttttttttaagcttgttaaccttcttagttaccatttctggggaaccatgaattcatgtcttcctttagaattgatttactgttgtggctcatgcctgtaatcccagcactttgggaggctgaggtggacagatcacctcaggaggtcgagacccgcctgaccaacatggtgaaacaccatctctactaaatacaaaaaattagccaggagtggtgactaatcccagctgtaatcccagctacttaggctggggcaggagaattgcttgaacccaggaggcagaggttgcggtgagccaggattgcaccattccactccaccctgggcaataagaaagaagctccgtctcaaaaaaaaaaaaaagaaaagaaaagaaaaaaggatttactttctggtttcattccctccctccctctttcttcctttctctcttttttgtggtggggtctctcgatgttgaccaggttggtcttgaactcctgatctcaagcaatcctactgcctcagcctcccaaagtgctgcaattacagatgtggggcactatgcctgggcttggtgtcattttcttgctccagtatgcttcattctcacccccatttccttcatgttgttatggtcaaatatattacatttctacatgttatagcccaaactacaattttatagatgttgtcttatgctattgcattttattctaattagaaccaaggacaagaaatatatgactatactgtcttttgtatttgcctacatgattacctttattggtgatctttgttttttatgtgaatttgaattaccctctggtgttacttcctttcagcctgaagaacttccttcaggaagttaatgtattcatgtattcaacttcttttcatgtttcgtgtaaggcaaatctactggcaacaaagtcagttttttctttctcttcatatgtctttatttcacctgcaattttcaaagatagttttgctgggtctagaattgttggttgacagttttggtgtttttcttttcccctgctaccccagaacatttttttttttttgagagggagtctcgccctgttgcccagggtggagtgccgtggctggatcttggctcactgcaacctttgcttcctgggttcaagcaattctcctgcctcagcctcccaagtagctgggattacaggcacctactaccatgcccagctgatttttagttgaggcggggtttcacagtgttggccaggctggtcttgaactcctgagctcaagtggtccatccgcctcagcctcccaaaatgctgagattacaggtgtgagccaccatgcctggcctaccctagaactttgaatatgtcgccagcctgcctactggcctccattgtttctgatgaaaactcagctgttcatcttattgggattcctttgtctgtcatgagtcatttttctcttcctgctttcaggattttcactttgtctttcagcatttttactatgatgtctctgggtatggatgtgtttgcatttatcctgcctggagtttgccaagcttcttcaatatatagatgaacgttttaaatcaaattttggaagttttcagccgttatccttcaagtatttttctctgttcctttttctatctcctctccttctagcacttctattatgtgttcttctagtagctcttcagaaaacccaagggaaacctggagtgtttaccaggggcccacctccttggagggctttgaacacaaatttttgttcccctagcgcccatgaggttgcctaaagttctctttagcttctcagccaccacttttggatttggctcttgagcattaatgtggcactaagctcattctctttgactgttcccctttgccctgatgttggccctgaaaattctcagtgacttggctcttcagcaccttcaacagataatgttaatattgtgtcaagctgatatgactgttctcagcaggaaggtttgtccagtatagtctagtctaccacgtcctaaaacagaatttccacattgattttctaaacatacattttatttttgcagtctaatagatttattttaaattgtcttaagttatattccttagtttacttgtaagcctttatattttccatacaattatttgccatatgtaatttcccaagttcaacaattagcaaacgccagtcatccacataccatttccaggtgcaggtgtgatgccaggtatcgggattacaaacaacaaatcagatggaaaatggtctgttctagagggctgggcacagtggctcatgcctgtaatcccagcagtttgggaggccgaggcaggcagatcacttgaggtcaggagtttgagatcagtctggccaacatggtgaaaccctgtatctgctaaaaatataaaaaattatctgggcatggtggcacatgcctgtaatcccagctactcaggaggccgaggcagaagaatcactggaacccggaaggtggaggtggcagtgagccgagattgcaccactgcactccagcctgggaagactctgtctcaaaaaaaaaaaaaaatctgttctatttgggcacttaccttttcatgagggaaatgaacaaacagtaattacatatgttaatgtcacaagtggtacgtcagaggaagtacaggacaaatctctgcccctaggatgggcacatagacttagaaagtgtgggaaacacattcacccatccaaacccaaagaacagactcagagacacgaagaacagcggaaatgagacttttcatggcagttttggaagatcaggtgtctggtaggcaggaacactggggcagtcacgacaggtcatttatctcctagtgggcaagtccctcccccagttcctcattggtcaagtactatggggttacaatcttcctgggtgtcgcccaagtatcattatcccctaataaggtcataccccgtctccttccccacttaagttttgctcttgtcgcccaggctagagtacagtggtgtgatcttggctcactgcaacctctggctcctgggttcaagcaattctcctgccttagcctctgaagtagctgggattacagatgcatgtcaccacccctggccaattttttttttgtatttttagtagagacagagtttcactacgttggccaggctggtctcaaacttctgacctcaggtgatccacccaccttagcctcccaagtgctgggattacaggtgtgagccaccgcgcctggccccctttcatgggctgacccctcctctacatcctgttcgctaagtgtgactttctaggtgcctgagtcgtgaggttcgtcacgtccgcaaggttggctgccagtactcagattttttatgccttgaaaatggaccatttaaactgtttctcacaggaggcatggtagaaagaaggttaactatggaggaaggcagggattggcaagagatagggctgcagagagacagagaaaaagaccctttctcccaaggggaaactagtaagaagttttcaagcagaggagtaatgagatcaggtttccatttgaggaagatgactgcagtggagaagatgacagtgtgcagacagactttcaactcttctactcacttctccggtagattgttgagtgctaacctttatatatttgtatcattcatgtacatatgttatcactggtttggggtttttttttcatgccattttttattcaggagggtctaacatttctttaacctgagaagtacaatttttctttttcttttttcttttttgagatggagtttcactcttgttgcccaggctggagtgcagtggtgtgctctcggctcaccacaacctccgcctcccgggttcaagcgattctcctgcctcagccacttgagtagctggaattacaggtgcccaccaccatgcccggctaatttttgtatttttagtagagacagggtttcaccgtgttggccaggagagttcgagaccagaactcctgaccttaagtgattcatctgcctcagcctcccagaatgctgggatgacaggcatgagccactgcgcccggccgagatatagttaatatatcataacgttcatgttaaagcgtatgagtcggtggtttttagtgtattcacagagttgcgcaaccattaccacagtctaattccagaacgtttccatcaccccagaaaggtacccattaggcgtcaccttcgattccccatccctctagtccaaggcaaccattaaagtactttctgtctctgtggatttgcctgttctggatatttcatatggatggaatcacaaaatacatagccttttgtgtctggcttctttcactgagcatcatgttttcaaggctcatctgtggtcggtgtaataagtatcagtgcttcattcctttttttttttttttttttttttgagatggggtttcattcttgtcacccaggctggagggcagtggtgcgatctcggctcactgcaacctccacctcccaggttcaagtgattctcctgcctcagcttcccaagtagctgggcttacaggctcccgccagcacacccggctaatttttctgtattttttagtagagatggggtttcactatgttgcccaggctggttttgaactcctggcctcaagtgatccgcccacctcggcctcccaaagtgctgggattacaggcatgagccactgagcccggcccatatcactatgtttcaaaccagttattattgtcatatgtactttcacgattttttttttttttttgagacagagttgctctgtcagcaggctggagtgcagtggcgcgatctcggctcactgcaacctccacctcccaggttcaacgttcaacttggacatactttaaatttgttggagtatattattaattctccttcatgctgtgatccaattggtagaacaatttatgttaaatcacttcctgagtgggatgctgcttcagggttgccatggtgttctgagacttaggaaactccagtcccctctgtgttctagcctggggctaggctagaattgtttcagcttttttttttttttttttttttgagacggagtcttgctctgtcacccaggctggagtgtactgtcgcgatctcagctcactgcaacctccacctcccaggttcaagcgattctcctccctcagcctcctgagtagctgggaccacgggcacatgccaccacgcctggctaattttttgtatttttagtagagacggggtttcactgtgttagccagcatggtctcgatctcctgacctcgtgatctgcctgcctctgcctcccaaagtgctgggattacaggcgtgagtcaccctgcccggcctctgcttttttttttctcctgcaggagggtctcactttgtcgcccgggatcgagtacagtggcatgaacatggctcactgcagccttgacttcctgggctcaagcaatcctcctacctcagcccccaaagtagctgggactgcagccatgtgccaccacgcccagctaatgtttgtattttttgtagaaacggggtctcgatatgttgcccaagctgctctcgaactccttggttcaggcgatcctcctgtctcggcttcccaaagtgctgggattagaagccagagccaccacgctcagccctttgctgaacttttaacaaacaactcttgctgcctttcggttggtttctttcagttgctcagggtggtcctgcctctgaaggagggctccacttgcctttcttttgctgtctcctctgtatccacacctttctggccttctggtccccttgccctgcctggtggcagccggacctcacgtctcatgctgtttgtgggcttcgatgctcgtggtctcctcggatgtcccctcacagtcctgtcccgggtccctggccacagcccctgggtgacggcacccccgtcttcatccctccctccccaaggactgtcctcttcagcactgcccacaagccctgggctgaggtcatcccctgcagttacgagatgcagcactctctcagggacctggtcccactgaaggccttcctgctggcggggaccaccgtgaccatcgtggaggagaaggtgggcaggcggaggcagtgcccggccatccacaggctgcacttctgtccttgttcctgttcccatcgggctgtcccccatgggagccgcactccctggttagatgagttctcagcgccattccagaaagggtgagggagaggtgaccccaggcagcccgcctgggcctctgctcactcgaggattctctcctgcccctagattctctcctggcctgtggtgctacctgctgttgacagtcccctgtctgccaagaaaggaaagggggagaaagacaagaaagggaaggagaaagacaggacggggaaaggagagaaagagccggccaaggtaccgggccttggtgctggggagggcagcctggccacacccttgcttcaacttgtcccaccctcctgtcctcccgtcgtcgcaggagtggaaggtgctgaagaagaagaaagagccgcccaaggagctccggcaggacccccccatcctccaggtgctgggccggggcctggtgatcctggagcccctgctcgccggggagcccctggtgtccaccgtgtgcaacttcggcgtggtccgcacattgacatctgacaggctgacgttggccagggtacagccgggccctagccacatcctccacctctgccttcgccctccccatgggaaccccgcgggcaagcaagggctgtgggcccaggtcacgggatggggaggaggtggtggggagggcctttccctggggcatgcagctgggctgctggtgctgccgcctgcacagagggcgcctccgtggactttggcccagtcagcagccttccctttggggatgggctggggcagccaccctcaccaggagacccccgccttcctggacctgtcagagccttggaggaggtggggccccagagacaccccttctctagtacctcccctctccagtaagcatctcgttttgtggttctttctctcaggattcaaagaagattaagaaagttgccaaaaaaggtgagtgccgatggtggtgaccaaaggcagggattgtcaggaggacctgctgagggccagccctgggggaggccaaaggaaccaaagggtggggaatggtagcttctggcctggggagaggccacatccccccttagatccagtgttattatttcttctctgcagccctcagaccacagggcctgtgtgggtggtgaccagggtggggaaggcacctgtggtagagccatagcggggcaagagcttggagctggggctgcctggggctcatctggttccgaggtgtctgcctccagcttcaggccatcggcccttatttgctgtaagaggggcctgggcttgtcctgtggggagctggagaagcatctgaaatgggtgcgtctcaggtttgaggttcagaaagaacaaccaactgggagggagagaaaggagacagggagtgccgtgggaggtggctgcaaaaagcatgaggcccgatcatagcagagcaacccatcatactgaagccgaaaagtggaaacaggcccaacatggtggctcacgcctgtaatcccagcactttggcgtgcggatcacctgaggtgaggagttcgagaccagcctagccaacatggtgaaaccccgtctctactgaaaacacaaaaattagccaggtgcggtggtgggtgcctgtaatcccagctactcaggagactgaggcaggagagtcgcttgaacctggaaggcagaggtggcagtgagctgagatcgcgccatttcacgccagcctgaagaagtaaacgttggagggcatatgctgctggacttcaaaacccatgcctatatgaacatgtgatttgtgatacttatctgtgggttaagatggccttaaaaaggtttttttttttttaatctctttaatgtttggcttaattgaagacagctggattcttacagctacttctgcagtcaactgcttgcaatatgttgctgtaattgacgtgcacaaagaaaatccaacctcaggcccataattggaaaagagggagtattttaatagaccttaaaataatataatttctttaatattacaccaaatttgacaagtggtaatttcttaaaggttgttacaatgtgaaaacaatctatattgaatttttcataatcagattaaaattcattaatctagtttgcattttgaacggatattttaccatgcagtttgtaacatgcatgagttacttgtaaactacaggttaacagacttatgcagatattccaacagttgacacctgtcactatacattttccaaagatcacgttctttactatcaccacccacatcattagaaaggtctttgcgtattggaaaattggtaaattcatggtggcagatacaatgttgtctcatttttagggcaaatgttatacatttattgaaatgctttcagttgtttcccctgaagtgctataattacttcatttttaagaaaatatctgcagctgggctcggtagtgtacgcctgtgatcctagcacgttgggaggcctaggcaggcggatcacttgaggtcaggagttcgagaccaggctggccaacatggtgaaaccccgtctctactaaaactacaaaaaatagccggtcgtggtgacaggcgcctgtaatcccagctacttggaggctgacgcaggagaatcgcttgaacctgggaggcggaggttgcagtgagccgggatcatgccaccgcactccagcctgggcgacggagcacgacactgtctcaaagcaaaaagcagccagtcttgcaactcaaacagctgcgatttattaaatgatctaattaaatacaatttaattttatttcttattactgttaacacccgaggaccaaaactgtgctcccgctgggacagggtccagggcttgcatatgggatgggtcagggcggccgagaacgccagcccatccgtctcccggggctcatgctcgcacttaaattttctcagaaaagccgaaagccgtgattccgatctacgaaggcgattaccaccctgagcccctgaccgtagaggtgcagatccagctgaaccagtgccgctcggcggaggaggctctgcgcatgttcgccgtgtagggcgtgggcagtaaaggctgttcccagcactcccgcctccgcttctgtcccgccgcacgcgtcggggggcgggtgtggcgccggcgtcctggggaggaggagcagcctctgcccgacccggctcgtgcggaccccaggaccgggcgcgggacgcgtgcgtccagcctccggcgctgcggagacccgcggctgggtccggggaggccccaaacccgcccccgccagaaccccgccccaaattcccacctcctccagaagccccgcccactcccgagccccgagagctccgcgcacctgggcgccatccgccctggctccgctgcacgagctccacgcccgtaccccggcgtcacgctcaggtaggttgggggccgggacgccgctgctgtgagggaggctgggtcaccgtgcagggaggggcgtcgccagggcggccgtgcctttgcaccccgcggcccgctccccggtcccccagggtccccgcgaggacgccggccccgcccgggtgcggcgcgagtctggcctcggcgggcacggctcggggcccacgggccgctcggcttcggttctccaggctggggacagaggctggagccgggcgcggtagaccccgccagcctgggccgcccgcgcccgacgcgcagcgctgctgccaaccccggcccgggggtccccgcagagtgggtctctgctgccgtcagcccttcggagactgtcgcgttgaaagaatgaaccagagttcgccccctgcccgcgccagggcgttttgggtcaccgagtcctgtggggatccgaggcggctgccgcccaaggccgagcgcagcctcaggacccgcgccccaccagacggggtcgtgcgctccgcggcgggtggagagccgggctctggggtctccgcggctcggagggcggcggggcgaggccgtgcggccagcgcctggggacgcccgcggcgggacaggggccacccgggccgcggcgcagcctgggctgaaacctcctgggacggaaccaagccacctgctgtgcgcccttctcggtgaatggcaccgccgcccgcccgggcctctcgtccacagcccgcggtgctcgcacacctgagactcatctcgcttcgaccccgccgccgccgccgcccggcatcctgagcacggagacagtctccagctgccgttcatgcttcctccccagccttccgcagcccaccagggaaggggcggtaggagtggccttttaccaaaggtcagattctttcaccgcctctgccagacccccttgtcccccacccccgcatagatctccagggggctcagaaaactctggccggtggctcacgcctgtagtcccaacgctttgggaggccaaggcgggaggatcgcttgaggccaggagttccagaccagcccaggcaacaaaagataccacatctctacaaaaaataaattagccgggccctgcacgcctgtagtcccagctactggggaggccgaggccggaggatcgcttgaacccaggagttccaggctgcagtgagctataattgtgccactgcactagagtctgggtgacagagacactgtctcaaaaaaaaccaacaaaacccttagctctttcactagccgggctggcctcttcctactgtaaacctgctgggcccccgtctcccttctttctcccctctctcctgccctggagctgcctgactctgcccacggcctgcagagaccccaggtcttcacgcaaggtgccattcctcactcagttcttgctcaaacgtccctccatcaaggagggctttttagctacccttggctatgggatccgtcctccgcgtcagccaattctctgcattagactgtaacttctcaacatacctggttcctatgcgttttgtgctcccctctgagagggcagcgaccctgtcttgcttgccactgcatccctagcacctagcagttgcttttctggtgacggcggctgtggcagtggccaatgcggcagactggtcagaagtgaagggacaggatgacttggcagtggaggtcaaggggaggggactggggcagagggagacaccagagggacaaaaatgagaaactgaagacaggctttgctacgtggagctcgggcaggccacactggtggattctgtctcctcatccttcttttcaggtccctgggagaaatcagcacttagaacgtggtgggaaggcggggcggggtgcctcggaagccatccctgatacaagtccccagctttcctgcttcccctcttgtggtgtgtggctttgtctccctccctccctcctggaagccccgacctctgaggcaggtgtaaagggtgtgtgctttggtggccacggccaccctgtggtgctggttctcctccgagggaagcagtgcactcctggtcatcttggagacgcccaacacaggaccccacaggcaccaagctttttttgggaaatggtttcacttcccacttgaaaagccctgaatgtcagttccacacttagtgaatttgatccaagctaaactgagtctgtgcctaaaactcatcaggtgctcgagtttcctggaagaatggctgggaacgtttatggtgtcagctgtaaagtggctgcaagtccttttgggaaaaacagacccaggagtcctcagatgatggcagaggagggcaagggctggcaaagcagctgtgcttagcccatcctcaggggagggaggactctggaaagagcctgaggatacgctgagaataaaaagtccagaggccagcagggacttagcggctggggtgcaggttaactcctgcccaactcttggggacagggacccggggctgggccctgctcaggtggctctctccttgcagggaccggcgatgctctgcaggctgtgctggctggtctcgtacagcttggctgtgctgttgctcggctgcctgctcttcctgaggaaggcggccaagcccgcaggagaccccacggcccaccagcctttctgggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcagggtggggggatgggctaggggccggcagctgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggcggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaacccagctaacttgtccagcatatgttgaatgggagccaaagtgtagcaaatgctgccaggaacctgtcggggcattccgggcgctgcctggggcgctgcagtctgggacctcaaggaaggaggctgcataggaccccaggagagacgcattttctctttcagatgcaaacaaaatcttacactcttctcctttggatacaatagagaaacggaaagaaaggaaggaacaagaggcctgtgttaagtcctgttgatgttaagtcctgttgagagcaccaggtaaacactctgcaccccttctcttagtagtaataggtttttcactccttggcctcagctgtcctcacaggacagtgggggcagatcagagaacacatcagaaatacatacaaagaaatcgtacaaactggacaggttcccctccccctgccacaactggcatcccaacagagggaacaagtactaaatcatttttgacgacgtaaataagactgaaaacaggttaaacagttgctgaacttaagggcatgacaaaaaggactcctctctctgacccaggtaggcaaaatgctttgggtgtgaggtaaaaaaaatgggtaagagcagctgtacagagtggggtgaaatgttaaacagggtgcagtgcccaagggctaagaaccaggtccagcgcaagcctgagaccacaggaggcactcacagctcacaaaggcgtctcgcctgattggccagggcaggatctgccgcctcttctcggtgcacagacagtcatgccaaccctgggcagggtggcatctgcccctgctttccccactgagtggggagacagggcagtgtgctcaggccctcaatcctcacgcaggtaggcctcctgctccgactcagcccgctcctccccttcctcctgtg

SEQ ID NO: 36943 - DNA, 100749 bp, Homo sapiens
gcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaactgtgagtaatcaatagcgtctcttctcccttccccagcattgtcgactgaactgcgtgccctggttggtaggattttcttctctagagctgcagcctcctagaaagtttccagtaagtaccgacagacacccagcggatggaaacagccgtggatagagcaggcagtgcaatggtggggcaggatcactatttgcacagttgcgagaatgtattgcctacaggacagatctaagaacctagatgacactaagtatcaatggagggatgagaacacctgcccatttcccttcaaagctgaagttcccagtcagagaactaggatgagcagattctagcttatgagtagggaagaaaaggtaacacactgtgtcttccctttgtccaagcgcctgcccccaacctgcacccgtctcctgaaacctgcctcccttttgcaatttctggactttgagcttggtttgcttgtctcacattaacgaaatgttttaggatgactgagggtttgtatagcagtagatatatgtcactttctaaccctgaaatcaaaaggactgttaaatactgtattctatttctcagatcgtttgtactgaggattttttaacactgcatgccactgatctgaggtggtggcatgaattctttatctttgtgtttcaggttctttatgtccttatgcccggattcaagacaggatattgagttttctctgaaaaatatataaggaataccaaggcaattagtacattttagtggtcagttaatttgttttctaaagttgtaagtgtgtttattgaataaaaacgcctttttgtttgtttgtttgagggtgagtctcgctctgctgcccaggctggactgcagtggctggatctccgctcaatgcaacctccgccccccggcttcaagtgatactcatgcctcagcctcccgagcagctgggattacaggtgcctgcttcgacacccggctattttttttttttttttgtatttttactagagacggggtttcaccatgttggccaggctggtctcgagctcctgacctccggtgatccatccgccttggcctcccaaagtgctgggattacaggcgtgagccaccgcacctggccaaaaatgacttcttgttctatgttttattttcagggattggaacaggagtgagaactctgaattacaaataacttttaggagtctagagctccaaagtaaactttttgaagatggaaatttctagaaaattatatatcaatttgctaacattccactagtttctattagttagtcatcaggatgaatgcagtactttaaaaatctaacttgggactaaaacattattttttgatcttacattaaacagctacaattgcaaaacttcagcattcaaacccctatcattcagccaatttgtaactacatgcgcttattacctaaatagttcattaggacaattaaatatttgcttcatagctagtgttttggagaggagaaaggcaaagtagcttgccacacttaactccttgtcatcatagaaatttgctaggctttttctctttgtagagattgttacattttgactgaatctaggcagaggtaaaaattatatgggtttgtgtatgtgtattatatataaacatatggggaattacacttgttatatataacactgatagagcagataaattaattcttcaagtatatcacataaagaatagttggccccataatgctttcagttaaaagtttttgattgcttaattggattaaaagtcatctgtggtttacttatgaggaaatttggatatagatgtgatgtttttaatccatatgatttgattttactttatttttatttatttacttttttgagacggtctagttctgtcactaaggctggagtgcagtggcatgatcatagctcatggcaacctccccctcccgagctcatgggatcctcccagatcagcacctatctagcaccgcacccagctaatttatgtgtgtgtgtgtgtgtgtgtgtgtgtgtgtgtgtgtgtgtgtggtttttattttgttttgtttttttggtagagttggtgttttgccatattgcctaggctggtcttgaactccagggttcaagcggcctgcctactttggctgcccaaagtgctgggattacaggtgtgagccactgtgcccagcctccatatgattttaaatctgagatataattagagctgtaaatattttatttgtaattcattgtgtagttctttatttagaattatttatttatttatttatttatttatttatttatttatttatttagagatggagtcttgctctgttgcccaggctggagtgcaggagtgcagtggcgtgatcccagctcactgcaacctctgcctcctgggttcaagtgatccccccacctcagcctcccaagtagctggtattgcaccagctggcatgcaccaccatacccggctaatttttgtatttttagtagagacagggtttcactatgttggccaggctggtcttgaactcctgacctccagtgatctgcccacctcagcctcccaaagtgctgggattacaggagtgagccaccttatccagcctataattcattgtttaggccatagaaagctaaggacgattaaaaaaatatttttgtgattaaaaaaaatcttgcccagaccggagtgcagtggctattcacaggcactattatagggcactacagctttgaactcctggcctcaaggaatcctcccatcagccttctgagtgtctgggactgtaggtatgcaccaccatggctggcttatagttgtgatttaaagaaaaacatttacaaatcatagctttattttagaaagagttattagaaataatctaattcaacttatttgttttaaaaataaaaaaagaaattgttcagagatattaactaattttccagaatacatatatatacatacatatatgtatgagagagagagatgagaatctctatatttaacatatatactgtcacccggtcatagccgctcatgcctgtaatcccagcactttgggaggctgaggaggaaggatcgcgtgaagccaggagttcaagaccagcctgggcagcatagtgggaccccgtctttacaaaagaaattaaaaaaaaaaattagccggatgtgttggtacacacttgtaggcccagctactcaggggtctaaggtgggaagatcacttgagcccaggaggttgaggctgcagtgagcatgattatgccactgcactccagcctgggtgatagagcgagatcctgtctccaaaaataataaaaataaaatagatactgtctacatattttaatcatttcccacttaaggcatgtggtgaggaaataggagaaagaggatgtccctttggctgtgctaatttggccttatctagactgccaccctgggccagtgcaggctactctagacactactgactcatattttcctcctcttttgtaccctcttctttctttctctaactattccttttactagttatgaaggcttatcttttcttaaattatctttactaaaaagtccaaaatgttgcactgatggagagattttatcaaggttaggttacagttggagtttgtgctggaagagttagaaacaatttctaatatacagtaatacaacatcaaaccctatgccacattctcttactattaattctgtgctaagaaacaatagaccttttctgttcatcaagtttatatttttgcagcttgagcgatctatatacatacttaaaccttcaaaatattatgcctgataatacagtattctttgcctataagcaacagtaatgaactattgctaactaaaggaaagaaaaaaggaaaagaaaaaagagaggaaggaaggaaggagcagttaaataatttattggaaggctactgaatggctagctgaacagccaggcctacagaagccaggcctacagaaggaatgcgaacatttaggtgacctatacagtgggaactcatgtgacagtacttgaggagctgccaatcagatgactcaattctgtcttccagtcctatgtgtctctgtgaacagctcaaattcctaggaggccctgatcattttggcttagcctggcactggagtcctgtgatcgacagctcactagaattgcacagagtgccggaagaacagttcccacaaaagaatggatgctgggaaggacacagaaataagaaaagtctacatattctaattattggctgtctaacaaatacacttgcccttctttccatacacaccatttgaaaatatttatctgatataatgcaaataactactgcacagagaaagaaccctctcctcaattggttccaggcaccacattcagagaggaaggcttgaggcttccatttcctaggtatcatcaagtgatggccatgattcctgtatttctgtgctatgctttatggataaaatgatacattatagtgtaccaacacatcttatatgcaaaaaaaaaaaaaaaaaaagaaaacaaaagcaaaaacaaaaaaaacaggcaagggaatacaggtaatggttttagggcttgcctttctctcccttggttacaagcatgagctggtatttatgactctttccctacccatttcatagctctcttgccctcaggatgcaagtgcctcatgtttgtgtttgctcaataagatgaaccatagcatattcaggaagaatccgagcccttattgtccctacctgtgggtggtccatccattgtttcttttcctatttctcctgtggacagtagtcatcctggaggggcttcacacctaaccctgattagtatgtggcaacaacactattttgcctggattattgtcttccttctaacataatcctctgatttttatttctttattttttttcagcaggtaaagagcttcaaatggcaacacagcagtctgagcttataattcagtggaaaatatgttagatcccctagtgaatgcattccttggaaaccattcttggtttccaaatttgtaggtgagccgaatgcagttgtgaggacggaatgtaaaaaatttgagattaggtaactgtattagtcccctaggactgccataataaagtaccacaaagtaggtggtttaaacaacagaaagttgtggtctcacaattttgaagtctagaagtccaaaatcaaggtatcaggaaggttggtttcttctgagggctgtgaggggagaatatgtttcatgctttctcctagctcctggtaacctcagatgttccttggctttggggtggcattattcctgtgtcttcacatcgttttccctctgtacatgtctgtctctgtgcccacatttcccctttttataaggacaccagactcactggattaaggcctaccctaatgacctcatcttaatttgatcatctgcaaagaccctatttccaaataaggtcatatttacaggtactagggaattacaacttcagcatcttttggggtcagccatagcagtcattaaacatcatatcatgacaagtacttctttcctttttccctttattctggatctgtgtattttggctttagtaaaatagtgctgtattttattttattttaagccagtcaaatttgccagttggaggttgtgtatcaacttaatgatactaatattaacaagttctgataacccactactattggaccagcctacaatcttttatttatttatttatttattttttgagacagggcctcattctgttgcatgggctggaggagtgcagtagcacaatcatgtctcactgcagcctcgacctgccaggttcaagggatccttccacctcagcctcccaagtaactaggactataggtgcatgccattacaccaactaatgttctttttgatttttagtagagatgagatcttgctatgtttcccaggctgatcttaaactcctggactcaagggattctctggcctcagcttcccaaagtgctgggattacaggtgtgagccactatgcctagatagcactatattttaatgattgctggtacagagaacataccatattttttaaaaccatattttgaaagatagtgttgtgtcttacagtgagtgagccctctataattggtgagttcatcattccataaggttagctccttccagatattaggatatacactaaggccaaggaaaactataatccttccactgatttgttttaattgtggtgttaaatccttagaggtagtgttgtgtggcttagcataaagcattgaataagtctaccaatagttgtgctgacagaaaaattaaatcccaataagtgtctctacctatgctgctcctccatgatggaagagcccttcttaatcaacaatctaccggataatctgattgaactatgtgatatgttcaacttttagcagctcgaggaatagcaatcctgcagaaaaatttggtgtttttacttttataaggagagtctgggtgggccttagtgaaggaaagttcatgtggcagatccagtgtggccaatgtgtagcctccatccttgccactgtggcttcctttttaaataaatattggataaacattagactgggggcaacccgaaagccatatgtggcctataaacttctgtgtttggcccttatacgtttcaaaaattggaacatttcatgtcaacatttggttttatggcttctcttgagaaacaatgaaggaacatctgacaacactggcgcacatcccaacatggtaagattcagctgaagctgattgtgagctgccttcttcttttttttttttttttttggaacagagtcttgctctgtcgccctgcctcagcctcctgagtggctgggactacaggcatgttgccaccacgcccagctaatttttgtatttttagtagagatggggttccaccatgttggccaggctggtgttgaactcctgacattgtgatccacccgccttggcctcccaaagtgctgggattacaggtgtggtgatctgccttctttagatagaatgtgcccgctgcagtttgctacaatgctgagcatctcccattgtctttaaccaaattatcttcctttgtttatgctgcctactggacacttagaatttttagtttgtggtccttgcactagatagtcttgagaggaaacataactgatggtcattaagtaggtcattctgccatcattattactaataacttctctggtgtggtgctgtcttgtgaatgttcacctggaacacaaacattctcatctctgggacaattcttgcttgaacttcgtccctaagcctgtgatctacctctttacaagtcactgaacctctggaaagaccatttgcaaccatctcaggcaatttctcattgtaggcaaagtgaacaatgagaaatgccacttatatgtctgcccatagtgagggttttgcttctccagtgcctctcaggaccacccctgagagaggttagtttgttagtttttggctgtagctttataggaggtatacatctggctcatattggtataccacagagaggcgtctgttgatatggttaggatgttttgtcccctccatatctcatgttgaaaagtgacttctggccaggcgcagtggctcatgcctgtaatctcaagtctttagcactttgggaggccgaggcaggtggatcacttgaggtcaggagtttgggatcagtctggccaacatgatgaaaccctgtctttactaaacatacaaaaattagccagatgtggtggtgcccacctgtaattccagctactcaggaggctgaggcaggagaatcgctgggacctgggaggtgaaggctgcagtgaatcgagatcatgccactgcactccagccttggtgacagaatgagactctataaaaaataaaaatagaaaagaaaagaaaagtatcaggttgttaccggggggtccttgctcacagagctcccaagatggtggtgagctgcttccaagatggtggcaggcagcttccaaggtggtggcaagcctagtgttctctgacctggggttcttggcctcatggattccaaggaatgtaatcttcggccatgcagtgagtgttatagctctattagaagccttgggtcacagaagagaaccgtagaacccagtgactagtgttcagctcgattaggacaaacccgggcacttagccatgcaggaacaatggcaagcctttagccagatcaggagcggcaatgggcgcctcgctggatcaggagcacagcggacacccttccggatccggagggatgggagtcagcagcgggtctgcgacggcggcaaacagcagttgtggacggcgagcaaaagctcagcttgagccgtaacaaacacagaccagaagagggcagttgcaagatttaatattgtgaaatagagtgaaaacagagctcccatacaaagggaggggacccaaagggggttgccattgccggctcgaatgcctgggtttttatcccgatccttgtccctcccgctgtgctctcaggcaatagttgattgactatttctttacctcctgtttttgcctaattcgcattttagtgagctctctgattggtcgggtgtgagctaagttgcaagccccttgtttaaaggtggatgtagtcaccttcccagctaggcttagggattcttagttggcctaggaaatccgaacctgccctcaatatttcaacataggttctttctattttccataagtgttggctggctgagaaataaagagaaagagtacaaagagaggaattttacagctgcacctccgggggtgacgccacgtatctgtaggactgtgatgcccacctgaccctcaaaaccagcaggtttttattaaggatttcagaaggggagtgggtgtaagaacagggagcaggtcacaaagatcacatgcttcaaagggcaaaagggagaacaaagatcacaaggcaaagggcaaaagcagaattactgataagggtctttgttccgtggtgcacatattgtcttgataaacatcttaaacaacagaaaatagggttcgagagcagagaaccagtctgacctcaaatttaccagggtgaggttttttccccaccctagtaagcctgagggtactgcaggagaccagggtgtatctcagtccttatctcaaccgcataggacagacgttcccagagtggccgtttataagcggccccccaggaatgaattcctttcacagggccttaatattaatattccttgctaggaaaagaatttagcaatgttctcctacttgctcatccatttataggctctctgcaagaagaaaaatatggctgtttttgcccaaccccgcagggagtaagaccttatggttgtcttcccttgttccctaaaatcactgttattctgttctttttcaaggtgcactgatttcatattgttcaaacacacgttttacaatcaatttgtacagttaacacaattatcatagtggccctgaggtgatgtacatcctcagcttaggaagataacaggattaagagattaaagtaagacaagcataagaaattataaaagtattaatttgggaactgataaatgtccatattaaaatgaaatcttcacaattcatgttcctctgctgtggctccagccggtccctccattcagggtccctgacttcctgcaacagaaaagaaagaaaaggaaagggaacggaaggggaggggagggaaggcacctccattgtaggaggtggtgcctggtgggaggtgttttggtcatgggggtaggtcccttatgaataacttagcaccagcccctaggtgatgagtgacttctcatatgagattcacagaggttcacgtgagatctggttgtttaaagtctgggacctctccttctagctcgcgctcccattctggccatgtgatccactgctccccttttgccttctaccatgattggaagcttcctgaggccctcaccaggagtagatgctggcaccatgcttcttgtacagcctgcagaatggtgatcctattaaactccttttctttataaattatccaccctcaagtattcctttgtagtgatgcagacagattaacacatctgtaagccagagattagttggtcatagatctcttcttatgagaccaatgagggggtttgagggtgaggaggaagtcaagagagtgaccaacctgtgttggcaactaagttatgcctttaggctcatcttatttataacagttgagcatggtttatgctatcacaactacatagctcaatggaaaagacagcatcccgcttatgatgagctgtttacatctcatggtcaccaggtgtcagatagtcagattttcagactccacttaagtcccaaaaaacaaacaaacaacaaaaaacccaagagcagtttctcaaaagaaaacgaattgcttgctgaaggaaatgagacttgcacaaatcgtggagatctctactgaaatttctcttctggaacttgctgcagcttctgaagaggaccttgctcttcagaaaatttgagcacaattggatctgatggatcattggctaggccaagtgacagaccacttgatttgaactttgaactagctggagagcattctcttactatggttcccatctatatttggcagcctttcgactcctgtggtaaatagatcatagtagaaaaccttaaaatggaatatgcctcaaaaataagacatctaccaaaatttattcttctaccttagtgatggacactcaggtacataacaacttctctcacttctgcaggaatgttccaacatgaccaaactcttgctgaagagtccactgagagtccactgctctcagtcctagggaaggaatgaaagctttgggtttgagtctgattaggcctatagttagatggttttaggacagaattctgcttatcagctgacttgcataagcctcaattccaaccagcataccttaatcagcatacattaggtcttagacattttgcttcctcaaagcccactatctaataatcactaaaggtttttgggatgtttctcttcagtgtagttattcaggtaagatactttagtttggagaaactgggagaaaagcttatagtatgaaactgtaacagaaggatacttccttaagggcctctctcctctccttcactcaagaggttctggatcagtcagataactcaaaattggtgattaaggagaggcagtgatttatttttattgtggttgaagtacagcctctatttgctagtatagggagtttgtgcatgaaacagtgaagaaatcggtgggttgtctattcatctcaatctcgtgagatctctgcttgttaatcctttctccaaaatgtgatcactacacacaccccagtttttgttcaggtgagtaagagctgctaactaagctcagccacccctgtttcttcccattccacttgaaatctgggggctcatttccattgctgtccctcccaccagcatgtttgatctagggagaactgccagtaaaatgcttattaaaaattccagtggtttctccaataatcgtttttcacaggatcagtgaaaatgtagtcttctcttctatattgggggagagtggggatgattgaggaggagagaataggtaggggtgacgtaaaaaattcaagccagaatttctgtctcctagtctttttgaattctttctgttacattatgccaaggaatgtctggcttttcaatgttatttggtgtgtgccaagattggtctaggatggcattagccaaccaagccaactgttagaacggaagctggcagccctagctagcaaatggaatgaaagcagcaatattaccacattcagcctgattaaaaattatgctatctctttttgtattcattttctattgctttgtaacacattaccaaaaatttaacagcttaggaaaacacaatttattatctcacagttgcataggtcaaaagtccaggcacaaatccagttaagttgctcagaatctcacaaggctaaaatcaatgggttggtcatggttgagatctcatttgaagcttgaagtccacttccaggcttcctgattgttgggagaattcagttcctcacaagtgtaggattgaggccctcagctcctgagacctctcaccattcccgccatgtggccctcaccataacatggcaatttgcttctataaaatcaattttaaaagcatcagctgctgctttttgtctcctatcactgtttctgcaatctgaatttggcatgcaaagctcaaaatctaggggattccagccttatctcttcctacaactgacctttccctgcttctcctctcaaaatggaccattctctgtcccttctcccctatggccttttcacatgctggtccttctgtttgaaagacaattcctctttgtcatcctcccagtcatgccaggtgatctatccaaagactattcaagttttaacatactttatgattttgtttcccttttttagaatcatgaattgaactatcataaagctttgcagggtcttaatttttccatttaaaggataatttagaaaagtgttttttttttctcaatagctagtctctaatatttaaaaaaccgcctttgtttttttttcttttgcccttttgttttattggttattttattcaaggaataaacctgaacaactctattttatctatgtgtttttacttttattagagccctctgatttttattattaacaaagaaacaagcacattattgaataacctctgttacaggtattagtttaaatgtttcatacctttatattagttaagataagatggtctatgaagtgataacacattaatcctcaaatctccaaattgattttcaaatttctaaatcttgatggcttggcaaaataagagattatttcttaaccatataaagttcagtgtggtttgcataaatctctttcatctttagttataccatctggaacacatagcatccaaagttcctgcaaaaaaaaaaaaaaaaaaaaaaaaaaaaaagagcaatggaggtggtgtacttgtttttaactgcctcagcttaaaagtgacaaacgcagccagacgcggtggctcacggctgtaatcccagcactttgggaggccgaggcgggcggatctcagggtcaggagattgagaccatcctagctaacacagtgaaactcatctctactaaaaatacaaaaaaattagctgggcatggtggtgggcacctgtagtcccagctactcaggaggctgaggcaggagaatggcgtgaacccaggaggctgagcttgcagtgagctaagatcgtgccactgcactccagcctgggcgacagagcgagactccatctccaaaaaaaaaaaaaaaaagtgacaaacgcacttctgcttatagttcaaatagttaaaactcaatgaagcacatggaatatttcttcggcactatgtctgttagaaacattttctcttaaggttgaaattaatgtattttcctctaagagaagtataaatacttattgcctatttaacctttggtaatatatattacaaagtgtgtggttgttttaattatctgaataaactttgtgatagagggagggcataatttactatgcctgctaacacaccagctggtagttacttagtattattacactgagttggctattaatgtagcagaacgaaaaaatatggtaacagctgatattgaaattactcctatggtgagaactgttgttacattagaaattaccttgaaaagaagcttgagttttggaaagtgaagtccctgaaacatggtctataactttgctattccagtatggtccgtggaacatcagcatcaggtttacctggggacttaactaaaaatgaaatatatctggccctaccctggatgtactcatccagaatatgcatttaaacaagactttcaggtaatttctatccacatttaaagtttgagacaatctagtttttaatgagatagagaagatagataagtgaacaaatttttgcagaatggccagaggtggcaattagggcaagagaagaggaaatgtcagagaagggagaaagaaagctgagcaccatggcaagagaatgcagcttgtggagaaggtctccagtgagaaattactagatgtgaggtgggtaaagacttttaggaatgggcatttcttttttctttcttttattatttttaaattcctttttttggttgttgttattttgagaaagagtcttgctctgtcccccaggttggagtgcagtggtgtgatcacagctcatcgcagcctcgaccttctgggctcaagcaatcctcctgcctcagctcctgaatagctgtgactacaggcttgagctaccatgcccagctaattttggccatgttgcctaggctggtctccaactcctgagctcaacggatccttctacctcagcctcccaaagtgctgagattacagatgtgagccactgcacccagtaaaagtggcatttctaagtttcaactttaaattacaaaagttgcttaaatataaacaactgaaccctgaattcctctgcctctagtgttttcaaaaagtgtcaattttcacatctaaattgattacgtactccattagtctgttttcatgctgctgataaagacgtacccgagtctgggcagtttaccaaagaaagaggtataactggactttcagttccatgtggctggggaagcctcacaatcacagtggaaggcaaggaagagcaagtcccatcttatatgaatggcagcaggcaaagagagaatgaggaagacgcaaaagcagaaacccctgataaaaccatcagacttcatgagacttattcaccaccatgagaacagtatgggggaaaccaccccagtgattcaattttctcccaccagttgcctcccacaacatgtggcaattatgggagttcaattaaagatgagatttggatggggacacagagccaaaccatatcaagtacaaagaaaagagtctcataagatgcaagtgaggaagaggttagtgaaagctaatctacaaaaccaacagtgactatccacaagaatgaaggaatgcagaggttttgacagatgttggaattttatcaaatgtaggattgggtttcatatcattattcagtgaatcaaaaagggcaggatgatgtttgacattagcaagacctaaactatctttacattattaagctttgattgagattaacattgcattaatctaaaagaaaacaacctttgcgatgaaaaaaagtcttgacccttgttctgttagatgacacaaattctttttacctaaatattcctgttttattaggttttattttacatatatcttacaaaaacatataagtaaaaataataatttaggggggttgggtgataattcaatatttttattttattttattttattattattatttttttgagatggattcttgctctgttgcccaggctggagtgcagtggcatgatctcggctcactgcaacctccgcttcctgggttcaagtgattctcctgcctcagcctcctgagtagctgggactacaggcatgcaccactgtgcccagctaagttctgtatttttttagagacagggtttcaccatgttggccaggctggtctcgaactcctgatccaggtgatccacccgcctcagcctccagcagaactgtgagccaattaagcctctttttaaaataaattgcccagtcttaggtatttcttcgtagcaatgtgagaatggcctaatacaataagtgatttgagcatccttggatttttatatctgccggggtcctggagccaatcccccaagaatactaaaggacaaccatgtttatagggtacaatgtagtgttttgatatttttatacattgtgaaacgatcaaatcgtgcaaattagcatatccatcacttcaaatatttatcatttctttgtgttgagaacatatgaagtcctcttttagttgttttgaaacatacaatccattattaaccttggaatttagacctttgggtctcattgtataactttccctggcttacactgctagctgtaagccagtgattctctaatattttaaaactattcaagaaagccatgtttaatgcaatctaatttgaaaatacagatatgcaataaaaaatgcatctgtagtaccactgaccagagaccaatgtaacattttgctctatgttcttctaagcttttgtccacacatatatattcttagaaatgaaaatacatggaattgtgctctatataatttttgtaacttgatgtttcatatcataaaactatgatgattgtttttgtatcagtaagttaaagtctatatcaccctttaaaatagatacataattttcctttatatgtgcttattataatatatttaaccaaaactatattttcggacttttagattatttccaatgttttgcttatatcaattatattgtaatgaacatattcatatatagttcttcatatatatatattcatgtttatttcctcaggttaattttctagaaatagaattgttagctgaatgtctatatagtgtgcctattttgaaggtttgggatacatattgttaaatttcctcctgggaacgtgcttttgaaggtagatttaaagggtgtcttgttcctctcatctttgccaaagttggacattaacttcattttaaatctttgttaatgcaagcatagtaaagattttttagtgaggtagagggagtggatggagtggatgtattagtttgatgtgagacttgcccaaaatgctttaaaaaacttggcaaatactggaatctctggatcacaaagtgagggtaagaagaccacaaaattcagtcacaaatgttaatgtacccttgtgtatccactatcttgtgaggcttgaaagaattctgataacgtgtgtgtgtgtgtgtgtgtgtgtgtttgtgtgtgtgtgtgtgtgtgtgtgtgtgtagagagagagagagagagagacagagagagagagagacagagagagaatcagtctgttgcccaggctggaatgcagtggcatgatctcagcttactgcagcctcagcctcccaggcttaggcaatcctcctacctcagcctcttgagtagctgggactacaggcatgagccatcatgctgagataaatgtttatgtttatttctttttttctttgaaaatacacaatttaatagtaaaattgctgcaccttataaaattcttgagaaccaaagatgagttaaattattattctttctagagtataaccaaaagtttcccataaaaattagcaaaattgaaagataccaataaaagatactactatcctaccgctgtatatttgtagatacctttgaatagcattatgaaaattattaaaataagtgcttctgaatcttcatttcactgagaccatttatttactatcatggatggaaactttcttctgattataattcagtctatttacattaaagcaaaaccatgggaattgatctttttaaatcttctgttatatagtcaggatagagtcaaatagtaaaccaagtgttcaatatatggtcagttctgttaagcaaattctgcccattgtgcatattcatcagtgtaaaattgaatatctgtagatatagccaacttaaaatatatattttgattgtcagactagatgattatctttcgtcctccatctgaactgttcaatactccaaattaaaataatggtaatgacaattgcctgcagaattttctttgcctttcttttttttttttatactttaagttctagggtacatgtacacaacgtgcaggtttgttacatatgtatacatgtgccatgttggtgtgctgcacccattaactcatcatttacatcaggcatatctcctaatgctatccatcccccctccccccatcccatgacaggccgtcctgtgttatgttctccatcccgtgtccaactgttctcattgttcaattcccacctatgagtgagaacatgcagtgtttggttttctgtccttgcaatagtttgctgagaatgatggtttccagcttcatccatgtccctgcaaaggatatgaactcatccttttttatgactgcatagtattccatggtgtatatgtgccacattttcttaatccagtctatcattgatgggcatttgtgttggttccaagtctttgctattgtgaatagtgccgcaataaacatctgtaggcatgtgtctttatagcagcatgatttataatcctttgggtatatacccagtaaggggatggctgggtcaattggtatttctagttctagatccttgaggaattgccacactgtcttccacaatggttgaactagtttacagtcccaccaacggtgtaaaagtgttcctatttctccacatcctctccagcacctgttgtttcctgactttttaatggttgccattctaactggtgagagatggtatctcattgtggttttgatttgcatttctctgatggccagtgatgatgagcatttttcatgtgtctgttggctgcataaatgtcttcttttgagaagtttctgttcatatcctttgcccactttttgatggggttgtttgattttttcttgtaaatttgttgaagttctttgtagattctggatattagccctttgtcagatgggtagattgtaaaaattttctcccatcctgtaggttgcctgttcactctgatggtagtttcttttgctgtgcagaagccctttagtttaattagatcccatttgtcaattttggcttttgttgccattgcttttggtactttagtcatgaagtccttgaccatgcctatgtcctgaatgctattgcctaggttatcttctagggtttttatggttttaggtctaacatttaagtctttaatccaccttgaattaatttttgtataaggtgtaaggaagggatccagtttcagctttctacatatggctagccagctttcccggcactatttattaaatagggaatcctttccccatttcttgtttttgtcaggtttgtcaaagatcaggtggttgtagatgtgtggtattatttctaagggttctgttctgttccattggtctatatctctgttttggtaccagtaccatgctgttttggttactgtagccttttaatatagtttgaagtgaggtagcaagatgcctccagctttgttcttttgtcttaggattgtcttggcaatgcgggctcttttttggttccatataaacttcaaagtagtttcttccagttctgtgaagaaagtcatcggtagcttgatggggatggcattgaatccataaattaccttgggcagtatggccattttcgtgatattgattcttcctacccatgagcatggaatgttcttccatttttttgtgtgtcctcttttatttcgttgagcaggggtttgtatttctccttgaagagctccttcacatcccttgtaagttggattcccaggtattttattctctttgaagcaattgtgaatgggagttcactcatgatttggctctctgtctgttattggtatatagaaatgcttgtgatttttgcatattgattttgtatcctgagactttgctgaagttgcttatcagcttaaggagattttgggctgagacgagggagttttctaaatatacagtcatgtcatctgcaaacaggggcaattggacttcctcttttcctaattgaatacaatttatttctttctcctgcctgattgccctggccagaacttccaaccctattttgaatacaagtggtgagagagggcatcccggtcttgtgccaattttcaaagggaatgcttccatttttgcccattcagtatgatactggctgtgggtttgtcataaatagctcttattattttgagatacatcccatcaatacctagtttattgagagtttttagcatgaagagctgttgaattttgctgaaggccttttctgcatctattgatataatcgtggtttttgtctttggttctgtttatatgctggattacatttattgatttgtgtatgttgaaccagccttgctttccagggatgaagccaacttgatcggggtggataagctttttgatgtgctgctggattcggtttgccagtattttattgaggatttttgcatcaatgttcatcagggatattggtctacaattctctttttttgttgttgtgtctctgccaggctttggtatcaggatgatgctggcctcataaaatgagttagggaggatttcctctttttctattgattggaatagttccagaaggaatggtaacaactctttttatgtctggtagaattcagctgtgaatccgtctggttctggtctttttttggttggtaggctattcattattgcctcaatttcagagcctgttattgatctattaagggattcaacttcttcctgatgtagtcttgggagggtgtatgtgtctagcaatgtatccatttcttctagattttctggttgatttgcattgaggtgtttatagttttctctgatggtagttagtacttctgtgggattggtggtgatatctcctttatcattttttattgtgtctatttgattcttctctcttttcttctttattagtctcactagtggtctaacaattttgttgatcttttcaaaaagccagctcttggattcactgattttttgaagggttttttgtgtctctatctccttcagttctgctctgatcttagttatttcttgccttctgctagcttttgaatgtgtttgctcttgcttttctagttcttttagttgtgctgttagggtgtcaattttagatctttcctgctttcttttgtgagcctttagttctataaatttccctctacacactgctttaaatgtgtcccagagattctggtacgttgtgtctttgttctcattggtttcaaagaacatctttatttctgccttcattttgttatgtacccagtagtcattcaggagcaggttgttcagtttccatgtagttgagtggttttgagtgagtttcttaatcctgagttctagtttgattgcactgtggtctgagagacagtttgttataatttctgttcttttagatttgctgaggagtgcttttcttccaactatgtggtcaattttggaataagtgtgatgtggtgctgagaagaatgtatatcctgttgatttggggtggagagttctgtggatgtctattaggtcctcttggtgcagagctgagttcaattcctggatatccttgttaactttttgtctcattgatctaatgttgacagtggggtgttaaagtctcccattattattgtgtgggagtctaagtctctttctaggtctctaaggacttgctttgtgaatctgggtgctcctgtattgggtgcatatatatttagggttgttagctcttcttgttgaattgatccctttaccattatgtaatggacttctttgtctcttttgatctttgttggttaaaagtctgttttatcagagactaggattgcaacccctgcttttttttgtttcccatttgcttggtagctcttcctccatccctttattttgagcctatgtgtgtctgtgcacatgagattggtctcctgaatacagcacactgatgggtcttaactctttatccaatttgccagtctatgtcttttaattggagcatttagcccatttgcatttaaggttaatattgttatgtttcattatgatgttaactgtttattttgctcgttagctgatgcagtttcttcctagcatcgatggtgtttacgatttggcatgtttttgcagtggctggtactggttgttcctttccatgtgtaatgcttccctcaggagctcttgtaaggcaggattggtggtgacaaaatctctcagcatttacttgcctgtaaaggattttatttctccttcacttatgaagcttcgtttggctggatataaaattttgggttgaaaattcttttctttaagaatgttgaatattggcccctactctcttctggcttgtagattttctgccgagagatctgctattagtctgatgggattccctttgtgggtaacctcacgtttctctctggctgcccttaatattttttccttcatttcaactttggtgaatctgacagttatgtttcttggagttgctcttctcgaggagtgtctttctggcattctctgtatttcctgaatttgaatgttggcctgccttgctaggttggggaatttctcctggataatatcctgaagaatgttttcccacttggttgcattctccccttcactttcaggtacaccaatcagacatagatttggccttttcacatagtcccatatttcttggaggctttcttcatttatttttactcttttttctctaaacttctcttctcacttcatttcattcatttgatccattaggtcatttaagctcttctctatgctgtttattcctgttagccattcatctaatcttttttcaaggtttttagcttctttgcaatggattcgcacatcctcctttaacttggagaagtttgttgttactgatcgtctgaagccttctctcaactcatcaaagtcattgtccatccagctttattctgttgccagtgaggggctgcattcctttggaggagaagaggagctctgatttttagaattttcaggttttctgctctggtttctcccgatctttgtggttttatctacctttggtctttaatgatggtgatgtacagaagggattttggtgtgaatgtcttttctgtttgttagttttccttctaacagtcaggaacctcagctgcaggtctgttgggctttgatggatgtccactccaggccctattttcctgggtatcaccagtggaggctgcagaacagcaaatattgcagaacggcaaatgtcgctgcctcacccttcctctggaagcttcgtctcagagggacacctggctgtatgaggtgtcagtcggccactactgggagatgtctcccagttaagctacttgggggtcagggacccacttgaggaggcagtctgtcggttctcagatatcaaactccgtgctgggagaaccactactctcttgaaagctgtcagacagggatgcttaagtatgcagaagtttctgctgccttttgttcagctaagccctgcccctagaggtggagtctacagagacaggcaggcctccttgatctgccatgggctccacccagttcgagcttcctggctgctttgtttacctactcaagcctcagcaatggcagacgcgcttccccccagccttgcttctggcttgcaatttgatctcagactgctgtgctagcagtgagcaaagctctatgggcgtgggaccctccgagccatgggcgggatataatctcctggtgtgccatttgataagaccattggaaaagcgcagtattagggtgtgagtgtccctattttccaggtactgtctgtcatggcttcccctggctaggaaagggaattccccgaccccttgcacttcccgggtgaggcaatgccccccctgctttggctcacactctgtgggctgcacccactgtccaacaagtcccagtgacatgaacccggtacctcagttggaaatgcagaaatcacccatcttctgtgttgctcatgctgggagctgtagactgaagctgttcctatttggccatcttggaactcctttctcgtttctttcaacttcttaaaatacccttattagtctttttttccctcttttatgaaatgcctaattatgttgttagtttatttttttagtagagctttttttcttatagatttgtatattttctgtatatattaaaagtattaaatttctttcatgtaagtggcatcttttttcctactttgcaccttgatttttactagtacagattgtgtttttggatgcagacatttttgctatttatgagccaaatctgtttttgtatttttcttttcaattttgtctttagtgtggtataaaggaatgtctctcccatcccaataatgtatcaatatagtaaaatcctgccaaatgtggtaagtggggtacgaaatactcaattttataaaagtaggtgacattgattgtgagtttataaaaatgacagaagtgaacctatgtagctaactgtccaggtttcgggtctggcttcaatatattaaggttcctattgtggtgtggcactgcctaatattgtctgcttagcttaaatgttgatgagaatgattcttggtcctggcccttactgagactttaaggacagcagcgatgtattctaggaatctcctgcttagtgagtgcctgtttctccagagcaatttagagacattggtccatgagaatcctggagcctgataaacacatgttccatgaactgttattctgttactgtgccatgcttgcaatgtttttatttctctggcacatttttaatatctgaaaaatgtaactaacaaccagatacttgctaccagatattttcataaaatcaggaacatggaagaaatgaataagagaaatgtatagagcaaataacctcaaaggaaatagaagtaattgaagtcatggaaggtatcttttaaaaattgtaactaatatactaaataaaataaatgtgagcagatctggcacgcataaaacaaaaataggctgctatggaaaaggaaaattagagaactaaaatataatctttagacttaaaaagttattttcatttatattctgtttctaaacattattgtttattgttctaaatagtctttataaacaacataaaattctaaaaaacaacagtttgtgcttttgagtgaaattacatcatatgtttattggctgcataaaagagacttagactcccacacaataataatgggagactttaacaccccattgtcaacattagacagatcagcgagacagaaagttaacaaggatatccaggaattgaactgagctctgcaccaagcagacctaatagacatctacagaactctccaccccaaatcaacagaatatacattcttctcagcaccacattgcacttataacttcttatttcaatcatactttagttctcaatttttttcttttcattgcagcctactttttttttttatggatggcagagcctctcaaatttgtttaggatattagctacagattttaaaatgttttcttctgtgtcttcaattacctctattttcttttgggtcattcttgtttatttcttccatgctattaactgtatgcaaatatctggcgatctttgattgttagtttatatgttttgaagaaagtcctaagtaagctgggtaaactaggtagttggcatgggttcttttgcttttgtttacatctgtttccccaacaggactttctcttaattcagaaaattgttatcagtcctataactgggcacatgtatcaataaccaggcttctatttaggtgcctatgtgaaaattgtgcaagggcaatgccaaggtaaggggggagagtatttatctttgaaaataactctttctaggctgggtgtggtggctcacacctgtaattccagcaactttgagaggccgaggcgggcagatcacgagatcaggagattgagacaatcctggctaacacggtgaaaccccatctctactaaaaatacaaaaaaattagccgggtgtggtggcaggcgcctgtagtcccagctactctggaggctgaggcaggagaatggtgtgaacctgggcggtggagcttgcagtgagccgagatcacgccactgcactccagcctgagcgacagagcgagactgtctcagaaaaaaaaaagaaaataactctttctagttgctttatcggctttctcccaaactttaagtgagatgaaatttggagtgactggaagtcctgctctttgtcatcccagatccacagagggaaccttccctcatgatgttatccctatctttagggagcagtttttaggttttattttaagggctagaatcctggtttctgagcttctgcaaacagaagagggagagagggagacttaaactgttttgttattctgaatggagttgtatagttaatgtgatgcttattctcagcatctgttgattccagatccttgagaaattgccacactgtcttccacaatggttgatctagttcacagtcccaccaacagagtaaaagtgttccttcctatttctccacatcctctccagcactgttgtttcctgactttgtaatgattgccattctaactggtgtgagatggtatctcatcgtggttttgatttgcatttcgctgatggccagtgatgatgagcattttgtcatgtgtctgttggctgcataaatgtcttcttttgagaagtttctgttcgtaacctttgcccactttttgatagagctgtttgattttttcttgtaaatttgcttaagttctttgtagattctggatattagccctttgtcagatgggtagattgtaaaaattttctcccatcctgtaggttgcctgttcactctgatgatagttttttttttttttttttttctgtgcagaagctctttagtttaattagatcccatttgtcaattttggcttttgttgccactgcttttgatgttttagatatgaagttcttgcccatgcctgtggcctgaatggtattccttaggttttcttctagggtttttatggttttaggtctaacatttaagtctttaatccatcttgaattaaattttgtataaggtgtaaggaagggatccagtttcagctttctacatatgagtagccagttttcccagcaccattttttaaatagggaatcctttccccatttcttgtttttgtcaggtttgtcaaagatcaggtggttgtagatgtgtggtattatttctaaggtttctgttctgttccattggtctatatctctgttttggtaccagtaccatgctgttttggttactgtagccttttaatatagtttgaagtcatgtagcatgatgcctctagctttgttcttttgtcttaggattgtcttggcaatgcgggctcttttttggttccatataaacttcaaaatagtttcttctgattctgtgaagaaagtcattggtagcttgatggggatggcattgaatccataaattaccttgggcagtatggccattttcgtgatattgattcttcctacccatgagcatggaatgttcttccatttgtttgtatcctcttttatttcattgaggagtggtgtgtagttctccttgaagaggtccttcacatctcttgtaagttggattcctaggtattttattctctttgaagcaattgtgaatggcggttcactcatgatttggctctctgtctgttattggtatatagaaatgcttgtgatttttgcatattgattttgtatcctgagactttgctgaagttgcttatcagcttaaggagattttgggctgagacgagggagttttctaaatatacagtcatgtcatctgcacacagggacaatttgacttcctcttttcctacttgaatgccctttatttccttctcctgcccaattgcccaggccagaacttccaacactattttgaataggagtggtgagagagggcatccctgttttatgccagttttcaaagggagtgcttccatttttgcccattcagtatgatattggctgtgggtttgtcataaatagctcttattattttgagatacgtcccatcaatacctagcttattgagagtttttagcatgaagagctgttgaattttgctgaaggccttttctgcatctattgagataatcatgtggtttttgtctttagttctgttcatatgatggattagatttattgatttacatatgttgaaccagccttccattccagggatgaaccccacttgatcatggtggatagctttttgatgtgctgctggattcggtttgccagtattttattgaggatttctgcatcaatgttcatcagggatattggtctacaattctcttttttttgttgttgtgtctctgccaggctttggtatcaggatgatgctggcctcataaaatgagttagggaggattccctctttttctattgattggaatagtttcagaaggaatggtaccagttcctgtttgtatctctggtagaattcatctgtgaatccgtctggtcctggacttttttttattggtaggctcttaactattgtcttaatttccaagcttgttattcttctattcagagattcaacttcttcttgggagggtgcatgtgtcccagaatttatccatttcttctagattttctactttatttgcatagaggtgttcatagtattctctgatggtagtttgtatttctgtgggatcggtggtgttatcccctttatcattttttattgcgtctatttgattcttctctcttttcttctttattagtcttgcaatcttctttattattctatcaattttgttgaccttttcaaaaaaccagctcctagattcattgatttttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctccaatatactgctttaaatgtgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcattgtggtctgagagacagtttgttataatttctgttcttttagatttgctgaggagtgcttttcttccaactatgtggtcattgatgtggtgctgagaagaatgtatattttgttgatttttctcaagtcagttttcttggtctttttcatgttactaatagctgttttcttccatatttctgatgattttttcgttgtgttttcatatataaacagcaaaactgggttagttttaggtggcaggtgtagttttcttctgctgttttatgtatttatctggtttcgtgttagtctttcttctaaatgggagagttatcagttagttctctgtacatttattattttcttgtatacatatgcaatgaatgtttattgggcccagtctgattattttactgtcacactcatctgtgtgaagtgactaccaaacaggctttgtgtgagcaataaagctttttaatcacctaggtgcaggcaggctgagttcaaaaagagagtcagtgaaggaagataggtgtggggccattttataggatttgggtaggtagtggaaaattacagtcaaaagggttgttctctggcggacaggggcaggggtcacaaggtgctcaatgggggagcttctgagccaggggaagtaatttcacaaggtaaagtcatcagttaaggcaggaacaggccattttcacttctttggtgattcttcacttgcttcaggccatctgattctatatgtgcaggtcacaggggatatgatggcttagcttgggctcagaggcctgacattcctgtcttcttatattaataagaaaaataacataaactaatgttgaagtgttagagcagcaaaaattttgggggggtggtatggagagataatggtcaatgtttctcagggcagcttcgagtgggattaggggcaatgtgggagcctagagtgggagagatttagctgaaggaagattttgtggtaaggggtgatattgtggggttgttagaagtgacattggttgtatagaatggttggtgatggcctggatacagttttgtatgaattgagaaactagacagaagacacaaggagaaagaggaaaacaggtattaaaggactaagaattgggaggacccaggacatccaattagagagtgtccaaggggttcagtgtaattacttgcttggttggtgagtttttgggctctatccttgacagagtcctcctttttaagttggaggctgagcttggtgaggtgtgcttttaaaagatcattagtccgttctatctttcctaaagattgaggttggtaaggggtatgaaggttctactgaataccaagagactgagaaactgcttgggtgatttgactaataaaggccggtccgttattggactgtatagaggtgggaagcccaaactgaagaattatgtctgacagaagggaagaaatgaccgcagtggacttctcagaccctgagggaaaggcctttacccatccagtgaaagtgtctacccagaccaagaggtatttcagtttcctgactcatggcatgtgagtaaagtcaatttgccagtcctgggcaggggcaaatccctgagcctgatgtgtagggaagggagggggcctgagtaatccctgaggagtagtagaagagcagatggaacactgagaagtgatttccttgaggatagatttccatgatggaaagcaaatgagaggttctaagaggcgggctagtggcttgtaacctaaatggaagaggttttgaaatgacgacagaatagaatgggcctgtgaggctggaaggagatattttccttggtccaagaaccatttgccttgtgtgggaagagattgataggtgaacgtttcagtgggggaataggtgggagtgaccagtgagaaagagaaaaactggcactgaaggacagaagttggaacactagctgcttctttagctaccttatcagcctaagcactgtcctgagcgatgggatctgatgccttttgatggcccttgcagtatatgactccagcttcctttggaagtaaagcagccttgagaagagttttcattaaagaggcattaatgatggaggacctttgcatagtgaggcaacctctttctgcccatataacagcatggtagtgcaggatatggacggaatattcagagtcagtataaatactgatgtgtagtccctttgcaagagtgagggctctagttaaggcaatgagttcggcttgcggagagggagtggaggggggcagagcggtagcctcaatgatagatgtggaagatactatagcatagcctgcctttgctggtgagtggtgatttggcctggtggaactgccatcgataaaccaagtgtgatcagggtgaggaacaggaaagaaggaaatatggggaaatggaatgaatgtcaagtggatcagagagatacagtcatgggggtcaagtgtggtattcagaataatgtgggaggctggattgaagtccaggccaggaacaatagtaattgtgggagactcaacaaagggtgagtatagctgaaggagccgggtagcagaaagcatacgcaccaggtgtgaggaagaaaatagattttggaagttatgagaattgtagagagtgtgttgagaatagtttgtgattttgagggcctctaaaagtgttatggcagtagcagctgccgcacggaggcatgatggccagcctaaaacagtaaggtcaagttgtttggacaaaaaggctacaaggtgtggtcctggtccttgtgtaagaattccaactgcacagccctgcactttggctgtgtgtaatgaaaagggttgggatgagtcagggagagctagtgtgggagcagtctctaaagctgtcttcaaggaacggaaagaggagtgggcaaaggatttaggatctatggggtcagctaaatttccttttgtgagtttatgtgatggttttgttaggatggcaaaagcaggtatccaaaggtgaaagtatccaatcatgcccaggaaggaaaggagctgttgttttgtagaaggggttggggtctgagagatcagttggtcatgatcagcagggagagcacgtgggttttcatgaagaactatgccaagttaggtaatggatggagaagaaatttgagctttggaaggagatacttgatatcccatggagaataaatgttgaaggagcaggagggtgtctttttgagaagattcaaaggcagggctacaaagtaggtcatcaacatattgaataaggtgagaagtggaggagtggaaagaaagtaaatcatgagaaagagcttggctgaagtaatgagggctgtccctgaagccttgcagcagtacagcccaggtaatttgcagggactgatgggtgtcagggtaaaggcaaagagaggctgggatgaggggtgcagtggaatagtgaaaaaaccatcgttaagatcaagaatggaatagtgagttgtggaggaaggtattgagggcaaaagagtgtacgggttgggcaccagagggtggataggcaaaacagtttggttgataaggcgcagatcttgaactaacctgtaagacttgtctggtttttgaataggtaaaatgggggaattgtaaggagagtttataagttttagaagcccatgctgtagcaggtgagtgataacaggctttaatccccttaaagcctgttgtgggataggatactggtgttgagcaaggtaatggtgattagggtttaatgggatagtaatggacatgtgatcagttgccagggaggtagtagaagtagggggatatgagaggaagatgtgaaggaggctttgggttgggaagaagggtggcatcagggaagcagataatttgcttaagatgtgtcagtctaataagggagctgggaaggtggggataactaaaaaggagtgcataaaagaatattgtccaagttggcatcagagttggggagttttaagagatttagaagcccagacgtcagtacccacaacagttatggaggcaagggaaacacgcccttgaaaagaaggtaatgtggagtgggtagcctccatattgattaagaaggtgacagatgtacctctcaatgtaagagttacccaaagcatatgtgatggtccaggaggcttccaggagacttccgaggcaatcgggcagtgtcagtcttcagccgctaagctgagaaaatctgggaaggcgtcaatccgagagccttgggccagagttccaggggctctgggagtgactgatgggtgagttggactgtccgatttccagtggggttctgcacagatgggacatggcttaggaggtatcccgggctgcgggcattccttggcccagtggccagatttccggcacttgaagcaagatcctgggggaggaggtcctgaaagaatgcctgaccactgtggcttaggcgttttgaagttcttgtgtgctggagatgtggctggggtttctctcacagtggaggcaaggaattgcaactcagaaatatgttgctacttggccgcctctaactctattattgtatgccttgaaggtgaagttagttaagtcctgttgtggggtttgagggccggaatctaatttttggagctttttctaatgtcgggagcggattgggtaataaaatgcttattgagaataagacggctttctgaccttttagggtctagggtggtaaagggtctcaagtttgctgctaaacaagccataaactgggctggatttttacatttgatgaaaaagagcctaaacactaactgctttgggagaggtcagataaagaaaaggagcattaaccttgactatgcctttagctccagccacctctttaagaggaaattgttgggcaggtgggggagggctagtctcagaatgaaactgtaagccagagcaggtgtaaggaagggaggtgatagaaggattatagtgtcggggagtggaggccgaggaagaattggagcctgattcagcctggcggggagcaaactgaggaggagcactctggggaagaggggagagatcagattggttggtagaaaaggaagattgaaaagactcagtgacgcttggggttgggactgaggggacgggcgagagggaaagaaggaagatttgggatgagttgcattaggaacagagactagggagggactgatgtgtaaaagaatgcctggacgtcaggcacctcagaccatttgctcattttatgacaagaactatctagatcatgtaggatggagaaattgaaagtggattttctggctatttggaacaattgtcgagtttgtattggggtcaagtggcattgcagaagaaaacaaggtgtttaggttttagatcaggtgtgagttgaagagattttaagtttttgagaacacaagctaagggagaagaagggggaatagagggtggaaggttgcccatagtgaaggaggcaagcccagagaaaagagagggtagagacatggagaaggggggtggtgagcagccctgggctgcagtgtgggtgagcagccaaagcaggcattcccaccattgacatgccaccaagtgaatgtgggtgaatgaaggcaggcatccccatggtgatcaggcaacaatggagtgtgggtgaataatcaggcaggcgtccccacagtgattaaacaccaagggaaggctgtcttcccaagtccgtgaccagcaccagagttttgggtccacggatgaaatgtgtctcctttgtctctactagagaggaaaaaaaactggaattggaaggacagggagattgaaggatagcgagagagggagattgaagggtagcaagagaggctggagaagagagtgaaaagaccgcttaaccgatttgaaattggtgagatgttccttgggctggttggtctgaggacctgaggtcgtgggtggatctcctcacggagtgaggacgaggacaggggacaagtctctggaaggagtcctcctgtcccaggtctttggcaccaaatgtcatgtgcgtccgtgtgaagagaccaccaaacaggctttgtgtgagcaataaagctttttaatcacctgggtgccagcgggctgagtccaaaaagagagtcagcaaagggagataggggtggggccgttttataggatttgggtaggtagtggaaaattacagtcaaaggggttgttctctggtggcaggggcgggggttacaaggtgctcaatgggggagctgctgagccaggagaaggaatttcacaaggtaatgtcatcagttaaggcaggaaccagccattttcacttcttttgtgatccttcacttgcttcaggccatctggatctatatgtgcaggtcacaggggatatgatgggttagcttgggctcagaggcctgacaattacttcatgtacattgggatggggaaactattggtgtgtcattgggagattttcaaattaatccctctgcttctagttgccttctcccaccctcctgctaaagctgtgttaaagtctttctgaggcctctttaggcaaaagggttcttcctttcattgtaggcgtctttaggcaaaagtgttcttatttccattataactctgagtgtgtatattggatctgagggaagagagagaccctctcatattgttttatattgttttatactaagtacctgtttcaagaaaaaaacaaggaagtgaaaccaaagacaggcagcccagcgccaggcccaaaactgggcctgggcctgcctggcctaaacctagtggttaaaaatcaactcaggctgagcatggtgactcacgcctgtaatcccagtactttgggaggctgaggtgggcggatcacgaggtcaggagatcaagaccatcctggtgaacatggtgaaaccctgtctctactaaaaatacaaaaaattagccaggtgaggtggcgggtacctgtagtcccagctactcgggaggctgaggcaggagaatggcatgaacccaggaggcggagcttgcagtgagcagagatcatgccactgcactccagcctgggcgacagagtgagactccatctcaaaaaaaaaaaaaaaaatcaactcatgacttagaaaccaatgttatccatagattcccggcattgtgtaaaagaacactgtgaaactccctgctctgttctgtttcaatctgaccactggtgcatgcagcccctgtcacgtactgcctgcttgctcaaatcaatcacgaccctttcatgtgaaatctttagtcttgtgagcccttaaaagggacagaaactgtacactcagggagctcggattttaaggcagtagcttgctgatgctcccagctgaataaagcccttccttctacaactcggtgtctgagaggttttgtctgtggctcgtcctgctacggatcaactcttcctgtcccttgtttattcaccaacaggttctcatcagctttccagcttggagaatttgatgaaatcacttatttaataatgacccctaccatgctgtcaatttgtatattttttaaacaaaaaacatgtttttaaaaattctcttactccttaaaatttttaaacatttatcttaatatcatttttatgtggtcctagagggagaagccataaatactctctgccatcattaaccataagcatcactttgtatgcctttacagagcagctagaaatagtccatgactaacttgccttgtgtattagtctgctcaggctgctacaacaaaacaacacagagttcatggcttaaaccatagaaatttattttcttgcagttctggagtctagaaagtccaatattaagttcagttaactcagtttctggtgcaggcttttttcctggcttccaaatggctgccttctcgctggctactcagatggcctttctttggtgtgtgcacaggggatagagaaagcacaacagagctatagagaactcccctgagtcccttcttataaggacactaatcctttattattattattgcttttatatttatttatttatataatttcaactttctattttagattcaggggatacatgtgcaggtttgttacatgggcatattacgtggtgctcagatttggggcaaaatgatcctgtcacccaaatagtgagcatagcaaacaacagttagtttttcaactcttttccctctcttccccctttaatagtcatcagagtctattattgccattttttggttcactaatcttagggggtcacattatgaccccatctagtcttaattacttccttaaaggacctgtctccaaatatagccacactgggtgttagggcttcaacatatgaatttggagcggggaaggggtgtgggggggagatggggacacattcagtccataacaccttgccaagtacaatgaaaatgcttattttatcattttacttactatgaaaaaaaaaacagtagttttttcattttgtctgtggctgactttttttttttttttaatgtggacttgagtttctatgttaactgcctctttcctttctgcttgttttatttttatttttttccttgattccttagcccaatgatattctctcctttccttaatgagttattgttttatttcactgttatttagactgtgtcttaaagccttttggttatttgacagagggttctgagatgctggtagaaaccattgaattagaaagactcacttgacgatataccaatattccaagtaatctcacttgcaaataagcactttaaaaaataaattatatcctaagagtcaaaggaatgccattgatatctgaaatccttctaagcctctaagcacagtttcagacttgcttatttcagggatctaggggctattgcaagtagggcgatattgcaaaattaggagaattattttactgttgcctttttaagtgtccaggaacactttgcctgttgcttttccaaacataagtacagacccaggccacagaactaatatattgatgtaattgtaacaaaataagtcaaatagaacaaaaacaaaacattttctgtgcagtaacttcttggtgcatgatgtcaaaatcaaatgatgttttggggtcctagtgggtaggagataaaaaagacaatgaaagctgagtgtgggactatcttgctgcatgtcatgaaaaagacctcctgttgtagcattaggaaacataaccagtttgcaatctagtagtcaggagaaaaaaaatagagttgtagaaaattccttctttatccttgccaacatctgagctcttgaatcccttcaatgaagcatcttcattgatcactgaccaagaacaaacaattcaaataaaagaaatggccagtgtaactttttttctgggtaataaagccgtgtattctatcattcgagtaaagatatttgctgtttggagggaataactaacgtgtactgctttctctgtctagttaatcaaaggttttaatctgtggaaacaacgccagagtgactttttttttttttcctagaaaggggctgtaaattgaagttataattaaatcttggtgtaaggagaggtccgtttcacttctgttgttgttaaacagttcaggcattgctcctgtactcattcaatgatctgttccagaatggagggtcaatggtcacattttttttttaattccaccagtggcttttctacttctaaataaatgccagcctacactcccctatccttaatgttttagaactcgcctttatatgtgtaacatttcattcacagattacttcttctttttctctccctggatttaaatctttatccacacctatctcttaatgatctttgactctagtaaagtatttctcatcagtcagtatttgttcagtccttcaaaaagacctagatacagttcattacagaatgttctttaacccattccaacccttaacacaatatgagaagaaatcgttgcatagcagcataatcctcaatgtgatacaaaatataaaatctagagaaaagcaaggataatagttggtgaatccctacataaaaacccatctttgagttttccttaatcctggcaaccttcacattttttcaattgcttctttcctccagttggaaattttctgtggtagaaatctttatgaaaaataactgaagtattttatagttaatgtaattattttaaatacatttttgaatatacagccatttttaccattattattattatttttttaccattattaactagcctttttttttttaatgtgatggcgtcttgctctgtcacccaggctggagtgcagtggcgcaatctctgctcactccagcctccgcctcctgggttcaagtgattctcctgcctcagcctcctgagtaactgggattagaggtgcccaccaccactcctggttaaatttttttttttttttttttttgagacagagtctctttctgtcgcccaggctggagtgcagcagcacgatctcagctcactgcaccctccgcctcctgggttcaagtgattcttctgcctcagcctcctgagtagctggggttacaagcacgcaccaccgtgcccagctaatttttgtatttttagtagagacggggtttcaccatattggccaggctgatctcaaactcctgacctcgtgatctgtcctggctaaattttgtatttttagtagagattgcatttcaccatgttggccaggctagtctcgaactgctgacttcaagtgatcagctcacctcggcctcccagagtgttgggattacaggtgtgggccaccacgccagcccattattaattaattttttaaataatatatgcaattcttttttctcaggctttttttttctttttttttgaggcaaggtcttgtgctttcacccaggctggagtgcagtgacacattcggggctccctgtacctcaaccttctgggctcaagcgatccttcagcctcagcctctcaagtagctgggattccaggtgtgcgccaccatgcccagctactttttaaattttttgtagagatggtgtttccctatgatgcccaggctggtttcaaactcttgggtttaagggatcctcccacctcagcctcccaatgtgttgggattacatgtgcgagccacagtacccagcctcagtcttggtttaaacaaaatatactgtttcatcaattgagacttgtgaagcacagttatgtctcaaagtatcaactggtggttctctatatttgtaaagtgaaagccattttccttcacctcatccaacactgaagcccacacaaagataaaaatacttggccaacccaagtgctagccaaagactctcttctcagaaacattctttcaagggcaatttttcatttatgagatgccaaataagaagagcctagggaaaagagagatggaaagcagaactaaaagagagatgagcttttggagggaagaatgtgagaaccatctttgcaaaaaaacaagggagcaaaatggaagagcttcagaggataagctatcctaaaacctggatgctcctccatctgccacctcatccttaacctgactgatcagttttggacaacctgcagacctttggtcctgccctccttgaacagagggtggcattagcagagggagtgctagcatcactgtcattacaggggctcttatgaaaccaataacaataaattattttttggaggtaagtcaatcaaatttacactcaaaaaacaaagacttaccccccacatgaagagaacatatgaaggctgtgaatacaatttcaaagagaattccagttcatgtttgcacaatggttttattattgtcataattgttccacctgctttggtcattattttgaaggagtgactcagataagttaaaaaaatcaagttgactcagttgtacttcttatcttgaaagactcataaactccacattataacctaaaattttgaatctgaatgtaacacttttcaagcaacatagttgggttttaacaaggactttcttgagatacttcttaatataaagaagtgaaacaaatgagtaagggacagtgtgctaatacaaaaagaggacagggtttggatgctggttgtctgtgttctcagctgtgggaacttgctaaaattaactcaactttaaattttagcttattcatatataaaacggaaaattttaatctacttagaacagttatgattcagattaaaggagataatgtaaaacagcatttatgtgctcatatgtcatggttattatggtaaataatggaacttttagatattgctgcatgtcagcagggtgaatatttttgggcagaagaactttgagccaattgctgaaagcacttcaaaccccatgcttgtctcatccaacagtcctgtagttttaatttgggttcatgatgtcatgcctgtatctttctggcaagaagcagtagactgcttcaaaagccattctcttagatggatgggtttattttgtaaaggacagctaattatttaagatagtgaccttatccactgcacaaccacataatttcttttacaaaaattaaagtcagctcatggcagttgtgcaagagcagagtatgagctgtggcagcgggagtcatgggagaccaaacacgtagaaagtttcttctgctctttgaccgagtgttctttggctgaaagtggtgcagccaaaaccgtaaccaaagaaggcattatgcttccagaaaagtctcaggaaaagtattgcaagcaacagtagtagctgtccgattgggccctaaaggaaagggattcaagcagtcagtgtgaaagctggagataaagtacttctctcagaatatggaggcaccaaagtaattctagaccacaagcattatttttttatttagagatggtgacattcttggaaagtaggtagactgaaataattcactgttgaaatggcatcaacatgaagctgcccattccactgaagttctaaaatcgtacatcatatgttaattactatgtcttttattataaagtaattatatctaaactaatgacatcagtgtctctataatttagtttcactgtattgataaacacatttccaaataaaaatatgtaaatgaaaaaagttaaatcaggtacatcatggacatttgagtagcagaatacactcaagaaaagagcactgggctaaggggatgggtatatttgaattccattagcacaactcgtagcaaatcatgtcacctctctcagcttcaatttcttcaataggaaaatagggatgataattctgtctgatagtttatttcagcatgtgaaaatcaaatgaaataattaattcgtgctttgaacattgttatgtatcataccaatgtaaagcattgttgggctgaactagatgaaatccaaatttagtgcaaatatatttagacaaaattttttgttgttgttagcttaattttcctgtaggacagaagcataacagtttttgtttttttaatattcctctcaacaattgagacaataaaacttcctgatttttgaaaagcagcagacaataaacaatggattgcaggtctgagagttgggatgcctatgatctagctgtagttttgttgtttattcactttacaattatggaaaaatatgttgcatgctttttacctgagtttcatcatctcttaaataataaaggtggttatgtttacttttataaacttaagtggacattcccaagaactcaaaaaccttggctattctgggtgatttagacctttgctttcacaagcatgaatacagtatgtgttattacacctgctttgtaccctttagttggggcccatacggggaaagagatgttcttaaaaatcactatcaaactcctaattccaaaagttaatattgtgtaaggaaaaaatgccaagaagtgaatatatatggagctttatttcctaagtgcatttaaccttgatttttaaaattgaatcagtgtattcacccttcaatgaaagtgttattgttttccccagaaagaatcacatagttgctgtaaagttcaaaaagtccaaattttttgctgtatttattacaaactagcatgcgtaaaactacttaaaataaatgagataattgcccacgtcaggctctttcactgttgacaggactgtcattgataagtcaataacacacttggcagatagcatgatcacagagtaccatcttttatatacgttctgccttgacttaatctctattttaatgagcatgataaacatgtcaagagatagggttacaaatctaacccaaacaatttatttatttatccattacatttaaacctctgctttggcaagtcagagaaataaagtaatattacttcactcttgaaagatttttttagttacttaactgataaatatagtaactgttgataaatctttttgcttttttctttcttctattgtcaacttttgagtatttattgcttattgtttaccaggtaataagagacaagaaaagggaaagaaattcagacatttatattacttgtttatcttcttagtgaaagaaccatttgtggttaagatcaggaaaaaagttacttgcagattttatttatgttttttacatttttcattaaaaagctgtattaacatgctaaaataataaaccaaaactcgacactctccatacttttctccaaatataattgttgtattagcagtttgtctttccaaactcttttctgtgtatttttccacatgatatttacatatatactactttagctgatttgtagagaattatgctatgagtgtggcattttacaacttgcattttaacttactgtatctttgagatctccagtacaagagtatcttccttttagcaactgcatattattccacagtacgggtttattatagcttttatttccattcccctcttttttttttaagtcagggtcttgctctgtcacccacactggagtgcagtggtgtgatcatagctgactatagccttgaccccccacaggctcaagtgatcctcctgcctcagcctcctgactagctgggactacaggtgtgcaccactacacctggacaattgttaaaattttttggagatgtggggtctctctttgtcatccaggctggtcttgaactccttggctcaagtgatcctcctgccttggcctcccaaagtgctgggattacaggcatgagccaccgtgcctgatcctgtgcccctcttgatagatatttaagtcatttttaattttttgatctcacaaacagtctttcaataaacaattctattttttccagcacatgggcatatatgtaggacatacttagaatcagagttgttgagatgacgagtatatgtgctttaaattttaccaaaataccttcaaataaaacctgccagtttatgctccactaccagtgtacaagaatgcatgttttcccttactctcaccaataattgatattatcattcttttaaagttttgccagtctaatatgcaaaaatataatttttaaaatagtttgatttgaacactttataatgtttatttcccgtttattctctgtagtgatggtttatatgattgtttatattgttttctttatagtttgtttatattttagaaatgattttatatacaaccgtgcatgcatttctgtattggtcggcttatctggatgcaattttttctattctatatgctgtaagtattttcctccagtctgttgcttgatattgaactttgttatgttatttttattgttgctgttcaacaacaatctccacagagatcacaaaggtttttcattaaaattgagaaagtttattactcttgctttaaagatggtatggcttttttttttttttttttgagacagagtcttgctctattgcccaggctggagtgcagtggcaggatctcagctcactgtaacctctggctccctggttcaaatgattctcgtgtctcagtttcccaaatagctgggattacaggcatgttccaccaggcctggctaagactatggcttttgacataggcatttcatcatgttttttcttttttttcagatttttttttttagaatgagggtcttactggctggagtgaagtggtatgatcacagctcactgtaaccttgaattcctgcactcaagtggcactcccgccttagcctcccaggtagcaaggactataagtgcataccaccatgaacaattaatattttttatgtggtggcgcattctagtaatcccagctactcaggaggctgatgcaggagaatcacttgaatctggcaggcagaggttgcagtgagccgagatcatgccactgcactccagcctgggcgacagagcgagactccgtctcaaaaaaaaaaaaaaaaaaaaatatatatatatatatatacacacacacacatatatatacacacatatatatatacacaagtatatatatatacatatatatatacacatatatatatacacacacacacacatatatatatatatacacatacacacatatatatatatatatatatatatgtttgttttttgtagaaatggggtctcactattttgcccaggctgggtttgaaccacctgggttcaggtggacctcccacatcagcctcccaaagtgctgggattacgaaggtgagccaccacacctggcctcagcatgttttctctgatgtagtcataataaaggaagtattgaatattatctggtgtgtttaacctcaagtataaacctgaataatttgtgtagaccatcatacaagggctgcagctgcacaccaaacccgctctctgaattgttaaccaacgtgcttctgtatctgcatttttttcttagttcgatcatactgattttaaatgtcatacaattcataggcagaaaatgattttaactcttattgtttaataaaacaatatattttacatggaaaaatgattaattcatataaactgattgtttccttcagttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggtaagcatttatggaaactatcaagttcacacatctagacatacaactacagactgaacatttccagcctgtacttccttctgttccatcttaaagtcaataattctgtgtatcaccttccacacataaccacttccatttcaggaggaagtaccttcaaaggaaagtgggcttgttaggcagacatgatcaccaataacagcttgttctgactaaactatagttcagttacacctcattatcagcaaatagtattgacctcatggtttgtaaatattttcttctaaccagaatttgatagtgttagggggaggggagaggaagtacctttaaaggaaaatgggctttttaggcagacatgatcaccaataacagcttgttctgactaaactatagttcagttacacttcattatcagcaaatagtattgacctcatggtttgcaaatattttcttctaaccagaatttgatagtgttagagggaggggaaaggatgtctgaagtattaacgtgtgtgtgtgtgcgtgtgcgcgcgcacgcatgcatgctagtttggattattattacaatgcttcattaaatttctccattggcatttatttttatttttattttttgaaacaaagtctctttctgttgcccaggctagagtgcagtggtgcaatctctgctcactgtagcccccacttcccgggttcaagagattctcatgcctcagccacctgagtaggtgggattagaggcgtatgccaccatgcctggctaatttttgtatttttagtagagacggggttttgccatgttggccaggcaagtctcaaactcctgggcttaagcaatccacctgccttggcctcctaaagtgctgagattacaggcatgagccactgcgcccggcccactgttactttacatgaaagattttaagtcacaattgtaggtatcatctaatattgaaattttaaatagattttaaatagatctcaaagtagagagatcagtgtaatacatttcattataaaaactcccccacccctttaataataatcaacactctgccattcttgttttacctatttttttccccatccattctaatttttgttttgttattctggaatattgtaaggcatgcctgtctgcccaagataccatattagtacatcactcattaatattgagtgtgtatttctaacacaatggatacattctatcagcttagcctctaagcagcaaaagcccagtgagggagaagaccttgatgtggaggaggaaagatagtgaggaaggaaaactcattcatgtgcttcctcccttccactaattctagcattggtctcattgacagaagagaaaaaaatgacagaaagagcaagacagaaaggggagaaatgaaaaaaaaagttactttttttttttttttttttagacagggtcttgctctgttgcccaggctagagtgcagtggcatgatcatggttcactgcagccctgacccccccgctcaggcaatcctcccgtctcagcctcctgtgtcgctgagactacaggtgtgcagccccacacctggctaattttggtattttttgtcgagagggcgttttgccatgttgcccagtctgggctcgagcaatctgcccaccttagtctcccaaagtgctaggattacacgtgtgaccacagtgatccctctgccccacccccaccaaacatttgttactgtgttacaattctcatgattacaggtgtgatcattttcgaccctacccaaccactccctgtccacatccctaataccacagtccacatttccagtccccacagtactacttatgcctcaacatctctaatatattcctttgacggtcgcaatatcacctttgaatcccattatctattgtgtaggtttatatgagaggaggaaagaatgaggcctttgactcagttctggatgagcttatgttctgtacttactaagtggtaacattgaatatgtctttgtgtagaaattctggtttctcatgaggtattcttgtgctgttaatggtacacattagatatattatggcttaagaatgcttttgtggactagcctgagaaccttactatcagaaatttttaacatttttctctttttaagaaagcacattctttactccaaattgactgatttacagacaaacttttggtacacaaccaatttataggtaaggtactacatgtacataagatgtataagataaatgtctactttaattcacttcaaagtatgtcactgttagctgggcaccttggctcacacctgtaattccagcactttgggaggccaaggtgggaggatcgcttgagcccaggagtttgaggcctaggcaacatagtgagaccccatctctacaaaaaaataattaacaacaaaaaaccagctgtgcatggtggcatgtacctgtagttccagctacttggggggctgagatgggaggattacttgagcccaggagggtaaggctgcagtgagtcatggtcataccactgcactctagcatgggtgacacagagaaacctcgtctcaaaaaaaaaaaaaaaaagagagtacgttactgtgattcaacattgaatctggtgtaggtgaccattatgacataaaatgtgtcaaatggttatctaatcattatggaaaaattaaaggatgtacaaaaaagggcatgtatgattatatttaccatcctaaatagagcttgtttttagattagaagcttttgaaacatgattaattgatcaatatttctttaagcctaagtatcttactggcttaattttattgttttctcttggtatattttactatataaaaattataatgtgaaaatgatggttatatgtaacttatttgcatctttaatataaaaacacattataaaattaagttttaactctataatgaaatttaggtttgctaagatatgttttctttttcttctttctaggattatttttatccaaaatacttaggtaagttcaaaacatctcaattatataatcttagaaatggaagggaacttagatatgttcctgtctaactctccacctatctattccatccaatgtaatttcattatccttgggagtgaggtttcattttatatgcaattttgctgtctttatatttaacacatgttgagaaatttggaacggttctttaattaccatgtgacattttaaattttagtgtttttctttctcatgtctttctcatgaagctcttgggctgatgctcagttatattgaggtgctagacatagtctatgagcatatgcgttttcatgggttaactgtttttttttttttgtgaggcagcgccttgctgtgtcacccaggctggagtgctgtggcctgctctcagctcactgcaacttctgtctccctggttcaagtgattctcaagtgcctcagcctcccgagtagctgggattacaggcatgtgccaccacacccagctaatttttgtatttttagtagagacagggtttcgccatgttggccagggtagtcttgaactcctgggctcaagtgtccactctcctcagcctcccaaagtgctaggattacaggcatgacccaccctgcccagccttagctgctgtattttaaaagggcagtgggatatggatatatccatgaaaaagatgttttcttttgtaaagttacatgcaagaatttgtactattaaagtgtagaaaagatagtatatcaagactatttcagctttttaattttagatagaaatgtaaatattttataataaaaatagacaatatttggctgttaaatattatgtgtacattaaaaaaacagtgttaactcttgcttcttagggccatgtaatgaggctgcatttttgcacgcacaatactgtagaggatacattcctttgatcagagtacatttggataaagataaataccatgctaatacagcattatgtgttctggggaagttccttagataaaatatttttcataattttatccttgtatctctcttaacttccgcttttctggccctgcccaactcttctctttgcctatctcatttggcaacatggtaaaaaaaaccaaagtataaaataaaacaaactaaaacaaaaacacaagatgtgggatccaggctcagacctaaaaatttttaactgtttcagattaaacaagttgtttagctttccagcttctgtagttttaagtgtgcactgtaactatattttctaacttcagagcttttaaatcaccaaatatgtcaacgtacataaataacttaatgtgtcaaaatttcttcagatgtattcttgtttaatcaacccatcatgtgaaacaaaaatatactttttattatgattttttttaatttaaatttcatattttggtctttatttgtatataggcatgtgtggtgaattccactgttaaaaacaatttttaaaaatgtcctgcctaagttacactttttttgttatttgatgtgtatattctataggccaatggctctaatttgaaaagcaaaacaaaacagtcctttctctggtaaatctaacagtagttttactaactacaacagctcatacaggaaggtccctgtagtgagataaggtcaccaaagaaattaaaaaattgtaacccatatatttggggcaatatttagacttcgttttcaggggctgataaagcacttcaattggcctacatattccatgtactatcttgaaaacatgcgatttggaaataagtactctgggtttcattatagtttttaaattgtgttcttctcttttgtaagaagtggaataaataactaccatttccataggcctagtatcacctaatagagtgagtgtttctagtaaagagagagaaacttcctgggaagaatggtgaactctgagcctaaatataaacattagaaatcattttttgatgtgagctggcaaaaaataaaataaggaaaaaacctgaaaaataaaaaaaagaaattatttttagtttctaagataagttggtgaattacctcagaatgctgactccctcccttcaaatcttctctaaagaaacaataagattccaagcactaataataacaaaataaaatgacaaaaagaagtttaagaaatgcctgggtaggcgaaaagctggcctgacctgctggtatgtgtggtgggggattgggttctaactgacaaggcagtagtgacaaaacagatttgataatttaaaaaatgacatgaactttccaattgagaaaacaaacacaaaaaatacaatagagcaaaccccaagtaacaagaagttttaaaataacaaaaacagagatagaaataagtggaatagaaaaacaaaagtgagcattaacaaaagcacattctcattctttgaaaaggttagtaagtgagactgacatctggcaggaataatcaaggaaaaacaaaaaagagaaagaggaaatgccaatacatagagtacaagatagaaagggaaaatattctaaactcaacacagattaaaaatattatcataaaatattacaaacagctatattaaatacacttggaaacctaaataaaatggatgtgttcctagaaaaacataaaatatctgtaatttcacaggaagcaatagagaacttagttatacaaacgagtattaaacaagttaaaaccgcagccaaagccctcttcttcctatttctcccgaaacccagatccagatggttttacaaatgaactcttccaaattttaagaaattgttaatgtttcccttattaagatattgtccttaaaaaatgagcttattctaagaggcttatgtaatcttgactccaaaatcaaataaagacatttagtaaactcattttaaaatttaagtgagggaataaaagaaaagaaaaatagcattccttttgattttgaattaattctaaataaaatgatattcagtccgatcttaagtgtgttaaaaataatatcatgatcaagtagaattattccagaaatttaaaggtgagttaacatcaggaaatcagctgggtgcagtggcttatgcccgtaatcccagccactcaagaggctgaagtgcgaggatcacttgaggccaggagtttgataccagcctggataacatagtaagaccccaccactaaaagtatattattacctcagttcatacagaaaaagcagttgatagagatcactacttagttatgataaaagtttttgtcaaactaagaatataagaaaagtttctgagcttgataaaggttaaatctagaataaccatataattaatcttccaaattttcacacttcagttcaggattaataatgcataaggtaatgtcagctagaacaagaataagatagggttgttttgagcaaattagcatgagaaaggagggagggagggagagatggaaagagaaagagagagaaaagaaaaagaaagtgaacaaaatctgcagtaaacattatacctaatgaataaaatttaggtatagtttctttatggttgagaacaaaaagaaaagtactggaggttacattcaatgcaataagaaaagaaaaatagggattgtatagatcataagctatagtatattcctgtcattacttttaatagatataatactggaaaaaaatagaatccatagacaaaatataggaacacataaggtatttagataattctatgactctcctataaaaatccatagtagttctttatgcaagcagtagtctagtagaaattaaaaagatgatagcattcacaatagcagcaaatcccataacatatctagaaatatcttaagaacacataaaaaccctatggagaaaatgttaatactcaaattgaagacttagaaaatgaattaaaaccatggaaagatatttcatgatcttgaattgagtgatactatacagtgatcagttctcctcaaattgattttattttattttattatattttatatttttagagatggggtctcactatgttgcccacactggtctcaaactcctgggctcaagcagtcctcctgccagggcttcccaaagtgctggggttataggtgtgaggtactatgtgtggccatcctcaaatttatatgttcagagcaatcttgtttaaaaaaatatttttgagaaactcagtaaactcattttaaaatttaactgaggaactaaaagtccacacatgtctaaaatacaaaagagagaaatatcttatcaaatattaataatataaagctatagaaataaaactatatggtattttcagaacatgaaactgaacagaaagttcagagaaaggctcatatctatgacaacctaatatttgataaagatgatactgtaagtcactgtggattatttaaagatggtattgcgaagaatggccagctattagcagacaaataaacatgggtttctaattaccaccaagtgtaaaggtgaattctagatggaataaagacaaaaatgttaaaataaaaccatgaaattaaagaaacaatatgggagaatatctttgtgactgatgacatgggggaaaattttaaattcacaagctgtaaggtgaaataataaattggattataacaaaattaagaatttatcttacaagagagacatgaatagtaagattaagagacaaatgacagatctgtctctgtcaaataaatatcaaaaatataaatatcaagaggtgatatttataaatgtttattttttttcaaatccgcaggaaaaacaaataaggatcaatagaaaaatggtaaaaaaaaaaaatagggaaaattttcaaagaagaaaactttcagatttggaaaatgacatgaaaatatgctgcctctccttagaaatcagaaaaataatgagatattactttactacctattagtctgccaaaaattagaaagcaaggatgtagaaatccttatactccactggtgagaatgcacctctgagagccattaagtacattcctatttaatgatcacacaattccaccactgggtatctattccaaagaaattgttatgcaggtactaaggagacatgcatgaggatgtactttccgccttcttgtagaggtagaaagttggaggtaatttgagtgtcttatcatgggtagagagaattataaagtggtggttgcatactgtggtgtaacacttagtggttagtagcaatgaattatatgtagcagcatggattgatcataaaaatcaagttctgagaaaaaaattagaggatgtgatatataacacaaaaccatttacacacgtgaaaaaaaacatggaaatgaaattgtaaatatatattttcaagaacacttacaaattttaaaaatacacataaccactgggcatgatgtctcatgcctgtaattccaacactttgggaggctgaggaggatgattcacttgaggttaggagttcgagaccagcctgaccagcatgatgaaaccccatctcttgtaaaaatataaagattagccaggaaggaaggagtggtggcgaggcctgtaatcccagctgtgtccagaattggtgggttcttggtctcactgacttcaagaatgaagccgccgaccctcgcggtgagtgttacagttcttaaaggcggcgtatcaggagtttgttccttctgatgttcggagtttcttccttctgctgggtttgtggtctcgctggctcaggagtgaagcttcggaccttcgtggtgagtgttacagctcataaaggcagtgtggacccaaagagtgagcagcagcaagatttattgcaaagagtgaaagaacaaagcttccacagtgtggaaggggacccagtgggttgccactgctggctcgggcagcctgcttttattctcttatctggccccacccacatcctgctgattgatagagcgagtggtctgttttgacagggcgctgattggtgcgtttacaatccctgagctagacacaaagtttctccacgtccccaccagattagctagatacagagtgtcaattggtgtattcacaaaccctgagctagacacagggtgctgattggtgtgtttacaaaccttgagctagatacagagtgcggattggtgcgtttacaatccctgagctagacataaaggttctccaaggccccaccagactcaggagcgcagctggcttaacccagtggatcctgcactggggctgcaggtggagctgcctgccagtcccaagccgtgtgcccgcactcctcagcccttgggtggtcaatgggactgggcgccctggagcagggggtggggctcatcaaggaggcttcatggcacaggagcccacagaggcgggggaggctcaggcatggtgggctgcaggtcccgaaccctgccctgcagggaggcagctaaggcctggcgagaaatcaagcgcagcgccagtgggccagcactgctgggggacctagtacaccctccacagctgctggcccgggtgctaagcccctcattgcccctgctggcagggccggccggctgctccgagtgccggcccgccaagcccacgcccaccaggaactccagctgttccccctcgcgcctttccctccacacctccctgcaagctgagggagccagctctgggcttggccagcccagaaaggggctcccacagtgcagtggtgggctgaagggctcctcaagtgccgccaaagtgggagcccaggcagaaaaggtgcccagagcagcgagggctgcaagggctgccagcacgctgtcacctctcacagctactggggaggctgagggacaagaatcacttgaacccaggaggtggaggttgcggtgagccaagatcgtgccactgcactccagcctgggcgacagagactctgtctcaaagaaaaaaacaaagaaacaaaaaacaaaacaaaacaaacaaacaaaaaaacaaaaaccacataacccattagaatgactgcctaaagggtgaatgaaagtggaaatggaggaaatggagacagaaaggaatatgtatgtattttttgaaagcaagtaatgggattttcaaacaccagcgatcataatatactgtcaaaggggcggggtatgaataactcagccttgtgctcctccagtcaaaacaagcaaacattcagccttttatgtgatgcgtcttctgtgacttaaagacagaggggtataaagtagtttcttagagaaataaaaaatttacctgactcttgatccattataattccagtacaacctttgtctaggagtcagtggctgtttgaactattttttagaattgacaaatcaagatagctaggatagtggtgcctatagaaagcggcaaaaggaaaccagtttgattgttaataaaactaatagtgaaaaatataagtaaaggtacatgtagcaagatcttttcctaagaggtcatgccttgaccaccagaacctctcttgaaagggtctgtttcttagcctttctctcctgtggtcctaatttctgtttttaatcccttttcttgtgggagcttccgcatcagtttacagaagcagagacaatctccctccaactttcaccttcctgtttaccctcctcaatttttactattcctgttgtgtggtaagaaagagaagtgggaatatgagggttctgtattacactgctttggagtagcaaagcaaatggctcttcacactgtaattctgaacacacttttccatgaaattattatcatgaatattaatgtaggcttctatataatgtgccttatgtgtttaagctaatgtagtctggcctggggttctaaactcatatgaaacatttcacttgggtctccagcctcagagctttcaaattttggctgtattcactgtaaaatttgccagagatgcgaaatgaagctttctcaaaaacgatgattctaatgaagtcttcacacaagaataaatgaagtctgaaagtagatgattcaagaagaaggacaaatgaaccaaagataagactactcgagacctaaaactacttaggttttactggggctgagtttggctcccttcccctctctatctcttgtacccttttgccttactaccttctgtcatgggatgatgctgtaataaggcctttaccagatgattagcaccttaatattggacttcccagcctccagaactgtaaaaaataatttttttctttataaattactgagtctgtggtattctgttatagcaatacaaaaaggcctaagacgaaacattggtgccagacattgggttgctgctataacaaatacctgaaaatatggaagcagttttggaactgggtaatggctaaaggctggaagaatctggaggagcaggctaggaagagcctagattgctgtgaatggagcattgaggatgattctggtgaggggtcaaaaaaaaagaagacatgcaggaaaagaatgtaacttcttagagattacttaagtgtcatgattagattgttggtagaaatatgaatgctaaagcccattctgatgagatcctagatggaaatgagaaacaaagcactggaaactagagtaaagaccaacattgttacaaggtagcaaagaaattggctgaattatctccatgcctgagggctgtagggaaggctgaatttaagagataagtactaggatagcagagatttctaagcaaaatattgaaggaactgtgtggctgcattaatttatttatctatttatttatttagagacagagtcttgctttgtcatccaggctggagtgcagtggtgtgatcttggctcactgcagcctctgcctcccaggttcaagcagttcttgtacctcagcctcccaagtagctaggattacaggtgtgtgccaccacacctggataatttttgtatttttagtagagacagcattttgccatgtttgccaggcagcctcaaactccttaccttaagtgatctgcatgcctcagcctcccaaagagctgggattacaggtatgagctaccgtgcccagcctttgtggctacttttaactgcatacagtaatatatgagaaaaagagaaatgatttaaagcttggatttacaattaaaagggaatcagggcaaaaatatttgggaaattcgcagcctggtcatataaagagtgaaaaggtctttaggagagcaaaccaagggtgtgtcccaagttaccatttcccaaagagactaccatgaatagaaaggagccaggggctctttagtctgagtgaagtaactcaggaatggaaaaccaaacattgtatgttcacagtcataagtgggagctaaactatgaggatgcaaaggtttaagaataatacaatggactttggggacttcggagaactggtggaggtggggtgaaagataaaagactacatattgggtacagtgtacactgcttgggtaatggatgaaccaaaatctcaggaatcactattaaagaacttacttatacatgtaaccaaacaccacctattccccccaaaacctgttgaaattaaaataaataaataaataaaaggagccaggtgctgtttttcaaaacaatgggcgaaagacctcaaagacatttgagagatttttgaagctgcctctcccatcactggcccagagcaagaccttgatgcagtttccagaggggcacctgcaggaccaccactgctctgcacgacctagggactctgctgcttgaatttcagcacagtgtcccttggccatcccatccatggctcaagtgggcctaggtgcatctcaacccaccactctggaatgtacatacctcataagccttggtggcattcatgtggtgtaaattttgcaggtgcacagaatgcaagagctgtggggtcaaggtggcctccacctagatttcaaaggttattatgggcagcctgggggtgtccaggcaaagacttgttacagcagcagagccactatagtgagcccccaccagggcaatgcctagtggagccatgggagttgggaagccccgagagcccagaactatagggctaccagtatgcaacttctgtctgggagagctgctggcacaagactccaacctgtgagagccgcagcatggcctacgcccagcaaagccatagggatgggctggccaagaccttgagggctcagcccctacccctgtgtgctcagaagtcaggacatagagtcaaggaaaactatattagagctttaacattttatgttgtttttcttaatgggttttggacttccttaggaccagttactgttcttacctgtttttcctttttgtaatggaaacgtctatcatgcttatctcattgcattttggaaactcatagctggtgggaattgccttagggtgaatcatgccttgagtctcacccatatctgatttagatgagactttggactttggacttttgagttggtgctagtatgagttaatacattggggcttatattagtctgttttcactctattataaagacatacccaagactggataatttataaagaaaagaggtttaattgacttatagttcagcatggctgaggaggccttgggaaacttagaatcatggcggaaggcaaagggaaagcgtattagttcattttcatgttgctaataaagacatacctgagactgggtaatttataatgtaaaagaggtttaattgactcacagttccacatggctggaaaggcctcatagtcaaggcagaaggtgaatggggagcaaagttacttcttacctggtggcaggcaagagagcttgtgcaggggacctcccatttataaaaccatcagatcttgtgagatttactcactaccatgagcacagtatcggggaaattgcccccatgattcaattatctccacctggccctgcccttgacacatggggattattacaattcaaaatgagatttgggttgggacacagccaaactatatcaggaagcaaggcatcttcttcacaaggcagcaggaaggagaacgaatgcagaaggaactaccaaacacttagtaataatcagatctcatgagaactcactcactatcatgagaacagcatggggaaaatcgcccccctgattcaattacctccacctggtctgtcccttgacacatggggattgtggaggattagaattcaagatgagatttttcggtggggacacagctaaaccatatcaggactactgagatggaatgaacgtattttgcacatgagaaggacatgaattttgggggctggagcaaatactaggctttgaatgtgaccctcaaaaagtatgtgctggaaacttaattcccaatggaacagtgttgggaggtggggcctaatgggaggtgtttaggtcattaaggctccaccatcatgaatagcctaacaccaattataaaagggcttgaggctgcaaattcagcgtcttgctctttcgccctcttttgccatctgctgtgggatggtgtagcaagagggccttcatgagacactaaagcaccttgatatcagacttcccagcctccagaactgggagaagtaaatttctttctttaataaattagcccgtctgtggtattttgttatagcaacacaaagtggactcagataggggctccagaaacacccccacaatgtgtaaggtaagacttatttgggaaaatattctatctcaccatggtaggctgaataatgacctccttcctccaccctgcctgcccctccccgccccagacatatctatgtcctaatccttagaacttgtgactgttaccttatatggcaaatggagactttgcagatgtgatgaaagatctttccatggagacattatcctgggatatctgagaggacccgataaaaccataagggtccttataacaggatggcaggagattagagtcagtagtagatatggagtcagatatggaatgataaagcaagaactggtagacatacaaggatgaggccatgagcccaggaatgcagatgacctctagaagctggaaaaggcaaggaaagggattcttccttgaagtctccagaaggaatggatccctgctagcccttttggttttggactctcggcactgtaaaacaataaatttttattatttaaagctactaaatttgtggtaatttgtcatagcagccataggtaacttaaacacatactgacttcaaatgaatcttttaatctgtctgtgatacactgtatttttccaaagatggtttaaaaatgtcttccattccacatacccttctacagtgtcattttgctgtgtcctcatcaagaggtagaataaatcccccacccacaccctaccctttgaatctgggtggaccctgggacccctttgatcaacagaatatgatagaagttatacagtgtcccataactgccatggcagtttgctttctctgtcttagaagctagctgtcatgaaagaagtgccactttaagaccagcatgctaagagaaacacccacgtggagaactttgaagcatgatctatcatatggaaagagagatgccaaagaacttccaagatgctccatcttggaagcagtcccctgccccagccatcctggttgactccattggcagcagagacaaacaacccaaccaaactctgcaaatatttgacccgcaaatcatgagaaaaatacaatgattacttaagctactaattttgggggtggtttgttccttggcaaaagctaagtaaaacaccatcttttttatagtaagctggtgactgtctgaacaatgaagtaatacatatggtgtctttagtgcctcttaagaaatatatttttggcactaagtaactcctagttacgttaaagtcacaaagtatttcatctttacaattccagctgttatttcttagtttcctagcaatatctaccaggttgctatatctgatttcacagggttgtagtgaagaatgaagggaatgaagtaaacctgatttgtaatatagaagcattatacaaatattactgtattaatctcagggcaacatgagaagaattggaagtagcctatagcaagtagaaacacgaactgattctattgacttaattacatatactttataaatcagactctggtcagtagatttgagggcaacatcttgtttctgctgtggaattaaaaacatagacttatatgacaataaatttctatgctaaatcaaggtttttttcacttctgactttaaggttcttctccagagagaagaagctgtcacagacttattttttatgtttctgtatctgttgccatcttgcttgtagatttttaatttttcagaaaggtagatggaaacatttagtgttgcattttgaagactgaatcttgtgaatctacaggagcataaatgtcctacctcttgggacagttcctaccatgaattcagatcaagtatgtgtgtctactctaagaagattatgtttgtttttattttcagtttgtcttcgctcttttcaaactgggttattcactgctgcacgtcagtcaactaatgcttatcctgacctaagaagctgtgtcaatggtaagcacttctaccatcaattgaaaaaacaaaacaaaaactctgtaggtaaagtacacccatggtaatataaactaacgtttaaaaattgagaaatgatcctttgatgggttgtatgcccagcaaggaagtattttcaaactgcatttctaatacttgtttatagttgtaaatgctcctgtattactcaaaatgaatttttttgcctaatgtttaaactgaacagtgttctctgttcctaaaggttatcagcttcagaatttttattcccaacagctttattttggctgttgttgcataatcatgtagtgtgactaaatgttacagtagattaatagctcaaagtagagccatgtttattcttctaactttttggcactgataatataaacatggaaaatgttatgtgaatcaaattagctttcttgctctgaagttcacaaggggcctaatgataattctggtacattatttttgactcttttttggtaaattggtaaattagtaaaagcaaatggtgcaatcacaggatataaattgtgatgtttgttcagagaatattttacatccaggattgaaattctctagatattcttttaactgtgtttttctctaatttaaagtgcttgtaattacacagggagtacagtttgtctgaatacgtatatttaatgatttaattcatgctttatcttttcttaaaatttacgaaagaacagaataataataattttgataaaaattttctattattttctatgattttaaactaatacctaatgtattgccacatttcaaaaaaaacgatcctatgaagacttttttaaaaaattatggaattaattaggcgttagctaggttggttatttatttatttaacaacaaaaattttctttggctaacatatgcaaagagatagaaatataggcagtattgggagtattggaagtattggaaggatgggaagaacatgtacagttgactgggaagtttagaggctggtgtggatatgtgcagaaatcaagggactattgcagtgtctaaagaggggacagaaattacaaataaaaaacaaatggcatgtcatttgccatattgataaagtgcttcgatattttaggaagaaaataaacaaggcactataattgatctttacttgtacgttttttttttttttttttttttagacaagctcttgctttgttgcccaggctggagtgtaatggtgcaatcatggctcactgcagcctcaacctcctaggttcaagcaatcctcctgcctcagccgcctgagtagctggaactataggcacatatcatcactcctggctaatttattttttatagagatggggtcttgggtgtgttctccaggctggtctcagactcctggcctcaagcaatcctcctacctgggcctcccaaagtgctaggattacaggcatgaaacaccattccaggccctactttgtacttcttaatattgctctttttctctggtaatattccttattctaaaatctatcttatattaatgttgtcactctggctttcttttgtttagtgtttttatggtttacttttccatccattaactttgaacataccagtgtgtttatatttcaagtgagtttcttttgggtcagtatacaaaataatggttttgaacattggagaacaggaagcagaacactgtgactcctaaggaaaagaaaataagcttacagcttatgttgctgggtcctggattttctttgcttcttccaaacagtgtttgattttgttgtggcatttaggtaacttatgtggaatacattaaaaacaaatcttttgaggtttgattttaagctctgttaaggcaatctggagtagccgttagcttaaaactaatttagcctcaataataagtccttgtgaggattccacctgatgccatttgtactgtgaaatattttaggtctgggtagtctaaaacaaactatccctatccctctctgagctctggaaattttcctgtgcaaatcatcattcagccaaagaccctacgggatctttttgcagatctctggagactctttctcttttcctctatctctctttctctctctctttccatacacacacattttttccctctctctgcctttatagtactctgaccagcagaattctaatttgatctccccaaactccaatatttgttttctcaacccagggagaccactgggatctgtttgtgtttcttgcactgttgcatagaagctatctccaggcagtaatgtggtccaattgtaggtctcagcttgtttattttcttttccttaggaattacggtgttctccttcctgttctccaatatttgaaaaaccattattttacatagttagactgaagttctacttatttaaggcaggaagataaatctattccttgttacatcatcttagtccaaattgaaaattttaatttctttttctttttttttgagagagagcctggctctatcacagtggcatgatctcagcttactgcagcctctgcctcccaggttcaagcaattcttgcactttagactcctgagtagctgggactacaggcatgtgccaccacgccccgctaagttttgtatttttcgtaaagacagggtttcaccttgttgcctaggcctcaagtgatctgcctgcctgccttggtctcccaaagtgctgggattacaggtgtgagccatcacacctagcctctttttctcttaatgttgagaatagtattgttctgtctacctcatggaattgttctaaggctcaaatgaggtaatatatttggaaaaatatctaaattacagttatgaaatactgtatatacttgcaatccagaagtagtgttatgggatctttggggtgttgcttttctggctggaaacttctgtggctggtggtgcctttgcctgagttcttgtcctgcatccatgaagaatgaggtatgcagaaaagtggagggtgagcaagatgaacaggaactttactgagcattagaacagctcagaggagaccctcagtgggtagctcatctctgtaggcaggttgtcccatcaagtgttcagccctcagcagagaggagggcttgaagcaggtggctcctctctgtagccaggtcatcccattgtctctgcagctttcagtagagaggaggcctagagtgggtggctcctgtctgcagctggttgtcccatcagcagctctcagcagaggagggcctggagacagtggttcttctctacagacaggtcattcgatgtctgcagctcccagtacatgggaggccctggagatggtagctcctttctgcagctggttgtctggatatctgttctgctctggctgagtctggggtttttatggtcttcagagagggaaagtgcatgctgactggtccatgggctgccatgggtgggcccaggaaaaagcacccagtgttcccccatcagtcagcaggactggtagcccagcccacaggcctcaggccttccccagcctgaaggtgggacttcacaggggacctacccttttccacctaggaagctgtctacctcctgccactgttcatggcacccaggctgtttgtgccaagggggtgcctgcaggccagcactgagctgccctcagcatgcccctcagctcccttcccatgcttgttggagcccaaagactggaggggacagggtgctggcatgttagcgctgccctgagcttatgcccacccagctaggctgcgacaacagctggcttcagctccaaccttgttccatgaccagagtgggtgccaggagagaggagaggtcaggaagcaagagcaggcacttctgagcctgtggtgggcagaatgggcctccccaggccctcaagagtacagagatgcccaggtttccagccaggcttgggcagctgcagctgcactcaggggactcttgtcccaccagtttggaaggagtggagctcccccttgtccttggcttttaccagctccatggcacgtgcagccctggccatgcctctaagatcagagtggatgcctgctgcggggagaagcctggcagcgggagcaggcccccaagagcacagagacacccgggtccggagccacgacaggaaagctgcagcagcatccggggagtgtggggctcctatctgctctgtggagtgggaggccctggcccacatccccactgcagctggcgtcttggcagcggccactctacatgggccactgctgccatctgtagtttatttttacaaaataattataaagatttgcctaataggctcactttttaatttaggaaaagtattatttaaagaaaggagttgtgtgtttttttttcattggttctaggcttcaggatttttattatagtacacacaattttatttttccatgacatgagataaaaaaaataaatagatgtctatttccttcagccattccagaccagtgtagtcctctgccatgcaatgaagatggatatatgagctgcaaagatggaaaagcttcttttacttgcacttgtaaaccaggttggcaaggagaaaagtgtgaatttggtacgtataataacccccgccccccagctcatcaggattggtctcctgaaaagttctctgcaggttatattactttaaaaataatttatttttttcctgttttagacataaatgaatgcaaagatccctcaaatataaatggaggttgcagtcaaatttgtgataatacacctggaagttaccactgttcctgtaaaaatggttttgttatgctttcaaataagaaagattgtaaaggtaagagcaggatggtagaattaaaacacatttactatgtgagaataatcccagttagagaaattttactagcaaatttttggaaaaatgatatgtaagtgcttatactaacacatttttatcgacattgaagccttgtgatactgtggaactgctttttagcttttgtttgtttttgagagatagggtctcactctgtctcccagactggagtagagtggctccatcatggctcactgtagccttgacctcccgagcttaattgatcctctgacttcagcctcccaagtagctgggactacaagtgcatgccaccatgcccagctagttttgttttgtattttttgtagagatggggttaatcatgttgcccaaactgatcttgaactcaagtgagcctcctgtctcagcctcccaaagtgtttggtttacagatgggagctctctgcctggcctgcattttagtttacagtactgataacacaatttttaaaaattttcttattgtatgtgcgtgtacacacttgtgtgtatgtttcaataaggaatttcattataaagtgatgtttcaatgcaagtctttgcatgctacaaactttgcaaaatcattgtttatcctgttttcagacattatattttttattctcttctagtaagatacatagccatagaaagaaatccactgcaataacctcttccattgtattttatttttccttttcagaaatacttttctgatttccaacatcagcccttcatctggcacctcatttcctgttgtggttttgggaaagtaaaagatctagttttctttctctttatacctttaagatcatatcattggtcataactcctttttcttcttcagacttaaatattccctgttagtttagctttctaacaagtcattttactagtgtatttgttttgtttttcattgttttcctatccctaaattttgactttttttctctttgtatactgtctttcagtttggctgtgttaatgctatgactaaatcttcaagtattcataccaggtgtatggatgactaaaaataaaatttcccacctggacttaaaatttgcctttagaaactggatacaatataatatccaagttctctcctccagtactttttgtttgcttgttttgctaaaatgttaaaaaaaaaagtaagttaaaatgtgaatttcttgttcgactctttattttatatatattttggtaaagccctaaattggattcatgttcaaatcatccatctcttactgaatagcagtgtttagtatgataaaatgtactataatattatttaaactgcagttaaatgactctaaagtgaactacattaacaacaaattcttctaaacagttatccaatttgtgatcatgtatctttcttatctgcctatttgaaggtctgtttgagtttggattttgagactacttagaatatatacccaaaggactataaatcatgctgctataaagacacatgcacacgtatgtttattgcggcattattcacaatagcagagacttggaaccaacccaaatgtccaacaatgatagactggattaagaaaatgtggcacatatacaccatggaatactaagcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtagggtggggggagggggaagggatagcattgggagatatacctaatgctagatgacgagttagtgggtgcagcgtgccagcatggcacatgtatacatatgtaactaacctgcacaatgtgcacatgtaccctagaacttagagtataattaaaaaaaaaaagactgtcattaggacatgagtgatagaaaaaccatcacaatgctggataccatatgcattttgtaaacaaatagtacccattcttacttctacgcttaaatactttaatagtctctttctaaagaatttgtgtttttattgtttttttaagatagatagggttttgctctgtcacctaggctggagtgcagtggaacgatctcaactcaatacagcctcaacctcctgggagatcctcccacctcagcctcccaagtagctgggactacaggtgtgcaccaccatgcctggctaatgtttgtagcttttgtacagagacagatggagttttgtcatactgtccaggctggtctcaaattcttgggttgaagtgatccatccacttcaacctcacaaggtcgtgggattacaggcatgagccaccacacctggccaaatttgtgactttttaaaaattaaaaagtatttaattcttatccactcagttaatacacatatatatgtgtaaatgattacaaaagtgctcttattaataggaatgttcctgatgaccacatctgttcttatattcatttgcattattgtttagtcatgatatgtaagtaataacgtataaaacagatagaagaatatataaaaaactgttacagccaggcactgtggctcatgcttgtaatcccagcactttgggaggccgaggtgggtggatcaacaacaggtcaggagatcgagatcatcctggctaacacgctgaaaccccgtctctactaaaaatacagaaaattaaccagggtggtggcgggtgcctgtagtcccagctactccggaggctgaggcaggagaatagcgtgaacccgggaggcagagcttgcagtgagctgagatcacaacagatctgtctcaaaacaaacaaacaaacaaacaaaccaaaaccacaaaaaacactattacaatgagacctttgccaagatgtagaaatggttgggatccagttgccagtaactgtctaaagatgaaagaataaagcttaacttttcttttcttcttcttcttcttttttttttttgagacagagtctcgctatgatgcccaggctggaatgtagtgtgagctcggctcactgcaacctctgtttcccgggttcaagtgattctcctgcctcagcctcccgagtagctgggactacagacgcatgccaccacgcctgtccaattttgtattttttggtaaagacggggttttgccatgttgaccaggctggtcttgaacgcctgagctcaagtgatctgcccaccttggccttccaaagtgctgggattacagacatgggccactgtgcccagctgaaagaatacaacctttcagtcagacattagatgtcagtttggagtcataaaaccaatgtactgtaacttaaacttgtatgatctaaataattccctgcaatatgcctcaaaccaaatacacttattgacatatttttactgattttattttattttattatttatttatttagtgacagggtctccctctgttgcccaggatggagtggagtggtgcaatcatagttcaaggcaccccagcttctgggttcaagtgatcctcttgccttatcctccttagtaacaagaacacatgccaccactcctggctaatttttttctcttttccttttttgtttttaatatgtagaagtggggttccaccatgttgctcaggctggtctcgaacactttgacccccaaagtgctaggattacagcactgctgctgtgcccggccactcctggctaaattaagaaaaaaaactttgtagagacagtgtcccactgttgctcaggcttactttatttcaaaaacatagagtttttagctctttttaaaaatcggatattttactttgaattaattaaagattcacatgaagttgtaagaagtaatacagagagatgctatataccctttaccccattttcccttagtggtaagagtttacaaaatgatagtacaatttcacactcaagacattgacaatgatacagtcaaaatatagaaaaattcctacaagggaactggttttattatttttgtgcaagttattttaaataatatcctaaattttgactattaatctggaaaaaaagctgtcaacttttagaatagaaaacatattttctgttctgaatttgtctttctccagagagtacacagaatagttcactaataattccgtctccattgaactatttctgtcacatgttttgttttcttcacaggtgctcatctagtaactaattgctaacaatatgttatctccttcttcatttggcaatataatatatgcatctgaaatttctggaatattcatttagcactaaattcatattggattaactgcagatttataagtacttagagaccttaatcttattttaaatttgaatcactattgtctactttagacaacaatagtagtgtactaattagatgtttgttcatttccaaagaaacaagatagaagagatgagccttcccatgtacaaaaaatacttgtgataatatggagtgaatctgttttcaagacctccatttattttcgcaccacaacctggcagataagaaaatttctaaagctttctccttcttaacataactagaaaggaacatggcaaacatcaatcaaatttccctctgcatttgtagaaagaaatcatatttagtgagctaacatatgatgatagatttaatgttttttggtccaaaggccaatctgttatctcattacatatattaaacaagatccaggaaacacaaatcaagggttctttggtagtgtctgctggtatgggaaaaatgttttttaatatagtgattttatttatagatgtggatgaatgctctttgaagccaagcatttgtggcacagctgtgtgcaagaacatcccaggagattttgaatgtgaatgccccgaaggctacagatataatctcaaatcaaagtcttgtgaaggtaggatgatggtggtatcattactgatggtggagagggtgggtgtgaaccctgaactgatatttaaaagcattggctttgtttgacatcaacagtcatattttcttatccctaatatagcttgttcaattgggtaatcattggcttccttccttccagagcaagagtatgtaaggcatatggtctttaagtttggtgttaggcacgccagttggccctttgagctacctatgaattggagacctccatgtgtggtaaaaacaagataaacatattttcacatcatttatatcatattcaaagataaagagaatttcactttggaaggaaaaacagtagatagaaaagaaagacacaagcttaaaaatcatcttattgagacaatgagcatggttaaaactttagtttttattccaagcttttcagtgatttttctgtgcatatataaataaatcatttattctaaaataaaaaatgacacagttctattatctcatgataaagaaatgataacaatactctagaaatttaagaaatactgatcggtaatgtcagagcctgtgggtttggggcaaccccttaaaggtgctgttacttcatgtgactgcagtggcgctgccctgtgtgcatcaggaagcttcaacatattatagttgtttgtttgtaggtttgtttattatgatatacagattatctcataccttcctttcgattttttaaaattttaaaacagatttactgccatggctggaactaatcaacactaatttttctattgtatctgtatatatatatgtatgtatgtatattcacacacatgtataatgtaccttttaaaaaatagatttaggggctacaagtacagttttaatgtactcttttaaccatttttaaatgtacagttcagtggcattaattacattcatgccattatgcagccatcactgctatttccaaaactttttcatcagccccaacagaaactcttaagcagtaaccattaagcagtgagttttcttttattagttaccttgatggcggtaacctctaatcttgttttctgtctctatgaagttgcctaaatcaataataattttacaatatattttttaactacgtatgctgcttttgagattttgatgtcctatcatctccttttgcaatcaccaaaaatattcccctgccagcccccgcaacacatttctcctttctcaccattgcagatagaaattaccgtggaaaactctagatgtctgcggaattatcattagccaacttcatcacttgtattgtagttttatttaatgaatgacatattttttaaaaagatttatatatgactcttatctataactttaataatatgcaattttaatactaaggattattaattttgggaatctattttaaattattttatgagaacatattcaataatagcatttatgagcttgtggagttttaaaggtcatagggcatatccaatgaaaatgtcaatgatcttatataactctgagatagatgtttgcttcaacataatattataaatttccaagaatgattttctcaaaatatggagtagggacagggaccatatagaagatttcataatatgggagattacatcacagtgaggttttttaaaaaaaaaaaaacagatatttccctaaattcactgccaacattaattatcgcattatgagtgttccaatgttcttgatattgtcatttaattcctgattgtatcaaccttcagttaaaggggtcttttcttcccttcccttccctaactttcctttcctttacttccccatcatgctctcccttcctctttcccttctcatttcttttttctttttttcaaagcaatgaattgtgaggtaatctcaatgaaattcaaatgatcagaaatgacagttaagttgagattctcaatcttttttttcttcaaattcaaaatgagaaatttggtagaattgttatactttacttaatcactgaaagttataaattaatttttgtttcaaatatgtaaataaaaactatacttgtaactcgtttaaatttccatgttcagtattatgtttaaatgtagtttgatgtcatagtatttctttccctaaggttcgattatcattgattatatcatactacaatcataatattcctctgcctataagattgaacatttaggggatattaaagtttgtgtgcgtgtgttttttttacctcagatatagatgaatgctctgagaacatgtgtgctcagctttgtgtcaattaccctggaggttacacttgctattgtgatgggaagaaaggattcaaacttgcccaagatcagaagagttgtgaggtaaacattttacaatgcttaacttctcacctgttttctaaaatgagagatcctagatacttattttcacatagctaagtcaggaaaatacagacgttctgcaataattgctgtagctttaagcaggttatgagtcatgattatttactaattatggtcatgtaagtcataaacattggggataattagtggctgggtttaaaaaaaagagggtagagtcacagtttagagagtacttatctgtagtctgtacatttataaaatacaacttgtatgtttacttaagaaatcaagaaaagctgagtttaatagccctcattgtgaaaaaaaatctctcatagaaacttcagtgaaaacattttccagtgtctacttttctggattccactctgactagtttgatcatgccttaggcgttatagggtttataaagtgctcataaaatttcagagggtacaagtgcagttttaatgtacccttttaaccatttctaggatttagtggggtttaagtatatcataattcagagaggttgatttcttaatctgtgtctctcaaacttgcttttaattacttagatttaatgcataattgacccaggaattgaatattgggggtaggtgctcatttttacttcattgaaataaatgtcaccatctgagctctttttttcctgcatctttttttgacaagtgaaggtaaaattatatattattatgaggcagaccataaaaaatgcctaaataatgatttaactaagtatacatacatacctctatagctgttgccaaaacaaagctgtatatgtccagaaaaatgtcacattcaataatatgcaacctacttggtaataagctagttggcatttgttgtaattttggtacgttactacttaattgaaatgccatgctgtgtgaacatctattttgtaatttagtcctttattatttctgtatttggtgtagttacatatcaccgtctgccttgaaatagatttattaaagttttaaggggaaataaaatgttatttctgggcctatatttaatatagtgctatgtacgtaattctcctcaaaatatcctcatatgtgttcaataatttgtatgttaaaagcttttcattttaatgtttgttttcactcgtagaaaaaaaatacttgataccatatgtgatgactttaaataatgttcttgtaaattccttggagactatgagatctgaatttatatttatttccttcatgttttccagtattccctttactatctagatagcacattcttgctcagaaaacttttgcttaataaatgaatgagtgaatgaatgaggtgctgtttattggtacattaattcttacacctatttctgacttcaaataaaaataattttcagacataattcatgggagataatatacctgactgttaattaaagaaatatatattggttcttgaagaaagagtttgtgtttaggacgaaaatttgcaaaggaagtattaaagacaaagatcgaaagccatgcacattgaacgaggctttaaaacacatgtattcttggaggttatactgatagatagactatacaaggaaatggaagatatgtatttattattaccaaaaatattcttaattattttagtgtattacagatgatacattagtaaccaaacaaaaatgcatgacctcacacaaacattaagcaataacctgtgcattttgattttcttgttgtttatttggtttcttttattccaggttgtttcagtgtgccttcccttgaaccttgacacaaagtatgaattactttacttggcggagcagtttgcaggggttgttttatatttaaaatttcgtttgccagaaatcagcaggtgaggaaccaataccaatgataatttctagaggttaagcagataagggcagaagaaaagtggccgaaaaggtttgaagtgtgtgaaattgtattacctatcagataatgtagtcatattaccaatcagatgacttggggaaacctaaagttaatttactccttcacacatgtaattttcatcctaaaacctttttgagtcattctaggctgactttccccaatgaacattttacattattccatattattccttttgtagaaaatgcatatttactaagaagctgggaaagtagatttaatgtacttgtgaaatttccattattctttacacatgttatgaaaaccaggtaataaaaaatactcagtattgcttttagaatatcattatattcaaaattattaaggaaaaaatttaaacttgcttaagtggcattttaaagacatatattacataattttagttggctgtctaaatactttatccattattatcgtacttagattgagttcagaaatgaagtaaatgcttatgttttttagtcatgattccacttatttttatagcaatgtttatgatccaatttttattttattatatttatttatttttgagacagagtcttgctttgttccccaggctggagtgcagtggcgcaatctcggctcactgcaaccttcgcctcccaggtcaagcaattctcctgcttcagccttctgagtagctaggactacaggtgtgagctgccacacccagctaatttttgtatttttagtagagacagagttttaccacgttgcccagggttgtctcaaactcctgacctcaggtgatcacctcaggtgatctgccataattgtacttcagttatcagattttctcagaagcatacattgctggaagtagaagaaagaaattggattttttttggaataatgagaaggcaaaatacttgagacagattatacagttcaaattttaaaatattttaattaaataagcatgtatgtttagaacttgatgttagatacatgaatgattattcattaaataattcaactaaattcatagacgttattaaaaacattgaaaattattctaagatcaataacttacataaatacttaagtaacagtgctccttccacactttatttctgccaatatgtggttttttcctttaacatcacagagcaactaatatcttctaatgatagagattggagaaaactcttccctgctatgagaataataatgagagaaaaatattagttctagtaaataacacttttaggaatacaattgatcctccaaatccttgagttcctcatctgtggatttaaccaacctcgggtagataatattcagaaaaaaacacaatgacaatacaatacaaaataatacaaatgagacacaatacagtatgacaactatttacatacatttgcattgtattgagtattatacataatgtagagacgacttaaagtacgtgagaggatgtgcataggttatatgcaaatactatgccattctatataagggacttgagcatctgtggatattgataccatccagaggtcctggagccaatctccaggagtttgttcatttctcactgacgattcatagtagtttgatctctaacatgggatcagaattggacaaattattttttccagaatttattatttatttattttaaacttttcattgaaatataaagtatgtaccgatatgtacacattagattaaatgtatagcttgatgaatttttataaactgccccttgtgtgatcaacacaaagaatagctagtgcttttatttatttttgcaaatttcttgacgtctgttgctcatgatcaaatactttccctccgtaaatgtcaacaaattcattctattttcctgtttaccatgcttgtgaaaaagaatgaattgttccccattgtaatgaatcaatatgctgctgatatattccagaaacaaaatatgcagaacatgaccctttgaaactatgatttcagcctgattttacaaagaaaaggaaattatctccataatagaatcaactgctggaagatcctgagcatacacagatttggattttggcaagataatattgcttcacatcagcaaaatgctcagataattatgaaagagcatagaagtccttattccaagcaaaattgttctttttttcataatctgagttcagtaaattcctactacattgttatccatccaacatactttactccacattttacctctttttaaatatttctttggaattctaaagatgaaaacattcattttgtcaccttttctttgttccatttgagggagatacgtgccccattgcaaatggtgcctctattactattactattttactatattgcggtaagagtgtgggattctgtcctgcctaatatagcaattatctgaagtccagactctttaacttaaattgcctttattttaagttaggtgactaatagttatacacctattgttccttttccctgtttgtctttcgtcaatcatgtggatttgctagtcccttggaaacttcaatgctgattctcattgaagtgttttaaggatactgaatcaacacatgttattttaagtcctgcatcctaagacttttctcccctgtaatagctacatatatgtctagagtcttaatagcaacagatgttgccagcactcagataccccccaaacacatgggtagactatgtcttttaagttttccttctgtgtattctacaacagtgacttatgcaactggagttttaggaaagctaatagatatattttaagtttttaaattttacctttcttaccacacatgaaggcttaatgatgtctgcagtcatccatgtgccatcttgtagatctccacgagtgattcctgacatgtgaaattatagggaaaatatgccttttgatgaataaaccaacgatgaaattgtaacacattttatgatcacttatggatacagcaaaaacaaaaacaaacaaaaaagaacaacaacaaaaaaaactaccacttcttaatgtcagattatatagtgtataaaaggctccaggagagatatagtatgcctgatacttatacctgtgtattaatttcagcatttggaaggtgctatcaaaatatatgtcaaagaaagatgacaaattaccaaagcatctgttccctggggaaaagattccaagaataagcaagaaaatataataacttaattttaaacgtacatggaaccagagataatacatgagcagtctaattctgcccttctcttttattaattccagaaaaagaaataaataattgactctttgtctgtgttactgtttgtcagtacaagaaaaaaagaataatgcattgagctttctgtatttcttactcttaaggatctctctttgtccattgtttagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtacgtttgcagatttcatcaatatcttcccactttgatgcagtctgtataaaatcataatttatttttatagtgataccaaaccaaaatggatttggagttatctgatgctatatgaggtatattctacatactgtaaatccctgaagcatcctgagaaataatattctcacttaatatattagaatcattgtttttagttatttgcttgaactactctgtctttaactttttaccttttttagttgctgtttggtgaacagtggtgttagggactattaggaggcctaacatttttttttttttttgagacagagttttgctcttgttgcccaggctggagtgcagtggcgtgatctcagctcactgcaacctccacctcccaggttcaagtgattctcctgttttggcctctcgagtagctgggattacaggcatgcgccaccatgcccggctaattttgtgtttttagtagagacggggtttctccgtgttggtccagctggtctcgaactccagacctcaggtgatccacttgccttggcctcccaaagtcctgggattacagatgtgagccaccgcggctagcatattttttttttttgagacagtctcactctgtctgcccaggctggagtgccgtggcatggtcttgcctcactgcaacctccacctactaggttcaagagattcttgtgcctcaccctcctgagtagctgggattacaggtgtgcaacagcatacctggctaatttttgtaattttagtagagacaggttttcaccatgttggcaaggctggtctcaaactcctgggctcaagctattcacccacttcggcctcccaaagtgctgggattacaagagtgagcaaccacacccggctggcataacaatttatgcaaagacaacactgatcaaggaaaactcctcaattgccaacaatattttttaaagtaaggagaaataaacatagtaacaagtctaaaaaggtaattcaaattcaaatataagcagatagataagtaatccttaaaaaaaaatagacacagggtcttgctatgttgcccaggctggtcttgaactcaaggaatcctcctcccactttggcttcccaaagtgctgggattacaggcatgagccattgtaccggacctagttgtcagtttttgtgcaaatgatatacattagcaggtaccagtgtgcttagaaatcagcattttaggctgggcgcagtggctcatgcctgtaatcccagctctttaggaggccaaggcaggtggatcacctgagatcaggagttcgagagcagcctgaccaacatggcgaaaccccatctctattaaaaatacaaaaattagtcaggcttggtggcgcacgcctgcaatcccagcaggagaatcatttaaacccaggaggcggaggttgcagtgagccgagatcacgccactgcactccagcctgggtgacaaagcaagactgtctcaaaaataaaaagaaagaaagaaagaaaagaaattagcattttaatttaatcctacatatagcctttaatctaatgatcaagaatagcactttaatcaactggattaaagtgggacttttctgaagggattactgctagttgatagtggggagaagtcttttctgaagtatagagtcattgctgccatcagcagaggatagctgagagaagattggcttcaccttagaatgtggtgcacaaaagagacatcttttatgcctagaggagctggcaagaagtttgtgctgatctcaatttatttatttatgttatttatttatttatcatcactattattactattattttgagacggagtcttgctctgtcacccaggctggagtgcagtgatctctgctcactgcaacttctacctcctgggttcaggtgattctcttgtctcagcctctcgagtagctgggactatcagtgcctgacaccatgcccaggtagtttttgtatttttagtagagacaggtttcaccatgttggccaggctggtcctgaacttcagacctcaggtgatcaattctcctcagcctcccaaagtgcagggattacaggtgtgagccactgcacccagacaagaagtttgtattgagaagtcatgtgaggtcatcactaaattattttggtccttcatttatgcagacatgcactcatttattcagtaagcttttagtgagtgcttttgatgctaagttcctgagttcaaggcattagaactatagcatatcggggaaacctgcccccaatatttcattgtagggtctttctattttccataagtgtcggctggctgagaaataaagagaaagagtacaaagagagaaattttacagctgggcctccaggggtgacatcacatatcgataggactgtgatgcccacctgagccacaaaaccagcaagtttttattaaggatttcaaaaggggagagggtgtaagaacagggagtaggtcacaaagatcacatgcttcaaagtgcaaaaaggagaccaaagatcacatgcttctgaggaaacaggacaagggcaaaatcagaaactactgataaagagtccaacaaagaccacaagccaaagggcaaaagcagaattattgataagggtctatgttcagcggtgcacgtattgtcttgataaacatcttaaacaacagaaaacaggttttgagagcagagaactggtctgacctcaaatttaccagggtggggttttttccccaccctaataagcctgagggtactgcaggagacccgggcgtatttcagtccttatcccaactgcataagacagacactgccagagcggccatttatagacctcctcccaggaatgcattccttccccagggtattaattattaatattctttgctaggaaaagaatttagcaatatcttccctacttgcaggtccgtttgtaggctctctgcaagaagaaaaatatggctctattttgcccgaccctgcacgcagtcagaccttatggttgtcttcccttgttccctaaaatcgctgttattctgttctttttcaaggtgcactgatttcatattgttaaacacacatgttttacaatcaatttgtacagttaacacagttgtgatcctgaggtgatgtagatcctcagcttatgaagataacaggattaagagattaaagtaagacaggtgtaagaaattatgagtattatttgaaaactaataaatgtccatgaaatcttcacaatttatgttcctctgctgtggctccatccagtccctccattcggggtccctgacttcccgcaacaatagcaagagattttccttgctctagagcttagtacctcacagataagtagctgatgcttctttgggaaataatataatgtaacatgaaatacattacattagaggtacaaacaaagcacacttgggcaaacgtggtgaatttataaatgattacatcttatctttgattatgagtctaatattaataggaattttaattgtaaatgtatcataattcattcagcaaaatatttattggcacttctatgtgctaatccttattctaggtggtaaagatacaacagcaaataaaaaaaagtcagtgctcttatggagcttgcgttctaatggtgagacgcaaacaacaaatgcatgaaaaaataaatatgccagatagttattcatgttataaggaaaaagaaaagccagacaaagacatagagagtaatggtggttagtatgcatatagaatcaggaaaggcatctctgatgagattagatctgagctgagacttgagagcacatgtcatgagaaataaatgagggaatataaaaagattctgtaccatgtaaacagcaagtacagaatttcttggaataggatgtgtttggtatttgaggaataacacagagtagtgtagcagcaggggagagtagttagaaaatgaggttagaaacgtggtctagaataagatcatctagggccttggaggccatgatgaggatgtggattttatgctaaattgaaaggccctggatggttttgagaagggacatgatctagtttgcattttaaaagataatcccaatcagaagctaatggctttgtggaaaccagaagtggagaatgagtgtataacaggatatggggatatggagttaggagactgttggaataacccagcggagagaagatgacagtttgactggtgtgctgatggtaagagtggtaagaagtggtcagattctggatatatttttgaagttaagccttcaattaaaatttttgaatactcagcataaagaggggttttaaggccatgaaactgtttgtgttgaccagtggttccaaacactatctcatccaatgtctgaaaatatataatgctcctttactattctataatgaaatgtatcagtaatataaactaccttcacatatacccaatcaaaaccaaaataattctgtcattattatattaatatggataaataaaaggaaagtaatttataagaaaataatatgtatttcaatatatacgtagtcaactataactataacacttgtcaaagcttgcttctatgcataaagtaaaagctacaaatgaagactaatgctggggtgttaaattagcaactcaagtaccattaagggcatacatggtgttgccattggtaatattaattttccaaagtggtgggaagttcctggtaaagatatgaacaaaacaaatatcaatctatccttagttgtcaagattattacattcttgaaaaatgtaatgaatgctaaaatagtgcagcaaatattttgtgtctatgtatgcacaaactcagatgattgtaagcatgaatattccctacatgaatacctagcagtgatgttcaaaagattttaagaatacttgatattttattattagttctgcattacttattattattaattctgcatgactagcctatgtacataatgcagattgtctatcatcttgcagtgccagcatggcccctactcattgtgacaaataaaagtgttcctcacctccaaattttccaaatgccctggagtggagtcatagtgtctcacttaaaatacttgcatggctacaggaaaaaggtctggggcctgagctgtggggaggggaggatccagcaaaggagactgagaagtagtggttagagtgtagaaagagaagcaatcagggtcaagtgttgtaggctaagttaagaaagtctgtaaaggagagaatagttgttcacatgctgctaattggctatattaaagaaggagtgttgaccaactttaaatttgtgtaactaaatttattttatgttggaggatagtttttcccttcctatcatggtgttttaatatgcttattgtttggcttatattattggttagtgagtgaagagtttgctctttgagtgctatagttttacttgaagtgattgcagcagtggttcttcaaattgcctttgtagaaggaatttttattgttgtttacccttacttgaaaccttttttaaaaacccaaacaactctcaaaattggaaaactccaatttaattttatgtatttttttcttattgcctcaatcacttttgaattttaaagaaaaaataatttgtgtgcaattaacagaatagtgaacatattgatttttcttactttatattaagaacttatgggccgggcgcggtggctcacgcctgtaatcccagcactttgggaggccaaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaagaacttatttacactattgattccatgtgcgtattatcagacaattgcaaaataaggccacttaaatttttcctaagatagaatggctcacttaattgttaattttctagcagcctggaattgaaagatatataactggatgtttaagcttaacagaatagtattttttttaactttaaaatatggtatgcttttaatttttgatcgtgctgccaccctaaatgcctttttatcacatttatcataatttgacattccaaatgagttgtaacaaattaataattacattaaaatgattactttacagaagtattttattggaataataacataagttttagatcccagtatttcaaatgacatgtagtaatacttggttatttggtaatttttctttttaattgtaggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccggtaatgatccaagcttgtatcattcatcatggatgagttccttttgtctgtaatagatttgaatatgtgtgtttctgagaatcaatagaagttgttttgttaagcatactaagtgtgacaacttgaaatgatcatggaaaaataacattagtaacccttgaaattatattaatgaaataaaaaaatgacgtagtggttttgtgcccatttaaatccccagcataaatcatgaagtggatttctaaaattctcaagttaacacttgagaatgttaacactaatgttaacattagtaatgtaatgttcagtgttaacatcatgataatccatactcagttgttaaacatataaattcatatatttaagtccaaaattacaccattttgtaaaagccagtcaaaggactttctcaagtctatttttaggacttaaatgcaagagctaaagaatagcacataaggtgaaatttattgttaaatatttactatcttacatccgtctttcattctctggaaattcgtagttactttaacttttaaaagatttccattatatgatattaagcttgaattaattaacccatgttgacatgagtatacctgttgtttgaaactgagaaattaatacactttaaaagtaaaataaattattcaaaaagtatcaatcatttatgaaacggttattacatgtcttgagcctggcaggatacttgatggaggctaaagaatgcaaacacttttgtgtctgaagagacttagagtctgattggcaagacaaacccatattataaatgccactaaagaaaaacaaggccaggcgtggtggttcacacctgtaatcccagcaatttgggaggccgaggcgggtggatcacctgaggtcaggagttcaagaccagcctggccaatgtagcaaaaccccatctctactaaaagtacaaaaattagccaggcgtggtggtgggcacctgtaatcccagctactcaggaggctgaggcaggagaatcgcttgaaccagggaggcagaggttgcagtgagccaagatcctgccactgcactccagcaagactccatctcaatcaaacaaacaaagaagataaacaagacaacttagagcccagggccacagctagaagcaaatatagaacttgaaagcagaaaagttaccactggatgatgtaggagaggcaggtggggcttgaagtgttaaaaaccattaagatcccactgagggcttgtgatagtatgagcttgcttgtactgaaaaagactgtccatctgaagaatactttgaaaagaaaaacttaaataaaattcaaaatattttcaactattatcaaagaaaggattttttttctcttaatgaaaacctatactcataatcgagccactgtttaagtttaaaatgcactccttgacttgtattttaatttgttagattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattatagtaagtgattttccatttatctctattttctcattaatgagtaaatttattcattaacaaacagtaataatttatttgtgaaacattattgagtatctactgtgtgcccactctagtcttatgcttattcatactattatataccttttacaaaaatttttcagtgtattgggaaaaatataaaggcatttgaatgtgcttgtgttgttatttcaggtttatcagtacatagcctgattccttatgggtaaattcaattgacctattttaaagttcactgatttctcacttgtatggagtctatcaatgaatgcatcagaaagattcatcttcatttctagcatttctatttgatgctttcttaaaatttctacctccctgttgaaattccctatctgttcacacttgtctagtttatgtactgagttttcaatgtattcatcataattattttaaattccctgtctcgtagttccaactgtgtcatatctgagtctcgtcattttgtttgctttgtcccttgaccaagtgttgtttttcttgcatctttgtgtaccatgtaatttttggtttagatttgggcatcttacgtataacagtagagactgagataaagaatatttgtgtctggaaatgagcacatttcttttgctaggctcttagtaatgggattgaatcaatctagtgaaaagttgagcttcttaagttttgttggtgccaggattacccttaatgcaccacaggtttcagatcttttattttgttttgttttgtttttgagatggagtctcactttgtcacccaggctggggtgcagtgatgcaatcttggctcactgcaacctctgccacctggattcaagtgattcttctgcctcagcctcctgagtagctagaactacaggcgcccgccaccacgcccggctaatttttgtatttttgtgtttttggccaggctggttttgaactgctgatctcatgatccacccccttggcctcccaaagtgctgggattacaggtgtgagccaccgcacccagcctcagattttcaaaatactaccttctgcttagaataagggaatggtttggtagctagtttttctttttcttttctttctttttttctttttttttgagactgagtctcactctgtcacccaggctggagctcagtgccacaatctcggctcaccgcaacctccaccttgcaggttcaagtgattctcatgcctcagcctcctgagtagctggaattacaagggtgcgccaccatgccctgctaatttttgtatttttgacgaggttttgccatgttggccaggctggtttcaaactcctgacttcaggtgatctgcttgccttagcctctctaagtgctgggattacaggcttgagccaccgtgcctggcctagagagtttttcatcatagcagctcagttttatgtattccctccataatacgcctcaagaaaatgtctctcccacttgtgtctctcaagtgtcttgcccacccctagcagagtgctcttgttacctgacatttgctaacatggcagagaagatgcggaggttggggaagcattctatgttgttgtcgtacaaattcagtcttaggcaggtgttgtatccctgggtctcaggagtgtggaattttcactgttcctcttccctgactctcatcagtaggggagatgtctagtgatcaggactcaatatgttttcttgctccttctgcatgatagatagctttttttgtttgttcttcctaatctgtagttgcaatgagtcttcatatgtgtcctaatgacaaggtttgctgcctttctcctggcttgaaaacttgtgttgtgtagaggagaccgagaaggatctagatggggctttgtggcttccctgtagctggtgctgctttcaggaccatattaagagagaggctttttcggatctccttccctgcactctgttttctcttgagtgcatggtaaggtctgtggagaagagcctgtgaatgagcatgaattgtctttgtgtctgtaatttctagggcttctaaactcttacgtcagcccctacatggagttcagcaatttgtttaaatctttacctaaattatttttaccaaattgcatggcatttcctgtctgccctggattagaaagtgttctcattctggctttccttggaaacacctgtctttctttaggtttctggttagtttgttgctctgcgacctcagctctttgatagtttcaagaaaagtcatgattatgcagataatttggcttttgttgttgtaagggtgggagtggtgccctttccacttttctacagcctaagtggagcagggaatcttgccatactgaccctaggtttttaaccttagaagtaatacttctgtgaacatcctaaatcatacatccttctacctttatgtgattaattctatggaagaaaattttagaattaggttatctctatcaaaggttatgcaaatatataattattagaggttcaattacattcttttccaaaaatcttttatcaattaatatttctaccaacagaatgagaaagtgtatgctttagtttttttccaatctgatagttcaaaaattaaattttgtaggtttgaatattaatattatttctctaatttctactgaacttgaatatcctcccatatgtttattagctatttataaattctaattattttattgaattctttgtctttttcttttttagtagttcattatttgagctactaacactttgcattataaattgttaacactaatgtgatatctctgctttaagaaaaaaattacattttaattgtgtttatttgtaacctaaaaagggcgaggtaaggtggctcacacttataatcccagcactttaggaggctgaggcgggcagatcccaaagagctagagcccaagagttcaagaccagccttggcaacatggtgaaaccctatcttcacaaaaaatacaaaaattagccaagcctgatggcatgcacctgtagtcccagctactcaggaggctgaggtgtgaggatggcttgagcccaatatgttgacacagcagagagccaggatcttatcactgcactccagcctggatgacagagtgtgagcatgtctcacaaaaaaaaaaaaaaaaaaagtgcttactacattaaaatacatttttaaatttttatgtaattaggaggtacaagtgcagatttcttacatgcatatattgtgatatattgtgtagtggtgaaatctgggcttttggtgtacacatcacccaaatagtgaacatgatacccaattggtaatttttcaacccctaccctcctcccaccctcccatctttcgtagtctatatttactacatttgtttgtttgtttttgagacagggtctctctctgtcatccaggctggagtgcagtggtgcaatcatggctcactgtaacctagaccttctgggctcaagcaatcctcctgcctcagcctcccaagtagctaggactacagccacatgccaccatgccttgctaatttttatgttttgcagagacagggtcttcccgtgttgcccaggtcagttttcaaattccttaactcaagtgatactcctgcctcagcctcccagtgctggtgttacaggcatgagccactgtgcccagccttttttactgtatttttaaggacaaattttacaaaaatgatttccctttttctaacacaaattgatacaatgcctagttctgttctgcctatgaaagatttttttaaagttataaatggggtgaggattaaattaggataaaactaaatccatggtgatttggccaaaggaaaaaaatcctgaaaaggtaatgaaaataagagttatattgtatctaaaaaaattactttaataagtaattaatcatttcatggataatttgtaagtgatctactttgtaattaatatttaatgttacattttaacttctatacattcgtgtgttcattttagtttgagtttaatattctgtgttaaatttacttatttcaagataaatgtttaggtgatagaaattccaattaccctgatttgagcattacacattgtatgcatttatcaaatgacatatgtaccccaaaatatgtgcaattatgatatatcaattaaaaattacttatttcacaatgattacatataaacattcttttttttttggagacagagtctcactctttttcccaggctggagtgcagtggcgtgatctcagctcactgcaacctctgcctcctgagttcaagcgattctcctgaatcaagcctcccgagttgtagctgggactacaggtatacaccaccatgctcggctaattttttgtatttttttttcagtagagatgtttcaccatgttgcccaggctggtctcgaactcctgagctcaggcaattccaaagtgctaggattacaggcatgtgccaccgtacccggtctatatattttttttcttctggatgggagttacaggattataatgaaaaacagtgacattatatgtggctaagtggaagaacatcttgtcaaaggaaaatgattttccttattcacatttaccctttcaagggctccgtgtggtatttgggctttgctgtatgttacatcatattaaatgaggaagacttcattcagattatgaactaatatttttagtaatccaactattctggaaacatattaattcaacaaatatctattgagtgagtgctggggaaaacaaagcaatgatagagatatatacctcctagagcttgcatgttagtgggatagacaattaacctagtaattaagaaagagaatgtgaaggattatgacaagagattcacaaaacaagggttcctattctgatttcaaaactaactgctgatgtcagtgtatttctctagtatcgaactatccaactctcctatgtatatagatcatatttatcctttggagtgatgatggcaactgtacccagattttccctaaattattacagtaaatttgttgaattttcaaacgtgtgcttggaaatatgaccactctgagatttgagcattggtgaatgtgcaagggagaaggaagcactgttaaagagcaaactgggaaaatccatgataatccttaacaccacaatccagaattctcttctaggaagaacgggaagatggtactccatttgcatgtttcttgcctgcattacaaaaaagtttgttttgttttgcctaggttatatagatcattgagaaagggaatggaaatagtattacacaagatagttttgaatattacctggactgtgttaataataattccttctgatgcactttaggagtgcattgatcatgcttctgtttcattattttaaatagataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggtaacttaactctaaacctatataagccttgtttttcttttcattttttaaaatgtatacatagcagtatttacctcaaaggactattttgaagattaaataaagtaacttatgtaaagtgtttggcacaatctccagcacatcattaaggactcaaaaaatgtctattattgttactttttttctggcttgtttccaaggtctgaatgaagaagtaaggggagggaggaatgaaaaacctactgcatctatacctaagattaggcagactctcacacaggctgcttggagccatccgagtacatagagatccacccttattaagaatactttatgtgttgtgggaattagtctgtactgtcaacatagaagtgagtctaattacagtgcactgtcagatattcagtgcttaattataatgttttgttctttcttacactcttaatcttttctcccaagagtaagttaggaaaaaagagagaaagttaaaactggtccacttggtttcttactggcaactcttatttgaaattaggaggaagaacacgaaaaagccttagatgaaaggaaatatgagggttatcagaaaatctgtattattcagacttctattagagcatagtcgttctgtctatgtgtcatccacagtgcattctaacaagttacagcaagaagctgatgtttatgccaaggctgacttggatgctttcagtagattttagaaagagacctgtggttgaataatgtctattgtagtaaaacaagttatgctgtttgcaacttaaagtatgattcagggaggaggatgggaagtttctggtggttaaccataagtaacctaaaaatatcctgatgagtttttttttgtttttgtttttgttttaatctcctgcctttaaggagctttctacatttggatttcaggggttttttgtttgctagtttgtttttctttttaaacaaaatggaattcttatcttaaacactacattcatgcagtggaggaggttaacgcatgccatgtctttgatatttaatttatcctttgagtgtttgcctccgtggttctttctttgcatgtcagatttccttctcaaggtctatgcaatatttcataacattattccagatatcattgatcattttggagcattttctttattgacaatctcttttaatgagtttaaggatacggacatgtacaacacaataacagatttcctcaagtaacctatatttgcaaagttagtcttttcacttaaaataggtatcttggattcctaaataaacatttctgattatgtttttatcactttcctctatgccatataagctatatgaagagatcacactcaacacattgagtaatttaggcataacggcagtttgaaaggttcagcagaatgaacacattttctttctgtagaatcttctggtaaatgttctataacgtgctggtggcaatccctggtttttctttctcagggcctcttcatttattttatcccaagtctgtaggattgcttgtgtggcacaaagaaacctgttagtcctgctggcatatgcttactaaagcattttaaatttcccaagtcttttctcaacaaagagtgattcaactccttcccttttcatatgtaaacttggaaattaggaaggctcataaacagaaagatataagacactcctataggttccggttgttttacggaattttcagaaaccagtatacatttatattttagctaaactttgagtttgtaaaactaatgtgtattttaaattttagtcataattattataaattagtcttataataattagtgatttttcccttaaatttagaggctctatcatacattttctttccttattgaaatttagtttttgactttcaaaaactcaaaagtcactcttaagcagcattactcttactccttgcttatattgaatctttgctctgctcttcaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccaggtatctgcttactttttcttcagttttaaaaagtatattttaatcaaaccgataatattttaaatatataattatagtaaaaaagcatcagaagggaacataaaatccagtattcattattctttttctaggggctagtaccgacattttattggcatatttttgttttgttttgtttagtttaaaaatgttgaactaaggctgatcaagttttgcttcatttggctatcccagccagaaaggatatgttattttatttcatcatcacaatagtcttataagttcaatatttgttctaatttacccaatatttattcatctattattcagttcatcttatcatttatccagctttttttttttttttttttttttttgagatggagtctggctctgtcgcccaggctggagtgcagtggcacgatctcggctcactgcaagctccgcctcctgggttcacgccattctcctgcctcaacctcccgagtagctgggactacaggtgcccgccaccacacccggctaatctttttgtatttttagtagagagggggtttcaccgtgttaaccaggatggtcttgatctcctgaccttgcgatccgctcgcctcggcctcccaaagtgctgggattacaggcgtgagcagtgacaatagttgtagtatctaactaccatcaactattgcaaaacaaacagtctgggcactgtttaacgtgcttcaaatatatccacttgtttaattttcaaaatagtccagtgaggtaagtgctattattatccccattttacagatgaggaaactgaggaagctgcaggaccagggtgataacaatgaagatgatggacagtaaatagatcggagatatgtgttagaaacaaaattaataggatttaataactgaaagacaggtataaggatgacttttaggtatctggcatgagcagttgcatggatggagattccatttaccaagatggggaaaactggaggaaaaacagattcatctttaactgaatattggaaaatatgaaattggcaccaatatttcactttaaatggaaaattagaggcagaaagttatttagaagcattttcagatgacatttgcaatttattctcatggggagaattctgagtttgatgtctggacctctgataaccttcaatatactgcttaaactgctcatggtcttgatttcccatatatggaaattgtatctggggttttgggaaatagaagtaaataggctttaaaagctatagaaagacagacagatagatagatgatagatagatagatagatagatagatagatagatagatagatagatagatagaggtaagtagtgagcatgcctaattattagggagtaaaattatagtttaaatgaataaattctatattgaaatctacctactaccttatccacaagttagttgaatgcaattttaggaaatcaaaccaacaaagagtttaaaagaagtagaattatcaaaatttcagtggtttcgggattttggcaacagcactgaggactaacttcaggcaaaatgtcttgagagaaagagtggggaagatttgagaggagctaaatattgagatattaagagtataaactgtgagatgggtaaattattaattacatgcaaagtaggcatgtaaaattccatgtgaagtactaaaacccaagagaaatgaatgattttgagtaatttctttcctcaaaatcgaatgaatttgagtaatttcttttctcaaaaaaggaaaagtggcataatctatgatgtttagcccaacttgaaagggattcttaacaaatgctatgagctcacagtcatagtaaagtaggaactttattcactgtgttggcaagttagaagttgaaaatttaaaggtttttttttggcataaggtactgaagatgaagaataagggctaaagaatatccattgtgagttaagattaatggagaggagaggccaaaaaagaggaaggaaaattgttatttttaggaactctaaatagtacatgaaagtgaatcctgtatcatgacctattgtatgctcaacaaaaaaattgtttctttggaaaaatacagaaatctgcttttattccaacaataataaaagagatatattgatcatgacatttaaaagagattcccaagtagctataatttggagttaagaaaatgatttaacaatgcttaaactgttgcttaagtttaaagagaaaatagtatgttatttgtataataaaaatagaatatcacaagaatatgcttgtttctactctccctcaaatgtgtttaagtttaaatggaactaattgtgtttatgaaatctgaggaactcatgacatgctgaattcaatgaagtacagtaacatgtatatcggcgtcacttaacatgtatttatggaatagaatttcactattaacttttcctttaggattagaatttggttggaaacaggaagtctgaatgacttctctcactgtaaacaaacaagatgctaaaagtcttggactaatattctaatattttccttttacagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaacagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataatttt

SEQ ID NO: 36944 - DNA, 342843 bp, Homo sapiens
gaccactgtgagcccgcggcgtgaggcgtgggaggaagcgcggctgctgtcgcccagcgccgccccgtcgtcgtctgccttcgcttcacggcgccgagccgcggtccgagtgagtgcggggcgccgggcgcggggcgcgggtcgggggctgggcgggctccttctgtgcagcggtcgtgggctgggccgcggccctgagggcggaggggcagagcggggccgcccaaccagtcccggggcggatgcggcggagaccggcccctcccgcgcccccggcccgggttctgggaggaggggaggccggtggccgtgaggaggttgggggccctcgcggaggccgagaggcttaaggaggtcagggggcgcgctgggaggcgggggttcggggcgctgggtggtcgggaggcttggggaagactgggaggctgagggacgtggggaggccgggagctcgaggaggtcgggggttttgggggcgcgcggggaggccaaggggttcggggaagacagaaaggctgggggacgtggggagtccgggagacgtgaggaggaaggggggggcggctttcgaaaaggccgggcgcgcggagaggccgaggggcctgaggaagacgaggaggccggggctctgggggcgcgcagggcggacagaggcgcggggaggacgggccggcctccgccggagcggacccaatgcctgaaaaacaaaaggggagaggcaggaggaggaagagggaaatcgcagggacgtcggcagggttcgcccggacgcgagagggaggctcgcgacggcccgacctccgtcccccgggcgcggcctcgcgggcagccaagggtgggctccgagcggcctgccggtgcccgagccccaagcccgccgtgtccccgaacgcaaaccctcaagtttggtagagccccgtgggcttcttggcgggagccctggagccctcactgaagtcctcactggagtcattgtgcttcccaagttttctcctcttccccgcccccagcccccgactctgccgcggtggcttaggcgcaactgtttgccgaatttctctctgggttccttgtgtagcggcatcctgttctttcttagaagaaggggtgtgtgtgtgtgtgtgtgtgtgtgtgtgtgtgtgtgtgaattggtttcatttaattgcagaattttgtagctaaattcagtgagggtaaagtttctttttttttttttttccgagtcatttcaacagtgtctcattcttgcatagttagcctgcagctgggtttttggcaatgagactaagataatagtaatattgtagtaattatgggaactggttatacattcaagctgaaagctgaaggcagtgcaagagtttggggatttgtatttaagacttaaccatcgctaggatttttacttagaatgtaaacgttttcatggctggaaaaacagaccagtactatttgaaatgaaataccagagcctcaaccttaatattttatttgggaaacgggtaatgaaaatgatgtcttcgagagttgagcactccgtcccatatttgaaaacttatgagcagtgcgatgcaagcacacggatgaactagttacaagacacataaaagtaaactagcattcaacgtatttttgttggggtacagtatagataatattttcatccagttatactagccaattaattagaaaagccctatgatattcaaacaaggaacattttaaggatgtttgtgtcccaatatctttgtgttttgtatttgtggttatccttggtggggaaaaacaggctgaacctaccatcattttgaaccttcttgtttattaaactgcagaaacaacaagatcaatattacaaggttttcctttaaagaatttcaggtcactatcaaataatctagtttaataatgaacacaggcacagattatttaaaacacatgcttcctttataagggagccgacaatcacctaagacttcagtgtagacgctgattagaaggacccatacatcattcagtggtgatgcatcaagaagcaagtcattggttaaataaagacatggaaatcaaaactccatgtttacggtttggggcaaagaatactggggcaaactctgagaggagatgggacttaaaaagccttattatttgaggctggaagcccattgaaagtgaataatgttagattaggagtgaagttccatgaatccagcagtgaaattgtgaggaggcagtgaggatcattaaaacgttttatactaaaatgttttctgaaaagcaccatgcttcttgatggaaattacataacttactccctcagtcctcaaaatcatgttctccagctagtcagataactgttctttctagggagttggagaaattgtctaagaaaatagtttttttttttttttttttgagacggagtctcaccctgtggcccaggctggagtgcagtggtgcgatctcggctcactgcaagctccactgcccgggttcatgccattctcctgcttcagcctcccaagtagctgggactacaggcgcccgccaccacgcccggctaattttttgtattttttagtagagacggggtttcgccgtgttagccagggtggtctcgatctcctgacctcatgatccgcccaccttggcctcccaaagtgctgggattacaggcgtgagccactgcgcctggcctgaagatcctgttgttttaaaggtagcctctttaaaaaaaaaagattaggtcctgtagatgaaattatttatattgtattctataatgtaaaaaataattttgaaaactgtcctttcctgaatgttgatttgagttagagaggtaggatcttagttcatatctctaaaggttatggaaacctttttccccttgtattttatgatgtcttaatttttagaaaataattaaaattatcttgagttacaaaagatgcatttcaaagtgtttataaagtttcagttttgaaatttaacattttcagtttaggcattctaaactgatgtagatttagacctagatcaattcttgttttaaatttcagtaacattaaaagttatactgtttgtatcatatttgaagtgaatttttcttttttgctggtgaaaaacatctgagaagtttagttcctgtagtataggcatatcttggtctgtttctagaccactgcgataaaatgagtcacacaaattggtttcccagtgcatataaaagttaggtttacactatagtaagtgtgcagtaacatgtctaaaaaagcaatgtacatttcttttttttgagacaaggtcttgttctgtcacccaggctggagtgcagtggtgcaatcatagctcactgcaacctggtcctcctgggctcaagtgatcctcccacctcagcctcctgagtagctggcactatacgtgcataccactactcccagctaatttttacatttttcgtagagatggggtctccctatgttgcacaagttggtcgtgaactcctgggctcaagtgatcctcccaccttggcctcccaaagtgctgggattacaggcatgagtcactgtgcccagctaatgtacatgacgtagtcaaatactgttgatcatctgagccttcagcaagtcataatctttttgctggtggatggtcttccctcagtggtgatggctgctgacaaatcagggtggtggttgctgaaggctgagatgtcaggcagtttcttaaaataagacaacaattaggtttgccacatcagttggctcgttctttcattaaagatttctccagagtatgtgatgctatttgaaagcattttatccacagtagaacttctttcaaaattggactcaatactcctaaacactgccattgctttatcaatcagtgtatgcaatattctagatcctttgttgtcatttcaacaatgttcacagcatcttcaccaggggtagattccatttcaggaaaccactttctttgctcatccctaagaaggaactccttatccgttcaagttttatcatgagattgcagcaattcagtcacatcatcaggttccacttctaattctagttctcttgctatttctaccatatctgcatttactttctctactgaagtcgtgaatccctcagagttatccatgacggttggaagcaagttcttccaaactcctgttcataatgctattttcacctcctccaatgtgtcatgaatgttaatggcatctagaatggtgaatcctttccagcatgttttctatgtacttagcccagatctatcagaggaatcactatctatggcagctatacccttatgaaatatatttaagacttaaaagtcaaaatgtcttcttaatctatgggctgtagaatggatgtggtgttaacaagcatgaaaacctcattgatctctttgtacatctctctcagagctcttggacaacaggtacttggccaatgaacagtaatattttgataggaatctttttctgagcagtagatctcaacagtgggcttaaaatattcagtaaaacatgctgtaaacagatatgctatcatccaggctttgttattccatttgtagagcacaggcagagtagaattagcatcgttcttaaggaccctgggattttcagaatgggaaacgagcattggcttcaacttgagatcaccagctgccttagcccctaacgagagtcagcccatcctttgaagctttaaagccaggcattggcttcatctctctggctatgaaagtcctagatggcatcttccaatagaaggtggtttcttcatttaaaatgtgtttagtgtagccaccttcatcagtgatcttagctagatcttctcgataacttgctgcagcttctccaccagcacttgctgcttcatcttgcacttttatgctgtggagatggcttttttccttccacctcacgaaccaacctctgctagcttccagcttttctgtagcttcctcacatcaatttacagaattgaagaggaggagctttctctgaattaggccttgttaggccttgggtcaagggaatgttatggctggcttgatctatctggaccactaaaactttctccatatcaacaataaggctgttttcttttcctttgttttgttttgttttgttttgttttaagagacacagtctcactctgtcacccagtggcgcgatcttggctgactgcaccctccgcctcacgggttgaagtggttctcgggtgtcggcctactgagtagctgggattacaggtgtgagccactgcacccggctaaggctgttttactttcttatcatttgcgtgttcactgaagtagcacttttaatttccttcaataacttttcctttgcattcacaacttggctgtttggcacaggaggcctcgcttttggcctatcttttttattttattttattttatttatttattttgagacagagtctcgctttgtgccccaggctggagtgcagtgatgcaatgttggctcactgaaaccttctgcctcctgagtagctgggactacaggcatgcaccaccatggccagctacttttgtttgtttgtttttttagtagagacggggttttgccgtgttccgcaggctgttctcaaactcctgagctcaggcaatccgcccaccttttcccaaagtgctaggattacaggcatcaccactgtgcccggccctatcttggtttttgacgttttttctcactaagcgtaatcatttctagctttcgatttaaagtgagataggcgggactcttcctttcacttgaacactttgaggccattatagagtttcttttcttttttttttttttttttgagacggagtcttgctctgtcgccaggctggagtgcagtggtgcgatctcggctcactgcaacctctgcctcccaggttcaagcgattcgcctgcgtcagcctctggagtagctgggactacaggcacgtgccaccatgcctggctaattttttgtatttttagttgagacagggtttcatcatcatgttggccaggatggtcttgatctccttatcttgtgatccacccacctcggcctcccaaagtgctgggattataggagtgagccacgtgcccgtccttttttttttttttttgagacagagtttcactcttgttgcccaggatggagtgcaatggcgagatctcagctcaccacagcctttgcctcccagttcaggcgattctcctgactcaacctcctgagtagctgggattacaggcatgtaccaccacaccaggctaattttgtatttttagtagagatggggtttctccatgttggtcaggttggtcttgaactcctgacctcagatgatcctcccacttcggcccattatagaattagtaattgttctaattgcagtatttttgtatctcagggaatagcaggccacaggagagggaggagagcagaagagacaggggcccagtaagtggaatagtgggaatgcacatgtttatagagtaaatgtgtatctcatgtgggtacaggtcatggtccccccaaaacaactacagtagtaacatcgaagaccactgatcataggccaggtgcagtggttcacatctgtaatccattgttttgggaggattgcttgaggccaggagttcaagatcagcctgggcaacatagtgagaccctgcctctaaaaataaaaagagatccctgttcacagatcaccacaacagatgtaataataatgagaaagtttgaaatattgtgagaattaccaaaatgtagcacagagactcaaagtgagcacatgctgttgaataaatggcactgatgacttgctcgatgcagggttgctgcaaatcttaagtttttaaaaactttttagtaaatgctgttaattgtagcttgatttgcataaatactctaatgaaatggtttgtagacaaaagcaggaaatagttgtttttgccttagtggcactgtcctcccccttagcagttggaagcctcagagagacactagtagcatcactacaaagtttacatgtttttaagaacatgaaagtatttccttacaatgtttaattaaattttatttaattgaaatcctacccgaatcttactgatatacattttctttactataaattcacttttttcagaaacagataaatgacaaaaatcatacctttgggtggggtgcggtaactcacacctgtaattccaccactttgggaagccgaggtggacagatcgcttgagcccaggagtttgtgaccagcctgggcaacatggcaaaacttggtctctacaagagatgcaaaaattagatgaatgtggtggcgtgtgcctgtagtcccagctacctgggaagctgaggtgggaggatcacttgagtctgggaggtcgaggctgcagtgagctgagattgcaccattgcactccagcctgggcgacatagtgagactctgtctcaaaaaagaaaaaaaagtcatgtttgtgggttatctgtgcctagggtctcttttttgccctcatattcttattaaaattcctgcattttgggtttggattctgctgtgaactgtaggtgcttgttgtgtctgtgtctctcttgaccaaaacactatatgtttgtctttgttggtccaatgaaagagcttaacagttttatgtgttacatattttgtagtaaaatgtgtgttgtcttgtgagaatgtaagctccacgagggcataaactttgttttatacattattgaatcaccagtgtcttacacagtaatatttattgaatgagtaaatgaaagaacccaggtgtattgattattggagaactgttacttgcatcagccaggtgtttactgttttgtttgccctggtaaagaacgtcacttaaaaatcacataggggccaggcacggtggcgcatgcctgtaattccagcactttgggaggcagaggccagcggatcatctgagctcagactcacatagggcttgataccagggaagaacttggagttatctttttcacctttgtctactgtatttaaaattactactatcagacttgggccaggaaaaaaatattgctctgctctttcataattttggaactttttttctagaaatcaatcttgtaggaattgattgggactcatcctaagttctgaagacatggaaaattgtttgaggtgacacaaaatgatggaagtttttattactgatccagaagctctaatgtaccttttgctaatcaactggattaattggatgctttacaaaggtttaacattatgcccctaaaccatttaaaagaacaaacgtcttcttaatgttgaagtgtgagttatgcactgtgccgctcatccttgaccttgttcagagtcttttgctgctgtgctgctgttcagataaaacattttgaaagtgacagttcaaaatacattcactcaggtaatggaagtcaacatttgggtacagaatctctccctgagattttgcagtttgcctctcagtgaattccaccatagtcttgctatagtgtgagggggtaactcattcacactgttcacgcacacgttccagtaagctccaggggctttcagtggttttcagagtagtgacggaattgtagcatcactatcatctagaaacttgctagaaatgcaagtgctgaggccctacctctggcctcttgaatcaaacactgagggtggtgttcagcaagcttttttattttgttttgtttttgagacggagtcttgctctgtggcacaggctggagtgcagtggcactttctcagctcactgcaacctctacctctagggttcaagcaattctcctgcttctgcctcccaagtaactgggactacaggggtatgccaccacgcccagctaatttttgtatttttttttttttttttttccgagatgaagtctcactctgttgcccaggctggagggcagtggcgcagtcttggctcactgcaacctctgcctctcgggttcaagcaattctcctgcctcagcctcttgagtagctatgattacaggcgcacaccaccacacccggccaatttttgtatttttggtagagacggggtttcaccatgttggccaggctggtctcaaactcctgacctcaggtgatctgcccacctctgcctcccaaagtgctgagattatgggcatgagccactgtgcctggcctgttgtttcatttttttttgttttgtttttctttgagaccgggtcttgctggagtgcgcgatcacagctcactgcggcttcgacctcccagcctcaggtgatcctcctgagtagctgggactacaggcgcatgccactacgcctagctgatttttgcatactttgtagagacgggtatttaccatgttgccagggctggtcttgaattcctgggctcaagcagttctcccaccttggccttctgaagtgttggggttacaggcatgagccaccatgcctggcctcgcaaggtttttaaacttgccatcttggtgctttgatgcatgctaatgtttgtgaaccactgctttagggtgttttgaaagaaatgcaagtcataggaggcaaaaattagtcttaatttgaggtatgtgtatgttgtcttcttgaccacttagatttgctaaggagattgccctcacttcaggaatctaaatatgttttttaggattttcaaaatcttggaaagatctcaaaactgcttttgttagggattttgaatgttttatgctaatactgattaattatttttaatcttggtttggaatttgaatgaacaattttacattgaaatagcagtttgtatggctcctggacttgtggcttttggcaaatatcaggagagtgtgtgtacatgttggtgcttaaggcacaagctccctggtggttttgttttggtgctgaaaaattggctagcatataataacagggtcagggtgattgccaagtcttggggtaactaatgaagctgtattgtgtgaattgatttttattcctggtgttgaattattgcctaaattcaatacattcttttgccttttgctcttttctcctaagaaaagggtaaataaaaattagacagtccacaaggatgaagttggtgatgtcgcttaaatctgttatatcttatgcagaattagacgcataacttggcagacagaatgttgtgagctcagagatgaggattctgtattatctgttaggtatctttgagtcccccacagcttgatcataatatcattataggtggtcagtaaataatgtaaggagtgaaaaagagtctcccgtccattctctgggttttcagcatgttgataattgaggaatatagatatgtgaaagccccgtaaagagtttcaggaaagatcaaatatctgaagggaggcaattagaaagactaaaatgactttattgtatagtctttgttgtaaagggtatttaagtatatgaaagttaacaagatagagaagaagagtagggataaacaaaattaaaataatgtaatctaaaaacaatgagaaggatgtttccacatgaatttcctactgtgatctttcactcaactgtgcagctcaatgaaagcaaaaataatagaaatgagatggtgggaaaatcgacctggaacaatttcttcttgagacaatttgttggcctggcatgttgactcacgcctgtaaccccagcactttgggaggccagggtgggaggatcacttgagcccaggagtttgagactagcctggtcaacatggtgagatcttgtctctcccaaagaatataataataataattagccaggtgtggtggtacatgcctatagtcccagctattcaggaggatgaggtgggaggactgcttgtgcctgggaggtcaagtctacagtgagccatgatcacaccactacactccaacctgggtgacagagggagaccctgtctcaaaataaaaaaaaaaaaaaattggtcaaggagagttaaagttataacttatagtcagttatattctgcgatgaccattaaatgtacttttaagagtgcttggcctgtagtagcttttcaggaaatgttagtaaataagtgattcttctgttacttgtcactaaaaggttaggctccaatcattgaccattttctctggttacttcagcactgtttcctcttctctgctcttataacctgtctcccctctgcaccccttttgatggtttatatagtgtaccgccttgtggttttaaatactctttttctgattataatgaggttgctctttttttttttttttgagacaaagagttttgctcttgttgcccagactggagtgcactggtgcaacctcggctcaccgcaacctccgcctcctgggttcaagcgattctcctgcctcaacctcctgagtagctgggattacaggcatgcaccatcacacccggctaattttgtatttttagtagagatgaggtttctgtatgttggtcaggttggtcccgaattcctctccttaggtgatccgcccgcctcggcctcccaaagtgctgggattacaggtgtgagccaccgtgcccagccgaggttgcactttttaaaataaatttgctggccgtttgcatttactgttttgccaagtgcctgtatttttctattaggtcttctttttttttttttaaattcattaatttgtagcttctgtatatattcagaatccaagtcctttgttggtttatatatcttgccagtgtctcctgctttgtggcatgcggtttcactgagtctcagtagtttttttgtttgtttgtttttttgagatagggtcttgctttgtttcccaggctggagtgcagtggtgcagtcatagctcgctgcagcctcctactcttgggctcaagcaatcctcctccctcagcctcctgagtagctgggaatacaggtgtatcaccctgctggctaattttaaattttttttttttttttttttttttttttagagacagggtcttcctatgttgcccaggctagtctcaaactcctgagctcaaccagtcctcccgcctttgcttcccaaagtgttggaattacaagtgtgagccgctgtgcccagcctcaaaagtgttttttggataaacagaagttaagtttaatgtagtccagtttatcagtcttttcctttatagttcctccttttttttgtcttccccaccctgaggctgtgaagtaattcctctgttattttctaaatgtttaataattttgcattttatctttaactgtataattcacttggaatagattttggtgtatagtataaggaagggattaaatcaacttcattttaatatgtggacatctagttatcccaacaccatttattgaaaagagtatctttttccctacttctctgcagcgccacctttgttgtaaatcacttgtccgtatacgtgtgtgtctttttttttttttttttttttttgggatggagtcttgctctgcaacccaggctggagtgcagtggcacgatcttggctcactgcaggctccgcctcccgggttcacgccattctcctgcctcagcctcccgaatagctggggctacgggcgcccaccaccatgccctgctatttttttgtattttcagtagagatggagttttactgtgttagccaggatggtctccatctcctgaccttgtgatccgcctgccttggcctcccaaagtgctgggattacaggcatgagccaccatgcccagccatgtgggtgtcttgtagactctgtgtttttagattctttgattccacaagcactaagctgtctaagttattatagctttataataagtcttatctcattgtggaacccttcctacttgtctcttcttcaagagtaccttggctgttcttgaccttttgcagatcaatatatgttttagaattacttgtcaacttctaaaataattcttccagatgttgtttgggattacattgaaggtctacatctattcgtggagaactggattattatagatctctgaatatttttgtacaaggctttgtatgggtgtagactttcatatctcttgggaatggttggactaggactggaatggctgaatcatatggtaggtgtatgtttaactttttttttttttttttttgagacagggtctcactctgttgtccaggctggagtgcagtggtgtgatcactgctcactgcagcctcaacctcccaggctcaagtgatcctctgacctcagtcgctggagtagctggaactacaggcactcaccatcacacatggctaattaaaaaaacatttttgtagagacgaggtctagtcatgtttcgcaggctggtgtcaaactcctgtgctcaagcaatcctccagtcttggcattccaaagtgctggggtcataggagtgagccacgtcacctggcctgttgaaattcttaaagtgccaaactatcttctagatttgtaccattttgcattcccaccagcagtggatgagagttctggttgctctgcatcattagggcaacactcgttattgtcagtcttgtacattttagccattttaattcagtgtgtaatggaatttcattgtggttttaatttgcgtttcccaaatgactgatagtgttgagcatcttcttatatggttatttgccatccgcatatctctgtgtttaaatcttttatgcattttaaagttgttagctgggcaccgtggctgatgcctataatcccagcactttgggaggccgaggcaggtggatcacttaaggtcaagagttggagaccagcctggccaacatgacgaaaacccatctctactaaaaatacaaaaattagctgggcatggtggcggacgcttgtaattccagctactcaggaggctgagacgggagaattgcttgaacctgggcggcagaggttgcagtcagccgagattgtgtcactgcactccagcctgggagacagaatgagactctgtcttagaaaattttaaaaaaaggtgtttttttcctccatttttttgggttttgagagttctctatatgttctggatataaattgtttatcagatacatactatatttttctcccaggttatggctggctttttcattttcttaacagtggcttgaagagcataaattatacgttttgatgatgtcccatttatgagtttgttgctttacgggttgtgtttttgtgtatgtgtcatatttaagagttgccaaatcctaggccacaaaggtttttctgatttttttctcctagaagttttagattttacttttaggtttatgatttaattttcatttatggtataagatttggatccaaatgatttgtaggattcttttgaggcctggaatgagggtcgcttcctccagagaacacttacttttgcgtcagccagtgtgggatctccttaaaccgaattcaaggcttgagattgtttggacccctcatagctctagttctgctggatagttggttcattactggtttactctctggaggtgtgtagccttttgggttcttgcttactgtagtggggttttgggttatatgttttggaggacccagtcttttattcctgtctccccctctctgcactgtcttaaaaatgaaagttgagacttttcagaattggcaagtgcactgagggcagaggtagtttctgtgcttatctctttgacttcctggtttcacttcaatttttgcctgttatttatttcttgtcttgtcaggttgtggttgcttttaagattataaaaatattctgtccatattttcttttagtctttttcagaaggagggttggaccaaataacattgcttgaaattaagaagccaaaacgcgttcttttttatttcactccagagtctagacctgaacctgatgtttgatatggtaactgctagccacatgtggccaattaaattgaaattaattacagttaagcgaagttgaaaggcccattcctcagttacactagtcccatttcaagtgctcattagccacatgtggctagtggctactacattgggcagcgctggtatagaacattttcatcattgcagaaagttctagtggatagatatggcttgactatcaaaacctcatcagggacttgcactggtacgtggatctgcatttgaaaaccactaatatgggtatccttgctgtttaaagtttgaattttttggaatctatatagctagacagatgattgagttcctttaatagacttactgtgaaatctatccctaaggtacagtgtagattcttagactgatttaggtggtgaaatgtgaatctgtggcacactgagtagataactattaagtattgatattttaacttacaaatatgtcagttttaactgagaaattttgtgaaagcatttattatatgttgatctgtgtcttagacccagtgtctcccattgcacttgccctgccatccctgcccttaggcagtcatagtgctgtgcaaagttgcagggcactgtggggttctggcgggggtgtcacagcacccactcttgagggaacaatgggaattagccaggtggggagaggaattagccaagtggagaggggaaggatgggggaaaaggttctagggagaagaaaaacatgggcaaaagcctggatgttgatgagaaccgtgtggagattggtttgaagcatcttaaatttgatttctagtatcaagagaggtagctgaaaccatagatttttaaaaatgtcatgaggccaggcacagtgactcaatgcctgtaattcgagcactttgggaggcctgggcgggaggatcacttgagtctaggagtttgagaccagcctggggatcatagtgagaccttgtccctacaaaaatttaacaaaattagttgggcatggtggtgcatacctgtagtcccaggtactcaggaggctgaggtgggagtattgcttgagcccggaaggttgaggctgcagtgagttatgatcatgccactgcactctagcctgagtgacagactgaaacccgcatctcacaaaaataaaaaaataaaaaaagaagatgaaaagctatgtcaggatattctgtccatttgcacagtatttcctattaactggtaatataatgttattacagttgtgttgggatctctcattctagctcacagagtaccaatcttttgattatgtgtccacagttgttagggtcagaggacatgcctgaagtagtcccagctgtccctttctgccaatttaaccgtgcactagattcatgcttggtagttcctgggcacatttcaaggaactcgggggatgttgagtggagtcattcccttattgtctattactctaggaggaggaagggttcagataagtcagtaagttgagctgtggtttaggctctgtacaagaggggcggtaaagatgaaggagtgggactgaggatgggtgtggaggaaaggttagggccacttttcatcgccacctggggtagcttgccagcacatgtttacctttggtttgggatcacagcaagcagaagagatgaaagctccctttaaccgttctaggatatgtatttgaattggagaaactacctcaaaatagagtgtgtgcaggcactatatgaaggcttctcagcgtttaagtgcatacatgccacccagggatctcgttatattttaagttccaattcagtctgtctgggaagggctcagacttgcatttttcctaagttcccaggtgatgccagggctggtggtctgtggaccatacttggagtagctaggcattggttttcaaagtgtgggttgcaaggtggcactgagtcttagtttgaaagttgaataaccactgttgattgcggtagttaagggcatggagttggggtcagaatcctggctctatgatcttgggcttgtttgttaagttttctaatctctatttccttgtgtggcatgtgattgtactacatgattatgtaatgcttagtcttttttttttgtttttttttgagacagagtcttgctgtgtcacccaggctgccaggctggagtggagtggcatgatctcggctgactgcaacctctgcctcccaggttcaagcaattgccctgcctcagcctcccgaatagctgggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaaggtaacagttattaaaagtaaatgtttacattaaaagtttgccagttttcaaagtgctgagtcttccctgcatctttgctcagtttgtaaaattgcacctccctccctccctcccttcttctctccctccctccttccctccttcctcctttccttccttccttcttccttccttccttccttcacttccctctctctaggacagtgatgaaccagccttcttgtactggaggaatacaccatccgtcttcataaagactggcaggcacatggacaagtttaccagttataatgcttttcttacacattaaagaagtaggtgtttgtattggggcttcaacaaggacttggaaaactttaagataatacaactacatagtattcctttaggtgaatatcgtttcagtttctcagatcattgatgaaagccttaacaaagattttttttttttttttttttttgagatggagtcttactctgttgcccaggctgaagtgcatgatcttggctcactgcaaccttcacctcctgggttcaagcaattctcctgcctcagccttccgagtagctgggattacaggcacctgtcaccatgtgtggctaatttttgcatttttagtagagacagggttttgctctgttggccaggctggtctcaaactcctgacctcagaagatccgcctgccttggcctcccaaagtgctgggattgcaggtgtgagccaccacacccggcctagattttaaaataagcatctgtttgtttctttttttagttgccactagtaaggatgatggaaaactatattttgtactaaggattttgaaagatagaattctttcaagtgagaattctgtgacttttctgttaaatgcgtatttaataactaaaaatacaaagcttcaatgtgaaaaccttgtagaagttttcaaacatatacagaaacaatgttgtaatgaattccctgtttattcattaccactttcagccatggttattatttaataagtattgttaactctttaaaggtactggttcatacttaaaagttgtgaagtaacttgcttctgaaaacgtacgctaacattggacaactcctgctaaaatgtgacataattcatgatgcatttctttaaaaaagatagggaaggaattgaatatagctctgctgcttttctaaggttcttctgtgagtgggtgatgcagctgactgtcctgtgtctttctttctttctttttttttggagattgagtcttgctcagttgcccaggctggagtacagtggtgctatctcggctcactgcaacctccgcctcccgggttcaagcgattctcctgcctcagtctcctgagtagctgggattacaggcacccgccaccatgtctggctaatttctgtatttttagtagagatggggtttcaccatgttggtcaggctggtctcgaactcctgaccttgtgatctgcccgcctcagcctcccaaagtgttgggattacaggcgggagcctccgcacccagcccccgtatctatcttaatgatgcagtgtgtatctatcttaatgatccaatgtgtatcttaatgatccagtgagctaagcaaggcggtggggactctccacagacttggagcctttagttggaaggttcttttcttaaaactgtacttgaatcaaaataaactgtagcttgctatgctttgctgtattggtttaatgttcctgatagcagtacatgtctgtttttaactgagtcatttttttttttttttttttattgagttggtgaagcgtggagctttaatagagcaatatttatgaaagaaatatgctaatctttttcaaaaaatgattaaactgaagaaatacaaaagaatatgtgtaaaatataaggtagagataatctctaccttcttcaagaatgctctgagctctgagaacctggaggaaggacacccaagtcagccttggttaagtccctagttatgccctaggtcaggggctagcagactttcttcgtgaagggctagacagtaaacattctaggctttgcaggccacctgtgacctctcacaagtactcagctctgctgtacagtgctacagcatccatgggctgtatgtaaaggaatgagctggctgtgtctagtaaaactttagacactgaaatctgaattttctataattttcacatgccgtgaaacattgttttagtttctttaaccatatacgatgtaaaaccatttttagctcacaggttgtacaaaaacaagtggggccacattggcctgtgggtcatagtttgctgttctcgtgtagagggtgataacaaagcaaactcctaggtacctcctgcccagcttcaacagtgggattttcccatgcccttgaaaggccagtgtgtgttccctgatcacatacccttccctcctgccccacaggttctgtcccatcccactcccacccctcacaccggtgccactctgtaagtgaagccttaagtcacctctcctgaagacatccttccttggccccgctcagtgtttcatttcttttcaagcccttttcaccatctgttactgtttgtattttacttactttttagtttctttctctcttggtggtgacataaagtctgagggcaaaatgtttctctgttccctgttgaatccctgacatttaaaacagtggtcattgaatgatattgtttttttccatttctttttcttttctttttttttttttccagagcaggagtggaagtttattaaaaagctttagaggctgggtgcggtggctcatgcctgtaatcccagcactttgggaggccgaggtgggcggatcacgaggtgaagagttcgagaccagcctggctaacataatgaaaccccagctgtactaaagatacaaaaaaaaaaaaaaaattagctggccatggtggcgggcacctgtaatcctggctactcaggaggctgaggcaggagaatcgtttgaacctgggaggtggaggttgcagtgagccaagattgcgccactgcacaccaacccaggcgacagtgtgagactctgtctcaaaaaaaaaaaaaaaagctttagagccggaaagaggaaaagtagacttggaagagtcccaggcaggcgacttgaaggacaagtacctgtttttgccatttcttcgtgttttgtctgttttgaactttattttattttttatatttttgagatgaagtctcgctctgtcgcccaggctgaagtgcagtggcgtgacctcagctcactgcaacctccgcctcccgggttcacaccattctcttgcctcagcctcctgagtagctgggactacaggcgcccaccaccatgcccggctaattttttctatttttagtagagacggggtttcaccatgttagccaggatggtctcgatctcctgacctcgtgatccaatccgcctgcttcggcctcccaaagtgctgggattacaggcgtgagccaccgtgcccggccgaactttatactaagggtatcatgctatatgtctttatatgacttgattttcttttttcctcccatcctgcactctgattttaaaacttaggtgctgtatgatagttttcattcattttcactgttgtgtaatctagcctacaattgatgggcagttggtttgcttgcagtctcttgctgtactgcaaacactgccacacaaatgtgaacactcttattgctcatagacatggatgtgcatagcctatgtatctaggagtgtgattgctgagttatagggctggccagtcttcaacctgactagttactgccaaattgcttcccaaagtagttataccaatttatatcaccactaatataatgactccttgtattagtttgttttcacgctactgataaagacatatccgagactgggtaatttagaaaggaaagagatttaattgacttacattccacatggctggggaggccccacaatcatggtaggaggcaaggaggagcaaagtcacattgtacatggatggcagcagtcaagagagcttgtataagggaactcccccttataaaaccatcagatctcatgaaacttagtatcacgagaacatcacgggaaagagcccgccttatgattcagttacctcccaccggtccctgccacaacacataggaattgtgggagctacaattcaagatgagatttgggtggggacacagccaaactgtatcactcctgttgttccacatccttgtctgtagtttattttgtctgactttttcagttttgtcattttggaggttgtgtcatatcttattgtggctttaatttgaacttcccttattagtaatgatgttgagccacttttaatatatttgctatctgttttgtcttctgtgaaggacctattaagtttctggcctttttttttttttaattgacttgtagctgttctttctatgtgtggattgcaatcctttatcattatgtgttgtgaatattttcttccagtttgtggtttgttttttttacctgtgaggtgtcttggagctaaagttctttttttttttcttttttttaatactttaaggtttagggtacatgtgcacaacgtgcaggtttgttacatatgtatacatgtgccatgttggtgtgctgcacccattaacttgtcatttaacattaagtatatctcctaatgctatccctcccccctccccccaccccacaacaggccccggtgtgtgatgttccccttcctgtgtccatgtgttctcattgttcaattcccacatatgagtgagaacatggggtgtttggtttttttgtccttgcgatagtttgctgagaatgatggtttccagcttcatccatgtccctacaaaggacatgaactcatccttttttatggctgcatagtattccatggtgtatgtgtgccacattatcttaatccagtctatcactgatggacatttgggttggttccaagtctctgctgttgtgaatagtgccgcaataaacatgtgtgcatgtgtctttatagcagcatgatttatagtcctttgggtatatacccagtaatgggatggctgggtcaaatggtatttctggttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctcttggctgcataaatgtcttcttttgagaagtgtctgttcatatcctttgcccacttgttgatggggtcatttgatttttttcttgtaaatttgtttgagttcattgtagattctggatattagccctttgtcagatgagtagattgcaaaaattttctcccattctgtaggttgcctgttcactctgatgatagtttcttttgctgtgcagaagctctttaatttaattagatcccatttgtctgttttggcttttgttgccattgcttttggtgttttagacatgaagtccttgcccatgcctatgtcctgaatggtattgcctaggttttcttctagggtttttatggttttaggtctaacatttaagtctttaatccatgttgagttaatttttgtataaggtgtaaggaagggatccagattcagctttctacatatggctagccagttttcccagcaccatttattaaatagggaatcctttccccatttcttgtttttgtcagatttgtcaaagatcagatagttgtagatatgcatgcggcattatttctgagggctctgttctgttccattgatctatatctctgatttggtaccagtaccatgctgttttggttactgtagggaactaaagttcttaattttaatgtcataagctttatttcttttttcctttatgatgagtactttttattgttttgatttttttaaggaatctctctttatccaagggctaagttttgatgtgaagtatttttatttagttcataaagcatttattattattattttgaggcaaagtctcattctgtcacttaggctggagtccagttggacgatcacagctcactgcagtatttttttttttttggacagtcttgctctgtcgcccaggctggaggggagtggtgctgtctcgtctcactgcaacctccgcctcctgggtgcaagcagttctcctgcctcagcctcctgagtagctgggactacaggtgtgcaccaccatgcccagctattttttgtatttttagtagagatggggtttcaccgtgttggccaggatggtctcgatctcctgacctcgtgatctgcccactttggcctcccaaagtgctgggattacagacgtgagctaccgcgcccatgctgcacactgcagtcttgacctcccaggttcaagcgatcctcctgcttcagccttctgagtttctgggactagcaggtgtacacattaccacacctggctaatttttaaattttctttagagatagggtcccactatgttgccaaacttggtctctagctcctgggcttaagcagtcttcccgccttggcctcccaaagtgctggatttacaggcaggagccaccacacctggcccataaagcatttattgttctatttaataaagaagtttaatatttagacatattttgtaaattctactgattcctttgatgattcatgatttattttaaagtgtttgataaattacaaacaaatgagctttttttcattgtatcttgtgacatttctagaattggattgtagtcagaaaatgtgttctgtatgttaccaattctttgaaattaatgttgtcttaaatagacctatattgtagtagaatttggctaaaatcttggtctcaactcagaaacttttaggtacctagccacttaaactccagctatgcctaagttataccttagttatgaaaaaaagattagactaacattattaggctttttaaaaagttaatagagtttctattttctgcctctggaaacacttgtgttgttttctggctgaagttgaggtgttaatgtacattatcagcttttggattctgttctacccaaactgaagcttaaagacaagtgactgcctcaactgccagtttgttttagcttagctgacaggcaaggagttcatgctgtgactgcagctgctttcctttcagtggcatttgttaattaagctgtttaattttgtgttgctttcccaaggactgattcttaaggaaaagagaaaatttttagcttgtggttattctgggaccttttagcctagtgtttattttgggtgtccatttcatttttttctccccagaaagtagcattaacttgaaaattatcagttaaatagtggctcagaaattaaattttatctgtctcctgaatctcaggcattagtaattgaagtgtctaggtattgtgatttttgtagagaggtattgtgtaagtgtctagatattgtagttgtgtagtctgtttaagagaaaatgcattttatctaagaaacaagacccaacttcaaatattggctctgcctttagtcatgtgacttttggcaagttagtttctgtgcttctcaagtccttatttataaagtgtagtttttatggtcttagcctttgaggttatatgtgcagttactgtgtagagtggtatacaaatgtaaggtgctaatgttgttaatagtatctttaacagacgtaagtagtgttttactactaaaggcacaggtcctttccatttaatgtgatttcaccagttcttgagctggttcattcagttaattcatttgttcgccatttaaaaaatactgttttgtgcctggtacggtattaagccctgaaggtatagacttgagggggagtgagactgttatagttccctggcatgcagcatgatgtgtgcagttgtctcttagcgtgctcaggcaatctggagggcaagtcccttgtgatgcccaacctcaggggtcggcagacttcccctcttaaaggccggagagtagaaacttcagccttcgggggtcgcatatacacatacagcctatcgcatttcctctaattttttcttcctttcttccccctcccccctctcctcaacgctttaataatgtaaaaatcattcttagtccaggaaccatgtaaaaactggctgtggactagatgtggtgacctctttgtaaagtatttttcagcggaagatgggaagtggattccactcatgtgcaaaggcatggaggtgtgagaggctggggttttgtggaactgaatatttttatcacatgtggagaaataggttgggtcgggtagagaaggatatgcagtcgatactgggcaggatcaaagcagtttgcacttgattctgatataaattttttacatcctagggcagcaagaacagatttagatggtaggaggatgactggactagaggcacaagatcagtaaggaaggtagtaatccacattagaaggggaaaagtcacccaacctttgtcattaaggaaatggctcacctgctgttatttagtaaagtgagagggataaagttcagaggtcgaatttagtaacatacagtctatttaataatagactgtatgttcttttaattatgttgtacatataaatgaaggacttaagggcacaactgaggaaatggagagtagggattgatgtgaagcctgtttctgagttcatctacaggcgtgactaagtaagtgaaatggcaaggctgagagagaaggaatccagcgtaattccaggatggcttccagattttttctttggtgatgagttcatgaagatctttttgctcttaattttttttttcctggaatatcttagtgattgctttgatgagggaacattgtctcttaggtccatgaacccctgaaattctaagcagaattgtgtgtgtatgtgagctgtttttccctggggagagaattctagagctttcatcacattatcagaaaggagtccaaccaaaaggaggaatcactttttgttagattgtacacatctggtgtactctaaaggtttgtgttggcaagggaaacatcatcccaatcacaggatttttactttaaatgtaatgcatctcaaactgccaagtaaaatgcaaacacatgcaactgttttctaagttgaactgtatcaaccagcaattggaatgtttttccctagtttctcctcctttccgaaagacagaataagacacatttttggtacataaaaagcgagctggagactgacgggcatggaatgcttcaacatgctatgaacattagagaaagctaaagtttgtagagtattaacgtatcttagtattcatgtggctatgagagatggtgtcacttttaggtaggatacaccagtaccataaatgagtgtagtttcctcagttggattagaaatgtgtaaatagtgagttgtaagacaatccctaaatcgtgctgtcatgatgagcccttagttgagcaaagcaggagaagcagggtggccgccgagcagttgttgagatatgagcatcaggcagattcgtattgtgttctggagtctgcactggattggttcatacttgatgtcagcattattacatgtaatttagggattacagactacagataatagcagtccctgcagagatttgatgaacttggtaagctgctccatatggagcagagagaacttaagagagtgaaaatggggcaatctgtaagaaagtttcttctttcctgttgagaaaaattgtgacttctattaaaggcaaagtgtgatggggcaaagatataagaaatgatggaatctagcagtggcatagaagtcaaaagtgaaaacctagactggttaagatatcactctcagaatttcacgctggggctaattgtaattccaaggtaggaaaaaagctttgaatctactttgcctaggtcatggcaaagtttaggtggcaagttttgttttctgtttggaaaaaatagtattggatcctaaggaattgccttgagaaatcagatagcagaaataacttagtttaagtgcatgttgtcaacatgtgggttaattttaaacagtacatggttgattatgtggttggcaaagagctgatgtctttgatttacatctatcctatgagtttgcctttttgaccattttattggaaagcaaacttttctgctgctttttttttttacgtgtgtgtgtatgtgtgccccttttactctttgctttacgtaatctagaattttaggggtatatctaaatttaggatccaaagcttttactttagagatgagtaagtaaataacccagaaaagtcaaatgaccatttgatggagaatcataggtgagcttactctccagccccatccaaaggtcaagcctggtgtttgctgtgggtcagggtccccaggtaaacaaagacagctttatcggacgagcttccaagagcttaaagattacctcccaggatctgggcaaagggccaaacttttctttgagcaaggcggttaatcctttactgcataagccctagcaaagcaaattattatttctgtcattactagggagttcaagaaattattattgctcctagatataagatatgttgtaaccacatacagtaacatttaccacgaaactgaaaaattagaatttctacacacaggtgaggatgtctccagaagtgtgtcatacttgacatctgttctaacatttctatcagggatttgaataaagaacaggagtcacactgggagacagttcatttttagaattttagatttttaaaatattttgacaggtggtaatgaagtggtaaaatccatagggtgaaatttgtcagcaataaatgtaaaatggcagacttagtttaaaaggaaaagcaactgagaaagctaaagctggacaaaacgtgtcttaactctaccagtgtgcggaagacctgggaatctagttgactaaaacaaggatcggtgaacttttttgtaaaggggcagatagtgaatattttaggttttgcagatgaataggcaaaacaagaatattatgtaggtatttaaataatgagagaaaacaaatttccacaaattttcatcgactgaattcaaaatataaaaacagtaattgaggctgggcacagtggctcgtgcctgtaatcccagcactttgggaggcggagggaggcagatcacttgaggtcaggagttaaagaccagcctggccaacatggtgaaaccccgtttctgctaaaaatacagaaacttgccaggcgtggtggcgtgcgcctgtagttgcagctactcgggaggccgaggcaggtgaatcacttgaacctgggaggtggaggttgcagtgagccgagatcatgccactgtactccagcctgggtgacagaatgagactccatctaaaaaaaattaacaattatttattaattaaaataataaaaacaattgagcataattaaaaaaatacaggtctaatgagaggaatggatttttttttaggggaggaggtggataacatttggctaaattagagtttgaacttagtgtttgctattatcaacatcaattacaagtgttcatctcttaatgctaatctgcaaggagattttacatattttatctttgaaaaatgtcttaatcctgacaggatacatcgaaatactgatagcagttcaggagcatattcattgcttagaaggcatttatagaattctattagattctccttgataattgccttctagcatgttattgcattgcagattaatcacttcctattggtggttagatggaagcacctcaattgcacagttaaatggattttgaaatatgtaaattttctttgtacttgcatcggagtttgaaaaatgctactggaatgtagtttgaacccagaaaatatatccactgcaaatttgcacagaattgaaatcttgctttttgttttaactttcacatacgagaagtatataaagaagcttaatgcaacttgtgattcaaatgttagctgtcattgaaatgactttactacagtataaattcctcatataagtactgttttcctttgtaaacttaaattgaatccattaagaaacatcaagtctgtagaaaaaattgattgcagagctattcagtgtttggtaacagtgttaactgaaggaggctcttttagaaaaatttgagtcttgactctaaggtcataaagttagaataaaacctaccactgtccatttaactgctgtgtggtaggccaagtcaagatactcagtttctatttctgacaaattcaaggaactgacaatggttaagtctacaagagctaatgaagttcactgtggatgctactggtccaataacacctgacagatttaaatactttctacatagtacttgctgatgaataaccataatactttcataatttttgtaaatttgtgcagcaaatcatttgtctgctccccatatatttttactatcaccagttattatcatgcatcttagtagattccacttcagattgtactaaattagtgttttctcagctttgaaaatattatttgtagttccacacagactattcttagagactaattttttagttacttcaaggttggcattgactccttgaataaacagttgagcaacgtcaacaaccaaggaaaatcattcaaaaatatttgcctttttttgactgacattgatgttgttatcagtatcctcaactctttgagcaactgttcttattgaaaagcttatagtcttaagcaagttttttgttttttggtttttttttttgacatatttctttgtctgttgtagtcagacatgttgtagtcagacaacttaacatggttaagttatccacataagatggagagccatttagggttttgagcagagaagtgatgacatctgattgagatttgacttcatctgcaatcagattgagatttgacttcatctgcaatgttgaggataggcaccagagcagcaaggttagaagcaggggacctgtcaggtggctgttgagttcatttgagtgaatggtgatgatggcacaagtcgtggtgatggtggaggatgtggagcaaagtggacagtttcttggcagatttgccaggaagagctgacattatttgctgacaaggttgaacatggagtgtgaggaataaaagagacaaggatgacatccattgttttttggcctggacaactggaaggagagagttgccaagaactgacatagagaagagtgtgtaaagaaggtttggaggagaaagatcaatatctgagctttgaaatgtctcttggacatttttattcgcttaactgatgtttcacttctctgaggatctagaagctggtccccagcatagtgtatccatgaggaattgttcaggaaaagagaagctgctctagacacttttttaaatacacaggattatagtccttcactactgttggaagggttggagaattgaaggtccaggaagcagctgttcacagtgtgtacttcccaggagctcatctgagatgggcagaggtctcagaattgaagcctctgctgctgtggttgaagtggatggttcttggagtttctccgaagctgctgggaattcctagtaggagctgctctatctaggtcttagtttcagaagtaggtcagttatttttttctcccagcacatcagcctacagctgcctccagagggtagtgtgctcttttatcttaccagtcttgcacgagttgcccttattagttgactctaaccctgagttgtagcaggaaggggtttgtaggaaatgtagttctggcttccctatgtcacacaggtgaatatagaaggtggtaatgatgcagaattgacaacagtctagcacaacaaccaggcaactggattttcaagttgggattttggaagaaatctgagctacagttagcataaaggtagcttttaaagtgagcttgcctaggaggtgagcataaataagagaaaggacagagtcttggggaactctagaattgacaagtttgcaagaagaggaagaacagctgtagagactggaaagaaaccacctgtgaggtaagaagaaaaccaggagaagatggtgtcctggaaagcaagagaagggaagcaggaataattacctgtcagttgcagctgacagaggaagtaatatctaagtattgaccattggatttagcagtattgaggtcattggtaatcttggatagagaagttctggtggagaggtgagataaagggaagataattagtgatagcaagtatattgtgtgtgtgcttgtttataggattatttgtataatagctgttttaaagtctttgtgagataattctgacctttgtgtcatctcagtattggcttgtcttgattttctttttctatgggaattgaggttttcctggttcctcctgtgcagagtaagtttggattgtatccccgactttttggatgttatgttaggaggagactctgggtcttgtttaaatatgctgatgtggtggtggtttgaattctattcctccctcatccacctgctactgtttacttttcagagtcctcaaatagcttctgcagttactctgttcaggctttctagttgctttcaagaggagtgacagggtgcaatgtgcttatttttccttatctaaacctgaagctgttcacttcgcaaactgcttctgttactcaggtaatggtcaccagtttcagctgggccatgatgctcaaatgattttgcgtccctgatcagttacctcttccagcccccataggagttgctgctcgaattatttcttgaatttggcttatagatagatcctttttttggtgtctgttcccatagtttcttttggtgtttttctcaggtagacaacatggcccttaccatatatcatgatagccattagttttctcaagtatgatagaagagttgtcttgtgttgaatgtattgactatgcctattgattagtttaagtagaataatgtctctttgacattttaagcctttcacacaatataattttgtggggatattttttacaatgcagaatagaacagcggtgaagagcacaagctgtagacagatttttgctttgcattcatatctgatccttgctccctgtatgatgttgaccaagctccttaaactctctaatctgttttttctcttctgtttagtagagattattgtgaattgtaactcttttgtaaatgtgatatatagttcttagtgcttggctagtcatataaataattaaaaacgattttttttttgggcaggatcaactcgatgttcataagtacagttcctaacagtgtagttatttctactgtgggaatttaagggctaatcttcatcattccctgatttatattgatctaaaaactggaaaacagtttatattcgtcatttgctatgcatacaaaatgggcaagttattactgttaatattggtttttaaaattcaataattttacagcctcttttagggtattggtttagtcagtagcttagtaccagttagatggcaaaccgtgtactaagcatcagtgcagagatagtgaatgagacacagtattcccacctttgagcagtgccagtctagtattagaatatttttggctaaaaaattattttgaagcataaagaagcttttgtttgctctggtgattttcataacatattcacattcttaatgtatttttggtttttcagaaagttacttctggcctgtgttctttcagaatataggttgcagcttgtgttaagtgcaggaactattgatagactgagtttagaagaagggaaaattggtataaagtggttgtgtattttgaacattggggagcttcatagatgagttaaattgttaggatatggattaagaaatgttgggttaggccaggcgcggtggctcacgtctgtaatcccagcactttgggaggccgaggcgggcagatcacgaggtcaggagttggagaccagcctggccaacatggtgaaaccctgtctctactaaaaatacaaaattagctgggcgtggtggcaggcctctgtaatcctagccactcgggaggctgaggcaggagaattgcttgaacctgggaggtggaggttgcagtgagccgagattgcaccgctgcactccagcctgcatgacagagagagactccgtctcaaaaaaaaaaaaaaaaagaaagaaagaaagaaagaaatactgggtttgagccttatttagcacttagcatcaaacagacattttcttttccaggggctcatcctacttgtttaattccagccagataacttataatttgtcaatatgtcatattgaacattactcagctgtggtaagaactttctgtcatgcttgctttggaaagcccagatcatgtttattgttttaacaatattacgtggttaatttgggaagcaagaatagcagcatgattttgagtgctgataaaccagtatttgaattcctggtctctcccttctttgctgtgtgaccctggaaaacttagtaacttctttaagtctgtttccttgtatgtaaagtggaaacaattatagtaaccagttagggctgtgaggagtaatgagctaatatagacactccacacacatgaagctgctattgttatgatcaggattgttatttggaggtagtgagaaaagaatgatagaaggctggccaagttggattgtgcattgaaatgagaacattgaaagcaaggtggtgaaaggaaatattctacgtgataatgaagcacagatttagtgtggtatggaaaattttagtttgtaggttaaaagggaaaagggttcagagcagcccaagcatctatttatacctatcttaaaatacactcattcatgcacaaagggtagggaatatccatcttaaaatatcttcagagttgagaatgtggagataaacatgtatatcattgtataataagccaactttaatttttctttatccatctggagaaaaagaatttaagacttttaattttataatttgagaaatagctactttatactctgagctagttcagatttttatacttatattttatcagtttcatagttacaaatagatttctgttcttagtaaagatggattaaatcatggaataagaagagttaggattcaacatgcattaaattgcctgttgctaaaacaggattcaacatgcattaagttgcctgttgctaaaacagtaagtgggcagtaagcctagtcttgatagaatggaggcttgtaacttgcttaaattctcctttaactacatagaataaaacataaagcaaaaagcggttatcagaatgtggctgaggtactcaatgccagtgtatccattcatttattcattaagtcattcatgcatcatataaatgtttatcgataatcatgcgctctagatgctgttttagataatggtgcatactgttgggtatacaatggtgaacaaaaagtagatgtggggagtaactgggatggtttgtcttcatatttaatgaagagaagaaagccagttccaagagtgtcagaataattcaacaagtgatgtttttaggtttacactcctaatagaaaggcaggaaaggcagagtgcatggaaagaagaaatgcttccaactgcaaccaactggagcttttctgacctttactttggttttaattaatagtgcttaagttgtttacctggtgtttaggtcctgaggctgcagagctgaaagaggttgtcactgtccctagaatctttctctttttgagatggagtcttgctctgtcacccaggctggagtgcagtggcgcgttcttggctcactgcaaccccttcctcctggattcgagtgattctcctgtctcagcctcccaagtagctgggattccaggtgtgtgccaccatgcctggctaatttttgtatttttagtagagacggggttttgccatgttggccaggctggtctcgaactcctgatctcaggtgatccacctgccctagcctcccaaagtgctggaattacaggcgtgagccaccacgcctggcctagaatattgttgtttacttggaggaggaagagactgacagaaaaggcaaaattttaatggcctctctagtaagcttcaccacaagattcctttggggtagggtcatgtctctggtaccgtgcatgtccaataccttgtgcagtgcatggcttgtgtctgtcactgaataacctatattgagtgaagaaatgctgtggagtgcaggagaggggcatctaacctggggtgagacagaacagcccctaccacatgtacatcaagttaagcaatgggaagaagatctaggtagaaggagcagcagatggcatagagatgtgagagaaagtacaagttgctctgtaaactgacaatagtttagttttgccagagtgtaggattcataagagacagtgctgagagactttagactagagagttagacttggcttgacaagtaagggtcataataaagagtttggattttgttttctttaaaagtaatagtgtttttttctaaacaatagaaatcaggtttcctaatgcccaggccgacactcttcatattacatgatgcatgcaatgtcaaaaaaggattattaggtcttagtttccatatccgttcatgatagcaggaccatcaaaattctgtaaagccattggtgaatgttctgtcttttggagagaaagaggatataggataaataccttttttcttgggagcaaagaatatgtagttgaaactcattaagggcaagcaaggtctgagtgtctttgaatttttgttcctggaatgatgccaggaatgtatagcagatctctgtacatgaataaatgaaaaaacctttctttgcatttgcatatactgttgctagcattatacttggttctgaaaagtaatagttaaatgagaaatggtctcagtggcacatgcctgtgatcctagcactttgggaggcggagagaggccaagacgggtggatctcttgagtccaggagtttgagaccagcctgggtaatatagtgagactcccctctctaccaaaaaaaaaaaaaaaaaaaaaaaaaaattacctggggctgggggtggtgcccacctgtggtcccaactacttgggagaccgatgtaggagaatcgcatgagcctgggaggttgagactgcagtgagcttgatcgcattgccacaatccagcctggatgacagagtgagaccctatctccagaaaaaaaaaaagaaattagctggcgcgtgatggtgtggctgagggaggctcaggtgggaggattgcttgagctcaggtgtctgagactacagtgagctaggctctcctcactgcactccagcctggaagatagagcaagaccctgtctcttaaaaaacaggcaaattattgattatagttcagtgggctaaatcctgtggtagaaacattcatgcatagggtggtgcatccacatcagtcttaggtgggaggagggtcatggaaggcagatttttggttgcacttgaactgaactttgaaggatgattaggagtaagctgggtgggggaagggaagaacctaccaggcagaaggactggcataagtaaaggcttgtttgtaagaagtagcatggcacattaagggaagttgaggttgttcagtatgaccctaccgtagaaaaggaatgagcaagtgatggaaaatgagataggaagctagtggtttggttctgttctttctctccttctccctcttaaccccctaacccccctcaagttctcctcttccctgttccccctggaatattctatttggaatgggatgatgagaaatattttgaggaggaagaggtaaaggcttagaaggtatgctttgatgccccagataaatgtcagcagaatagggaacacagttggaaaattgcttttcaaagcaaagaatttctaatatccctcaaagtaatgagagctgttgaagacttttgagcggttgacataatttgttttaggaaaggtcactcaggtaggtactggtgaagaagttgaattgaagggggcactgtaataaagaaagtagatcagttaggaggttttgttttgtttttgtttttgcaacactgtaacttgaattaaatggatggccatagaattggagagcagggatcttaggggtgagagataagtgaggtgaaagagttagattgggcaactggtcatggttaagggcaggatttttggggtcagacacctgaatttgattcttagcttggctttttattattatgtgactttggaaaattagataaccttctaaatctgaacttccggaaatgtgtaacaggaataattccttgagaggttattttgaggactgagtactcctaagactcttagcacagagtatagctcgtggaaagaattagttaagaggagatgctattataagctgttcattgttatagggtatatatttataggaggaagaacatatataggctgtattagagggagaggcaaggccttaaggttcgtgcgtgttggtatcagtggtctgttacagggctgaggaaactatagcacgtgggccaaatctgcttttgtaaatatgtatttattgggatgcattcaaattgtttatatattgtctatggctgcttttgcactgcaaagggaatgtacttaacacaaagaatagggtccccaggagagcacttaaagggcaagcagaggaagcctaggtaggttgggttggggggggggacctacaagggccaggaagtttgtaggattgccatgagtgaggagtgtcactaatgctgggaaaggagggtggacattctgtggtttttttttttgagggagtctcgctctgtcacccaggctggggtgcagtggcgtgatctcagctcactgcaagctccgcctccccgattcacgccattctctgcctcagcctcccgagtagctgggattagccaccacgcccggctaattttttgtatttttagtaggtttcactgtgttagccaggatggtctcgatctcctcacctcatgatctacacgcctcggcctcccacagtgctgggattacaggtgtgatgactgtagagtatgctcgagctgtgtgtcctatacaggaggcccctcaggcccctcacagagtatgtgtgtttgtagtaggcatagtatactgatagagcttttggcattgctggatgcttgtacacagttttctttagctctttactatgggactgctgtcttcattgccacacaaaacagcaagaatttgttgaaatgagtaaaaataaccacataatttttttccctccctccctcccttcctccctcccttcctccctcccttcttcccttcctcccttcctttcttccttcctttttttttttttttaaattttgagacagagtcttgctctgttgcccaggcagtggtgtgatctcagctcactacaacctccacctcccggattcaagcgattcccctgtctcagcctcctgagtagctcctggctaatttttgtattttttttagtagagacggggttttgccatgttggccaggctggtcttgaactcctggcctcatgtgatccacctgtctctgcctgggattacaggcatgagccaccacaccaggcccagatatttttgagtttaaagatactaactcaataaattgcaaaagaggaggcagttttcctaaaacaccaccactccagttgggttgtatggttgaagggataaacctctaaatgaaatctttaaaagaattaaacctataaaagaaacctttgctttcttttatctaaaatttccttaccaggcttaaatcattgccttttaaaaaatgtgtactataagtactttttgttaggtgagctctctagtattaacttggtgagactgatttgtagtaccaaatctttttttttttttcttttttctttttgagatggagtctcgctgtgtcgctcaggctggagaccagtggcgcgaccttggctcactgcaacctccacctcccaggttcacgccattctcctgcctcagcctcccaagtagctgggactacaggtgcccgccaccacgcccggctaatttttttgtatttttagtagagacagggtttcactgtgttagccaggacggtctcgatctcctgaccttgtgatccactctccttggcctccaaaagtgctgggattacaggtgtgagccaccacgctcggcctgtagtaccaaatcttaaaggaaactttgcatttggaatttgaagtttatctggagatttggtatggttgctgagttatttttaggattagatacatttcttggaaatagcaaatgtaataacaaattgtgtggctatatagttggctgtttgataccatccataagcttagcaaagtgtggtgtagttatttgcctgtcttcgagggaaataaatgtaaaaggcatgtataacttgctcacagtgcccaaacttgctctagtgatagaactaggactggaattcaggtttcttgaatttgatttcagatgtcttttctatatatctgctgcttttctgactttaaagtacatttccaaggaaaagtgctctttatctataaagtacttttttatttttgagacagagtttcgctcttgttgcctaggctggattgcagtggtgtgatcttggctcactgcaacctccgcctcccaggttcaagtgattctcctgcctcagcctcccgagtggctgggattacaggcatgcgccaccacgcctggctaattttgtgtttttagtagtgacagagttttaccatgttggtcgggttggtcttaactcctgacctcaggtgatctgcccgccttggcctccgaaagtgctgggattacaagagtgagccaccgcgcccagcctatatgatacgttaaatacaagatttgtgaagtgttgattctgtatgtggcaatgaacaattttggtagttcacctgataagtcattcagtatgagatcatgctttctttacagcctggtgtaaaaccattgatggattcatcctagtttatcttgccttgattacttattctttttttaagggttaaaatgggccagccgcggtggctcatacctgtaatcccaacactgggaggccgaggtgggcgtatcatttgaggtcaggaatttgagaccagcctggccaacatggtgaaaccccgtctctactaaaaatacaaaaattagctggatgtggtggtgcatgcctgtaatcatgtagcgcatgccagctacttgggaggctgagcaggagaattgcttgaacctgggaggtggaggttgcagtgagccgagatcgtgccattgcgctccagcctgggtgacagagtgagactccgtctcaaaaaaaaaaaaaaaaaaaaaaaaaaaaagtttaaaattgcatttacaatgtgtttttttccttctaatacaatatatgttcattgtagaacatttaaaaaaatactgtatacaaaaaataattgctggtgaattgtatctctcagggataaccacaggtaggttttttttgttgttgttggatttttttttttttctttttgagacagagtctcactgtttgcccagtgtggagtgcagtggtgtgaccaggctcattgcagccttgacctcacaggctcaagcagatcctcccacctcagcctttcaagtagcgaggaccaaaggcatgtgccaccatgcccagctaatttattttttgttggaaaaggagggtggtggggggcaggcaagggggagtctctctgtgttgcccaggctggtcttgaactcctgggctcaggctgtcctccaaccttggcctcccaaagtgctagaattacaggcatgagctgctatacgtgggccacaggtaagattgtaaaagatccatttaggccttctttatcccttggtgatactcatatatctttttgaaaatcaaaaacgtagatataagtatatagattatatataaaagtccaccatttctgaggggaacggatcactcttacactacttttttttttttttttttttgagacagagtcttgctgtgtcgcccaggctggagtgcagtgtcgtgatctccgctcactgcaagctccgcctcctgggttcacgccattctcttacctcagcctcccaagtggctgggactacaggcacccgccaccatgcgtggctaatttttttttttttttgtatttttagtagagacggggtttcactgtgttagccaggatggtctcaatctcctgacctcatgatccgccctccttggcctcccaaagtgctgggattacaggcgtgagccactgcgcccggcctacttttgtttaaaaaatatatgtgtgtgtaaccacattcaggtaaaaaattattgccagccttttactcccttttccatcatcttgacttctgtgacagtcatttccattaaaaaaaaaattttactccctattatgtgtctttaaacattaggattagcttttgtatagttttaaactttataggaatagaattatactgtatatattcttttgtgacaattgatctgtgacaaattgacattgtagagcaacggggaagagacactttttcaataaatggtgctgggtcatttgagtatccatatagggaaaaataataatttgcttcacacaataaaaaataatttcaagtggatttatagatatgaaaagattaaataaaactggtataacggtgtttaatagaaatatattgtgagccacatgtgattttaaatttttctagaagctaaatttaggaaaaacagataaattaatattttgtatttaacccagtaatgctcaaatacattttaatgtgcaagtaatttaaacattattagtatattttattttggggggcaaggatactatagttttagcaattcagtgtgtattttacacttacgtctcagtgtggcctagttacatttcaagtgctccttagcacgtgactagtgggtactgtgttggagagcatagttttggaggattatgatggataacatcttattatctctggacacaaaaagcaaccataaaagaaaaatcgatgagttatgctacattaaagttaggacatcatattcctcaaaagacattattaggcttggcatggtggcttctgtaatcccagcactttgggaggccacagcaggaggattgcttgagtctaggagttcaagaccagcctgggtaacatagtgggaccctgtctctacaaaaaattaaaaaaaagaaattagctgggtatggtggcacagacctgttagtcccagctactcaggaggctgagacaggaggattgcttgagcccagtaggttggtgctgcagtgaggcatgatcacaccactgtactctggcctgggtgacagagtgagacactatctcaaaaacaaaaaattagtaggagagtgaaaggcaaattacagagtgggagaagatattggtaaatcatagttctaacagtttgcataaaaaatatgtaacatgtcaagaaaaaggtagttaactcattagcaggatggacaagagactttgctatttcatgagagataaatgaaataaaatctatcactgtggatttgtctttttctttttgtaattctgtttttgatttttatatatgagttgcttaacgacaggaaatgcattaggtgatttcattgtacaaatgtcatagagtgtactcagcaaatttagatggtagcctactgcatgcctgggctatatagtatagcctattgctcctagactgcaaaattgtacagcatgttactgtacagaatattgtaggcagttgtaacacagtggtaagtgtgtgtgtatctaaacatagaaaaggtacaataagaatatgatataaaagattaaaaaatatacctgtatagggcacttacatgcatgaatggaatggagcttgcaggactgaacgctgctctgggtgagtcagtgagtgtgtggtgagtgaatgtgaaggcctaaattatcactgtacgctactgtagattttataaatactgtacacttaggctgtacactaagtttataaaaaatatttttcttcagtaataaccgtagcttactataactttataaacttttaaatgtttttaaacttatgactattttgtaataacacttagcttacaacagaggcacattgtacagcagtacaatgtgagccccttcccgggctcaagtgatcctcccacctcagcttcccaagtagctgagactacatgcgtgtgccaccatgcccagctaattttttctgtagagatagggtttcaccatgttgcccaggctggtctcaaacttctagactcaagcaatccatctgcctcggcctcccaaagtgccaagatgatagaagcgaggcactgcacctagccaatattttctttatatccatattctatgagcttttctgtatttttttaaaattttaatttatcatttcatttgtttgtttgtttgtttttgtgatggagttttgctcttgttgcccaggctggagtgcaatggcatcatctcggctcactgcaacctctgcctcctgggttcaagtgattctcctgcctcagcctctcaagtagctgggactacaggcatgtgtcaccatgcccggctaattttatatttttagtagagacagggtttctccatgttggtcaggctggccttgaacttctgacctcaggtgatccacccacagcctcccaaagtgctgggattacaggtgtgagccacggtgcccagcctaatttaaggtttttaaacttttttgttaaaatgaagacacaaatacacacattagggtagacccacacaaggtcaggatcatcaatatcaatatcttccacctttgtatcttgtcccactggaaagtctttaggggcaataacacacatggagctgttatcgcctaggttaacagtgccttctggaatacctcccaaaggacctgcctgagctgttttacagttgtcctttttaaataagtagaaggcgtgtactctacaatgataattaaaagtgcacaataaataagccagtaacataattgtttatcaagtgttaggtactgtacataatcgtatgtgctagacttttatacgactggcagcacagtaggtctgttttccccagcttcactaaaacgcgtgagtaatgtattatttcccccaagtggcttttttattccttccccgcttccccaccctcccgtgttgttctctgtcttttgtgttacagaattttctcacatgtctggtattaatttccttgtggtgaataaaaaattctttggaagctttagcaagtgggttcagccttttgactctgacttttgcatcaggatattctggatggcccatttgttgggaaatccccagcattggtatctttagatctttcttcttagacgtatcaggttcctgcagggtaaagacctgactatctgaagtttgagaggaaagtgcatagggcgtagtggaggagctgaaatgtgtgttcagtgactagatcgacctctgttttgtacagttgggcagggtgacttctgtctaaggatgctctccttttccagagagcccccagtcttctgtcatggttggggagtcccacgaaggcatggtgttgaggctttagctgcatcgtagatagtcttcacctaacctccatcatcctttatgcctccaccttctttaccccttgttctgtctgcatttagtgctgccagttctgaaccttcttccgacatggctgtggaaatggaattggttcttagtgtttttggctgctggcttggtctggctgcattgggcctgctgagtcatttgctatgcttccgatcttttatcgttcatttcccccaagtttttctgttttcctgtttgttcggtttctatcttcagtgttagaggcttttcttatagcttcaaaaattcagttactttttctttcatttctccctgtcctgtgggtttggtttttaaatttatctttttaatatgtctgtattagtttgttctcacactgctaataaagacatacttgggactgggtaatttataaaggaaagaggttcaattgacttcacagtcccacatggctggggagaccttacaatcatggcagaaagcgaaggggaagcaagacatatcttacacacggcagcaggcaagagagagtgtgtgcaggggaactcccctatataaaaccctcagatcttgtgagacttatttgctatcatgagaagaacacgggaaagacctgcccccatgattcagttacctcccagcaggtccctcccacaacacatgggaattatgggagctacaattcaagatttgagtggggacacagccaaaccatatctgtgtcttttgtataattttagtggaagtgaaatagatgtgtatattctgtttgccatcttcctctgaatttgttagctaactttgtgtcagattaattatgcctgttgatgttttaatggttcttagttatttcatgtatatttccttcaactaaaatacgggtttgaagacaggccttttccaaatttgttattcttcattcaaggtccagtacagtaagtatggtaagcagtgaagaagctaactgtaaggtggacagtacaataaagccttgaaaaaaactagtgaaataatggtggttatatatatatatagtctttcaggttctctctgactgcaatggaaagaggaaagagaaattagaagtatttttttaaattgtcatttgatttcttcagagttattgtgggcttctgaactgtgagtataattctcttgctatacttgtgtcttgagatttttggttttgttttttctttcacctgtcttagtgtctctttgatgtacaatagaaataaacaaaaggtagttgattttgcagagtgggtgagggaagaaatataaattgtttagtgcctattatgtgtagatactttatatatttttttctgagacaggtagtataataatggttaataacgtgcttagaatactgtctggtacattataaacactctgagttacaattactaattgaatcctcacaataactttataagcaaggtttactgttcttccctatttcacatttgcataaaccaaaatacagagaggttaaaggatactaagttacggccggacacagtggctcatgcttgtaatcccagcactttgggaggccgagacaggaggattgcttgagttcaggagtttgagaccaagtggctgggtgcggtggctcatgcctgtaatcacagcactttgtggggttgaggcaggcagatcacttgaggtcaggagttcgagaccagcctggccaacatggcaaaaccccatctctgctaaacagacaaaaattagccagacgtgatgttgcatccagctgttgtaatcccagctactcgggaggctgaggcaggagaattccttgaacctccacaggaggaggtggaggttacagtgagccgagatcgtgccactgcactccagcctgggtgacagagcaagaccctgtttcaaaaaaaaaaaaaaattcagaccagcctgggtaacaacaagaccttgtctctgaaaataaaacaaaaaacaaaaattgtcaggtgtggtaatgcatgcctggatcacgggaatttgaggctgcagtgagccaggatcgttccactgtactccagcctgagtgacagagcaagagtccatctcaaaaaaaagattactaaattagtagatggcaaagctgggattcagattcattctggcttcacagtgttgtgctcttgactggtagagcagctccctccccccagtctgtggttttgctttttgtaggttcagttacccaatgttagctgcagtccagaaatactaaatagaagattccagaagtaaacaatttataagttttaaattgtgcggcattctgagtagcctgatgaaatctcatgcaccctgatctgtcccgccctatcccacctgggatgtgaattgtccctttgtccagcatatccaccacactgtgtatgctgcccgcctgttagtcacttagtagccatctgagttaggtcagctgtcaaggaatgacagtgcttgtgttcaagtaacccttagtttatttcatcatggcccccaaacggaggggtagtagtgatgctggcatattgttataattgttctattttattatgttattcttgttaatgtcttacagtccctaatttataaattaaaccttattgtaggtatgtatgtataggaaaaacatagtatatatagcgccaagtactgtccctagtttcaggcatctactgggggggactaggagcatatcccctgcagataagtgggaatagctgtatcttattctcatgggttctagattcagatattggtttagctaggtattatatttcctaactccttaattttaatcaaattatttaacctattgaaagtcaattttttttaatctgacaaaggggattattatagaatctcccttatggggttattgcgaagatgctgtgagatatgcgtaaggtgttcactcaaaattgttagcaatgattatttggtgccatttttctcattttaattagcagaaaacggagccctagagagattatattacttgtaatttgtcagtttgtaacttgtagatcttggtgcatgtttcacagtttagaaatcgtacaattgagggtaatcctactttgtcttgtttccaaagattgctctttcttctaagtctggtggtaaatggaggacagataggttcatagagtatttataaatctcttttgtgggcattttgtttatgttgttacagtacatatctcataaacttggacttcatggagtcagaattcatgataatttatagctgtattgaatttgactttcgcaagtgtttttggagtatgggcctaggattattttttaatttccacatgagtgtcagttcacatctttctttgttctcttttctcccccaaatctatttctaggtgttagtgaagggaaattatgtcatacagtttccatttctttgcaaggcctagaagtctgggtcctgtgtccccctgtccttcataggctaagggagaggagcctattctgtcccttgtgctgtgccagatgtgattgttacagtgtgagaaggtcacagcccctctatttgtgttcccctatttccttcccccgtccatattgtacctttcttcctataacagtgcattctgtttatttgggtgtgagtctgtgtgtgagggcagttttgttatttcatctctgcttaacccgcagttaacttgcactaaatgctgaattaggactgtttaacgcctgtcacaaaataagttctcttttcttagtagatctgagcaaaagaaagaataccaactgtaacttttcagcaacattagctgtaaaaatatttcctcttggtatagcacaagacagttccatagcagaaatacaaaacttacattcttagtgtaatgtgctgggaaacgaaagtctaaagagaggtgagatgacaaaccagctatttgtgacccaagagccatctcattggctcattggaacttaaaaaaaaaaatttttttttttttaatttttctttgcagatagagtcttgctccatcacccaggctggagtgcagtggtatgatcatagctcactgtagcttctgaactcctgggctcaaatgatgcgcccatttcagtctcccaagtagctggaactataggcacatgctaccatgcgtggctaattaaaaaaatttttttgtagagatgaatcttcctttgtttcccaagctggtctcaaactcctggcttcaaatgattctcccacctcagccttccagaatgctgggattataggcataagccactgctcctggcctcattggaactttttagctataggacaaaatctacccatcttggtttgtccttttaaaatcatttgaaaatatataaacccaggaaaataacctcataaccagtgttcctgtaattcccccccaccgcaaattctggacagatggtcagtccatatgtgtaagtctggcttccaatccattgaatttcatgatgtaatgctgagatataggtcccttatttcacagagttccccttcgtaagtccgttgggccatttgagctcctgcagtatggatctggttgcgaagcagctagctttggcggagttggttcttggtccttgccttgtttttaagtgacacattggaagacagaaatttgggaaggaagtattttagaaccagaactctaggcaagcaaaggaaagtttgggaggaattgagttgctgggatatatatggagataattttcagggttaatgtggcatgggaaggtgatggacagaaaggaaggcctccctgagacccttctgcaaaatctcgtatttgtgaatacaagcatcttttatagcatatgggcagatgagcacagctgagatagattggactctgaggttctgggagtgttgacttaaaaaaatatatatattatttatattattaggtacctcctaatatgtagtgatccctccatatctgtgggggattggttccaggattcccccaagataccaaaatctatggagcctgtctcttatataaaatagtgcaatatttgcatataacctatgtatgtcctctcatatacagttaacccctgaacagtgcgggggtgaggggtgcccatcccctttgcagttgaaaatttgtgtataacttttgactccccaaaacctaactactaatagtgtcacaggatctttgggatgccgcttcaccagccagaaatcacggtggctggtggcaccttctgcctgagtattgcccatgcccactgggcttgttcgcctactcggcttggcatgctgtgcttggctcacactacaagcctggatcccacacctgccaagggcgagccaggcgcagagctgtgaggggtgtgtgggtgtgtgagcatgtggtccagccaccttgcacagccagctgctgtagcggggtgggcagctccaggcactggcacaggtgccagttctgtgcaaggctgcagctggaccagatgtactgcatgcagcctctgctgtggaaacccgcatctggatgaggggaacgaggtggcgcccagaagagtggagatgccaggaactgcaaagccccaaagagggtgtcatagccctggctcggggattctcctctgctcgttgctcacaacatggcaagcaggaggccgtgttttagtcctgtttgtgttatagctctttcagtccctgcatttggcaggtctcgagttcttatccagtgtccaggaagaatgaggtacatggacaactggaggatgagcaaggtggagaggggcttcattgagcagcagaacagctctcaggagacccaaagtgggtagctcctttccacaggcaggttgtcctggtgagttgaagagacccaaagtgggtagctccttcctgcagctggtagtgctaacatctctctgagtctggggtttttatgggctcagaagggaggaagtgcgtactgattgggccatgggcaggcccggaaaaagcaccataagttctcactccaggctgtagactccacccgtaactggtggcctggctcccgggcttcaaggctgtccctggcttgaaggtggaatttcatgggggacctgcccctttctatccaggagcctttctgccttctcccaccatcaacaagccatccatggcacctaggctgttcatgacgaggtgtgcctgcaggcccacactgagccaccctcagctcccccttggcctccctcccgtgcttgtcagtgcccaaagtctggagtgggccagggcggcagggggctggtgtgtcagcgctgcctcgagcatgtgcatactcggccaggttgtgacagactcaggctcagccacaactttgctctgccctggagtgggctggggagaggccaggagcctgtgagggcgggggggcttcccggacccctaagaacgcagggatgcccagctccggagccgaggctaggaggctgcagctgtacctgggaatgtggggctcctgccccgccaactcagtagggggttgggatttccacctgttcccacctcctgccagccccactgcagcctgtgtcttggcagcagcccctccagactggcttccactgctatcagtactgtagactggaagccttattgagaatataaacagttgattaacacgttttgtatatgtattatatactgtatttttacaacagagtaaactagagaaaaaatattaagaagatcataagaaatattaagaaatatagaaatattaagaaatattaagaaaatatacttattaaatggaagtggatcttcataaacatcttcattctcattgtcttcatgttgagtaggctgaggaggaggaggaggaagaagaggggttggtcttgctgtctcgggtggcaaaagtggaaggggaggcaggagaggcaggcacactcagtgtaactattattgaaaaaaaatccccctatacgtggacctgtaccattcaaatccatgttgttcaagggtcaactgtactttaaatcatctctagattgcttatattgccgaatacaatgtaaatcctttgcaaatagttgttatactgtattatttgggggataatgacaagaaaagcatcagtacatgcttggtatagatgcagtcattcatttttttcctcaaatattttagatccatggttggttgaatctggatgtggaacccgctgacgtggatggctgactgtattgtatgttaaactttatcatttgtgacttctctgttttaaatgacctgttgattttctgatttgggatataaaggtttagcttatttatgttattccccatatctcttcctgcattacttattgttaaatagttgatatgtgtatttttcttttagaagtcttctgttgtaattttaccaatatctttcctttgcttgggttattgattcatgtcaatatcttgattccttttaagataaagatagtattgccctaaatattgacccttccccccagttccagcatgtctccctgttctgcctcatattttgtttttgttatttcttttatgttgggatttttacatttgtattttatctgcaactacaagtgttctggggactgctcatgggttgaactctaaaactagtttattatttttaattttaagttttcttgagctttcccagcttagctttctttcaaggccagtttttctctttgttttctccggtatttgtttctttttcatgaaggtggtattccctgtatgtctgatgatcctttattgtctgtaagtgtatagggaagcaggactagctacttttcggagttagatttagcccctggtaggaattcagaactgaagtactttgcttcagcatgcttttagtctgtgggcccctaaataacaaaataaaggagagttttactgtaaggttgttaacacctataccagaaacctttgctttattttctagagaaatagccccttgggatttttaaaaaattattattattattattttttgtccgagggtaaatgctgagttagcctgggcacaactagtcagttaaaccctgttttcacccctggctattaacatcagccctccccaatacctcatggccaggcccaaagcctcatcaagattcacttgagttttgtctctgttttacacatcactgtgcgtgtagctcctctttaatagctagatatttgttgaattctcatcttttggtggctcttcccttcctcttatttacctttaaaaaaaaaaacttgcatacttcagtttcattgaagtcttcacaggaataaaactcattactctaccaccttgaagttgaaaccactgaggattttaggaggtggggtggcatgttgatctgtagggtgaggattttaagtggtggagtgatatgttggtttgctgtgtggctagttttagagttagatgagctcgagttcagactttggtgctgccacttttagctgtggaactttggtcaaaacattttatttttcttatcctcagtttcctcatttattgaacaaatatttattgagacattgtttgtagcatgatgatgtggggatagttgaggtagttcttttataatgccttctgtatttctctaaagtaggatttgaagtcatctcctaagaaggagtggaaaaagcaatgctggggttggagatttgatgatagtggaggaggtttgaaatagggatagtgaggacagagccaagcaggggtggagaaggcttgcctaggagtgttgtggttcaactgagattggtgacagttaaattagaatgtacgaatttttttagttaatgatgttttgtctggtgctggctctcagcagtccaggtgtagtctggtataagttgtcctaatatttgtattgaatcatgaaatggacttttttccaggcttgtttattggaaggacagtgggagttagtaatattggtcaaagattggtttgaactatgactttacaattcaggaaatgtttgttgaacttttactaagtgcttggcatggttctaattgctttagatagatgtatcagtagaccaaacagagtctgtatagtgtagggaagcagataataaaaaaataataagcaaatgagtacattatgtaatgtactggaaggtgggacgtgggatgagaaaaaagtaatgccatagtatgagtgaatttgaggtctaaatagggtagtcataataagcctcactgcaaaagtgagatttgagctaaatacaaaggagatgggtgtattcatgcgggaaaccacaggctcctgtccggtcttccatctgcttcccagaagcaacggaaataatctgttttaggtgttgattttagcttttacattcttgtttcctaatagtatttgtttactagtcattgctccatcaattttagaaaaagttatatactgaactcctatcatggtaggtagggattttctctctcttacgtggtctttcctctcccccatcttcctcgtgtagttctagaacagtttttgtttagatccgtattttcgtttttaattattttgacttttaaacataactcagtattgagccaattgaagtagtatggttgcatttcttgttcagctttgtttttcttgttttcttggactgaaaattgcagttgtccctcttgtttgcttaatattcttaggtctggctaaggtttcctactctgacagctctgtaagtagggcctctcaattagtttccatgcagtcaagtgtattcattttgtcttcaccccctagacacacccctcctggagctttccttctccttttccctgcttcagtctagagaggttgctctctagacctgctgtaaatggtaccagggtggagaaacctgtggtaccagcaaaaataaggcgagaacaggtaagacaggtgagtagaaaatactgattgaaaaaactgatgggaaggacagaggaggaatggagatgatgtcttcttggggaattgtgttaaggagaaactagagttgaggaagagcattctaggtagtgaaaatggtgccagaaaaagcatggagatggaagtgatcttttattttttggtgacttgaaaagcctgtgttgtgttaccttcttagattatatgtatattaacttattgactttgccctgaagagcttttaaaaaagtttaaatgggaattgtgacaatcaggccctgaggagctttaaaaaagtttaaatgggaattgtgacaatcagaatgttaaacattgatatattttttgttttgtttttttttgagaaataaaggtctcattttgtcacccaggctgtagtacagtgagtggcatgttcatagcttactgtaaccttaaactcctgggttcaaatgatcctcctgcctcaacctcccaagtagctgagaccacaggtgcacaccactgtgcctggctaatttttaaaattttttgtggaggaaggctctcactatgctgcccaggctaatctcaaactcctgggctcaagtgatcctcctgccttggcatcccagagtgctgggattacaggcatgagccatagtgtccagccttgatggtaaattattaatgtcctaaaacctgaacataggatatatcaggaacacttgaattcaagtgataaccttaaactgttgattttatatattgatttacggaaaaatctttacgcattggttacaaaaacttaataatcttggcatctaactatccaagccaattcatcagtgcaggaatgagtgctgtagtaccacttcagttttcaggcaagaacaagatgaacgacaacaggaaatttaagaagctgctccgtgtttggccaaattggagagagggcaagcagggaagttggaaaaatgtcattgaggcatgtaagcacaactttcgtctatatggcgtagctatatagagaaaattaagccaacaataatgagatactgaaaaaccaagagatgagtacctttctaaaagaagcattgctcagtttgaaatgctgaagcaaaatgctaagaaataaggttcacaagtggtcttcatgattgcaaactctagagtactttttgtgtaaatgcatgggacttctcatggatggtcaggccgttatgttcagtgggtgcgctgtacacaaatattacttgccggctgaagctttgactttttactcagttttgtgaagagcacatccttctggtctttatttgcactgtgattcaggagtcgcggctgaaggaaatagtcataaatcgtaatcgctgtcatgtgtcagtcattgtgttaattcaaatcttaattctttacagcagctcagtaaggttttgattactattctcattttacagatgagaaactgggcttagagaagttaagaagacagtccaagattcctcgtggcagtatcaagttctccatttccttacagtaaagcttaggccttaaggttaaccacagtgcacaattgggagtcatacatttaacagagagaagaatagtgccacctactgaattgccagtgaccctttcccctctagtattgtacttccttttaaaatgtatcagtcgtgttaaaatgcagtatttctgcaaagccttgcaaatttcttaatcatctgtgttgctggcttatactgagggaagagtgtagtttcataaaatactcgtcaaaacagggaaaattttgatttcctgattctgaaagtgggcaggcaactttgcataggatcttaccttcagagaaaggaagagacggggatgagtgttttttctttcaatccgtctttgcatatcatagtgttgtgagttggggtggcaagtaggcagtttagatttttacccagtactcatgaattccaaatggtttaacaaaatatacaaacacttcagcattttttctttgataaactgtctgattaaaaaagataggtgtctcaataaaaatttcaatgaaaaagtggccaaaagatttggacagacatttcatccatttcatatgaatgagagtaagcacacaaaaagatgttccacattagtagtcgttaggaaatgtaaattacaaccacacgagatatcattgcaaccctattagaatggctgatgttaaaaaccaaaaagaaggtgacagtgccacatgacaagaatgtgagacagttagtactctcctgctttgctggtggaagtgcaaaatgttatgattgctaaagaaatcagtttggcactttcttatgaagttgaacatagacttgtcacccaacccagcagtcctacttctaaatatttactcaagagaaatgaaaacattttcttacaatgacctctatgtgaacatttatagcagctttattcgtaatcactggagacagctcaaatatccatcagttggtaaatggataaacagattttggtacacctatacaatggaatcctatacagcaataaaaaggaactaactgctgacgcacctaacaaaatgggcagatcttcaaagcagtctactaagtgaaaacactaaactccatataactgtgatttcatttatataacattttggtaagtcaaatctgtaagaacagaaataaaatcagtggttgcctggggcggaagagagaattgagtataaaagagcatgggggcacttcttggggtgatggaaatagtctgtgtcttcagcgtggtggtggttacacagacccacttgtattaggctgttcttgcgttggtataaagaaatacccaagactgggtaatttgtaaagaaaagaggtttaatcggctcactgttctgcgggctgtacaggaaacatggcaccggcttccagggaggcgtcggagagcttttactcatgatggaaggtgaagtgggagcagatgcgtcacatggcaagagagaacaagagagagagtgggaggtgccatacacttttaaacaaccagatctcacatgaactcgcttgtcaccaagggaatggcactaagccattcatgaggaatacgcccccgtgatccaaacacctcctaccaggctgcacttccaacactggggactacatttcaacatgagatttggctgggaaacagatccagtccttatcaccatccacctgatgtttttattgtgcacgttatgcctcaagaaataaaactttaaagagaagaaaaagtgacttatatgcaaacagatattatccatatactcttgcacacatatatgcgcgcacacacacacacacacacgcacgcactcattagagctcaaattttctttccagctggatcaacatttatttgtctggattaggtaccaccaaagttgaagtgaagtagatttcagtgtagacactgcttttgaaaacagtcttgaagtccttgattcatttatgtaatctgatttatttgtggcctaaaggctttatatttgtctttgtataatgagattgtatattataaaggtcatataattagcagaaataaaagatgtttaaaagttattttagtatttgttgctcaagttcttgtagctctggagaaaaatagttttatcagcgttataaataaaaatgctatttcttatattgatgaaactatgcagtcttcagctccatcttttagttaatagttaatgagctataatggtagggtacatttatgttttaaactgctagaattaagaatgtacatagtaagtctaggtgcagaggttcatgcctgtaatcccaaccctttgggaggctgaggtgggaggatcgcttgagcccaggagtttgaacaacatggcaacacctcatctctacaaaaaattttaaaattagccaggtgtggtggcacatgcctgtggtcccagctactcgggaggctgaggcgggagaattgcttgaacctgggggtggtcaagctgcagtgagctatgttcaccccactgcactgcagcctggacgacagagcaagtccctctctcaataaaacaaacaaacaaacaaacaaacaaaaagttagctgggcgtggtggtgcgtgcctgtagtcccaggtacttgggagactgaggtgggaggatcgcctgagcctgaggggtcgaggctgcattgagctgagatcatgccactgcatcccagcgtaggtgacaaaagtgagaccctgtctccaaaaaaaaaatagagttgctcattactactttgtggtacttgttgatgtcctgtggagcagccatttagcattttttttcccaataaactcttggttaaaaagccacaacagtgagtaggagtggaatcaaagtagaaagttgtatgttctaattttcgtttaaaaatcagtttattttaaatgatgagctcatcattttacgatcttcaggatatactataatgtgtggcactaatagaatcagtgatagaataaggtgcattacagtagggcttcctaagttgctttttgtttatttaatgcatatgctcttctgtgtcttgagacactgtctccagcagatgagacctgtttattacagcctctgcagagaactatttgtgtgttgatcacacagtaaatatctaatggtagcctctttgacatttggtgtttgggaacaggagggagattgctgattgttctgctttttatattttattgtctcactccatccctgtatttttctctgggaatgtcttcattaacttaaccctggttttgaaggcttaaaagtgtgctggtacgctttttagaattggtgacagttccggttggtgtagcccaggtggcagtcattcatggttcacttgtcattgcatgaacttgggatagctgttcatattgtgttcatttcagttgaatttatgtgtgtgattgttgtattacacatgttgaatttatttttttttaattaaaaaaattttttttgagatggagtttcgctcttgtcacccaggctggaatgcaatggtgtggtctcagctcactgcaaccactgcctcctgggttcaagcaattctcctgcctcagcctcccaagtagcgcaggtactcaccaccatgcccggctaatttttgtatttttagtagagacagggttttaccatgttgtccaggctggtcttgaactcctgatctcaggtgatctgcctgcctcagcctcccaaagtgctgggattacaggcgtgagccactgtgcccggccatgttcatattaaaaaaacaattttattttaagcctacagcacccagtattttcaggcagcctcccaatcccaatactactaaccaggccccacgctgcttagcttttgagattggatggcatggctgtagaccatggtcatattttggcaagtgatgtcccttatagcagttcttacccttgatacaggatcctgtctggaatcacttgtaatatatagtcatgactctttagtcttttttttttgagacagagtctcgctttgtcacccagactggagtgcagtggcactatctcatctcactgcaagctccgtttcccgggttcaggcctgcctgagtctctcaagtggcgccatccacacctggccaatttttttgtttcactattttggccaggctggtctcgaactcctggcttcaggtgatccacccgcctcggcctcccaaatgcaaagtagtgtttctttcctgatgtacaggatgttgtgtttttcatcatgaacataactgttaatcccaagttcttcaagcaaaagtctgtatttattacttgcccatcctatcagggatatgttaggatatgtcaatacgaacagtaagtgtagctggagctagtgatgagtgaatgtgaatcaagaaaagtaaatggatttattctttcattcgacacagttgagtgccttccgtgggccaggccccgtgctctactctgttcttctgttcatttttccccactcatctttcagatgattccttggtgatttggagttgtttttggcacttcgcctagattttgatgtaaattttagtaactcagtctctcccttttaaaaggtatctttctttcttaatttgtgacatcgagattatcactaataaatagttaatgccagagcaggacaaatatcaaaataatttttcattgtataagccttttgcgaaatgatttaccataaagtgaataaatgtgtacatactacctagtttttatctcctagtgacaacagctttgaaataaaaaaaatcctggtagaataatggtgtttgggtatatgtatgacataggtgacctagaatgagggactagatgtgacttctaggccacatggccagaatggtatgtaatatttgactgtggaagatttgtgcaaccccaaatgataattttattctgggcctgtagggttgatgaaggctacctgttggatttgtgtggaaactggatcctaaatctatcatcttttgatggactaggggcagatgagacttgatcattgttagagctgaacttgcagtatatagagctgaacttgtatagtacacatatcaatagcagtgatagatgtgggaaaactttgatcacttatgtatgcttgtcattaatttttttgcaatttcttgaatgaaaaattttgaactagtaaacatttaaaaataaaatgtatagttttttcgaatctggctttaaatgtttagaataagtctctggatttaaaggttaggatatacttttattcattagatgataaagtttattgtgtatgcatctggaagattgttcagactgttgaagaagatgtatcctttgtttgcccccagccctttccttttcttccccaaccctacttttattcacgtaagaagatggaagaggggaggaaagcagggtgtgactttttatgcaaaaatattcttttttcaaaaaaaaaaatactgagaatggggtcttactgtattgcccagtctggatttgaactcttgggctcaagcgatcctcctgccttagcctcctgagtagttgacattacaggcatgcaccaccacacctaggtaaaatattttgattatgaaaacgagtcagtttataagtggattttattgagaagaagaggataacaaagcttggtcaaatgtttgcatggcatttgtacagtaatcatgatggctgtttttattttaggacatactgtggctgctgccagacatttacccaaggggtggtgcggagttgtttcctcagctgaagctctttgttttgtaccactgagctgaggctggagttgcccccaaagcagtggcagggcagttcccacaagggagtgctccagattatcctgagatggggctggttgggattctaaagaaagaagtactaaacaccagggtgatcagtctagagcatttattggggaaacttacagaggattgcgacaatccttgtgacagacagcaaaaaggagtggggcggtgttctctctaggtatgtctgcagcaaggggattaaggtgtggagtttttatgagagtttgaggaatttgtctcaggtctagggctagtttcttttagtgttttgtgcagcaacttagatacctttatcaatgcctgggaatgtttaaggctccatactgagttcaagcttgctagggaaaacctgcacgtggctgggtcacagagcggtcaaagcactctggtatttggtcaggacatagaatgaaagcacagggaacaggacagccctacactagtggacttagtgatggacgccttctatttgcatcgtctctctttgcatgaggggagacaaagatactctcgattttgtactgtgaattgtgttagatgtgaagaggaggttgtgttgtcttcttagataactgttagaataatgtagagatcaactaagtttgaggatacaaaaagtgagattgtactgagtatatttttcaacagaagaaataattttggtcatgttctttttgttttatttgtaagagatggggtgttgctatgttgcctgggctggactcaaactcctggactctggtgatcctcctgcctcagcctcccaagtagctgggactacagacgtgcagccactgccactatgtccaactgaatcatattctatatggaaagattacattgtagtaaatatgtgttgtacttttgtggtcacattaaaaatatgtaaatgtatttgatgtattttgggactaggaatatgcagttacattaaaccctgtatgtagtaatgccattatttttgttttctttccaatttttgttagattaaatcagatttgtttttttgtgttttttttttttttattgtttacttaaagatggcatttgatttccttaaacttgggagatacatactagcaaatgcctgtagtcaaaggtggttcctgggtaattcaagggtgccaattagagtatactttaagccacgtgtaattatgtccaggctttatatatacttagagcataaaaataaactttcattctctcatatttaagtccattttatatagacaaattcatggcataactttattttcagaaaaatcaggtgtggaaatacttaaaaccacagctgaagtaaattataatttcctcaggaagtaagtataaaagtatgcaataacgattataaaaagaaaatttaaattctttaacatattttttgcagtttcttgccctccatcacttattttaaaaaatggatgttcttaaaaatgtgcaaattaggtgtatattttaatgacacctgtactacaggagatccatgtttctgtattacattaatataaatcttatttgtctaggatcagaaatcaaatgcttttagttgttgctgttaattatctttacatctgtttttgatgtttagctttcctgtttgtgagtaaactactttattagctattaagatgcatggaaaggccgtatcccaaaagagcagtagtcattataatagctttatgtaattaactgaaagcagtatttttctctaaaaggttatcatcttagaaagttaaaaaaaaaagatgttctctagaatatcctttgtcctattggactgatgagctgcagataatggtaatttttatatttaaaactattgtgggacttaagtttaaaattttatgtagtatttcaagttgtaactttgccatgcttaaaaatcatagcaaccaaagtgtctgatgtgatgtgtgctgtgacacattcggagatggctctttaatttgctggtggaggtgtgaaggttaaggaggtccagtttttgaattggttacagattgtttctgaggtagatcaagatctgatcttttttttttttagggcaactaaagatgcccctgaaacataacaacagcattggtcgggtgcagtgagtcaggaaggcccccatatttgcatcccaggtagaaaatgggcctaacaagttgttctttttgcttttagttgaagtgtcttttattatagtggcccctcctcctgtgttttaccttataccttgttgtagacttcgtgagcgctcagtacattgctgagaatttaggatgacgttgatttatctatacagtacatgtttgtcttctcttgacctctttaggtgatgtagatgtgtaaaatttacagtgttcattgatcctgcttcttgttttcccacaattgattttattagttaaaaagattgaattcacaaaactagaaggttctgacctacttaatttttttaattttagagacagagttttactccagctcaggctggagggcaatagcactatcatagctcacttgtagccaagcaatcctcctgtctcagcctcctgagtagccgggactacagatgcatgccaccatgcctggcttatttttaaaaattttccttttggagagatggggtttcactttgttgcctaggctctgatctactcttaaaagatgaggacaggccgggtgtggtggcttacacctgtaatcccagcactttgggaggttgaggcgggtggatcacaaggtcaacacggtgaaaccctgtgtctcctaaaaatacaaaaaattagccaggtgtggtggcggatgcctgtagtcccagctactcaggagcctgaggcaggagagtggcatgaacccaggaggagcttgcagtgagccgaggcaaagagcgagactctgtctcaaaaaaaaaaaaaaagatgaggacatactgagcattgagattacatgaacagcgcattaggaaaaaaactttcattttattggtttcaaataacagagtgaatctcagatagaggtctttgcaagccagtttggcattggactcagctttgaacccctccccgtcttcccttgtctctagtataggataaccccgtttatattcaggcgaggtactaataactttcttctgggaggacctgtctacagttgatgggtcctgaggccagagaaccatggatacatcgcagcctaggtgttatttatgctctctaagaatctgtcaggataagtcactctgaggcataggtgcttacctctggacctggggtgcttgccttcagtgaattgtaatcctgattcttgattccttcttgagttgttgatatgaatcattttttcttttccacagtagctcctgctataatatgctctggggccctgggacatttcatgggtgtaaagtagcttttttccttctgtttggttctatcgtttatggacagtttgtctaatagatataaaataaacatttatatgttgttgaaaagttgttcctatctccccctttctttaatgctctcatagttctaattagctatacacatttaacaattgtgataatacttttaacctctgattgacaacttacttaagatcatgtgtcacttgttaatgttgtaattgcagtgctgattcaaacttcaaaatggagttttttatgtcctccttttctgcataaacacagtaacagtctaatctctctaactccattttgatatctctttcttttccctacagaaaagaaaacatcttgctagagagagatcaatagagagttgttttcagaagtgaactttatatgcagaaaataggaataagtctataacaacagatggtcagaaaatttcatcactgtcatagcagaggcttagcagaatataacttgataaacactacttgtttaaaacttttgaggccgtttagcaggaacattggggaggtgttatttctcatgggtggtttagatctcttagagcgttctgggccattgtgaggtcttgtgcatttgttctgagtcagatgggaagccactggaggatcttgagcagaggcgtgacgtaaattttaagaaacttgttgggatggttgtgttctaaagttaaggaatcaaggatgatgtcaaggtattttcattagcagctaggagaatggagttgctaatttcaaaaaaaaaatttatttttttattttttagagacaaagtctccttatgttgctcaggatgctagagtgcagtggctattcacaggtgtgatcatggtatgctgacagcctcagactcctgtccttaagctgtcctcctgcctcagcctcctgagtagctgggactacaggcgcatgacactgaccccagtgctatttactgatttggggaaatctgtttcaggattaggttttgaggggaaagccaagggtttatcttcaatttcttataattgtaaacaagattttagaccaatgatttattagatatatgatttcttttctgtaatgtttatagttcatttaggaattttagttatttatttgtgtttctttttctttcttggttgatcttctagaacttgttgtttctgaataccaactggtggcttttatttgttaaaggtatttttttttgtcctttagctctatgtcatttattttatatttatcggctccttttccttatcttcctcgtgtgtggcactttaatctttgtcttgtaagacttgaaaatctctactcactgcctttagaggctttgtgtctttttttttaaattgacgtataattctcatactatacaatgagtacaatcaccaccatcaattttagaaatttccctcaccccaaaagaaaaccccatacccaccaggagtcactctttattccttatcttcagcccaaggaaaccactaacctactttcttatagatttgcctattctggacattttatataaaaggaatcaggctgtatgtggtctcttgtggcttctaacacttggcataatgttttcaaggttcatccatgttgtagcatgtatcagtacttcattccttttcattgcagaataatatttgacaataaatacacctttatacagtaagaatactaatgctctaggatttagcgttccaaaaccttgcctgatttttctgtcttctggcagcagttttctgtgaatgcacagcctagattctccacctgcttcttcttctcagaattggtaaatacataccaaaggtaaaagtaaatgcaaaagatcagctgaacttctgtggttttgaagttttttagcccctcctgttcttgctgtcttcaaacagatgatttttatattttatgcagttcttctgtttttttctaaaggaaatgctcttctattgccagctgttgcatctgtcttggatttagaaatctcaagtcttttttttttttttcattactgttgttagagatcctggttttaaaaagtcagggggccatgtgcggtggctcacacctataatcccagcactttggaaggctgaggtggttagatcatcggaggtcaggagttcaagaccagcctggccaacatggtgaaaccccatctctactgaaaatacaaaattagccgggtgtggtggcacacacctgtaatcccagctacttgggaggctgaggcaggagaatcacttgaacccaggaagcagaggttacagtgagccgagattgccccactgcactctagcctgggcgacagagcaagacttcatctcaaaaaaaggggaaggaagactcttagtaagctagctgtatacaaacccccgtcttgtttgtcttctgttgtaccctgatgaggcagttgattttagtctctgctgctgttagtcaggatccttggacagaaaaagagtgaatgaatacattatttctgctgtatcatagaagatgcaaatatccataatttattgattttgctaacaagtttttatatggcatgcttcctttgaaattcagacattttatgaattcaagagtttgctggtccagtgtaaaaattacattgtaattatttcaattaaactagatatggctttgacagttttgcttactgtagttctggtccctgaaaaaagaaatggtggctcacatctgtaatcccagcactttgggaggctgatgcgggtggatcactggaggtcaggagttcgagactggcctggccaagatggtgaaaccccctctctactaaaaaatacaaaaataaactgggtgtggtggtgggcgcctgtgatcccagctacttgggaggctgagacatgagaattgcttgaacctgggaggtggtggttgcagtgagccaagattgcactactgcactccagcctgggcaacagactttatctcaaaaaaagaaaaaaaagaaatgttaaatatctttattcttagagtgaaactttaaaaattgcgtgattatgtttaacatgcattgagcagaaacatttctagtttcacaaacccctgagagtcatgtggttgaggagaatggggtcagtgggggaaagagtagaatgtggaaatggatctttggacagtgccagcaggactaggctgaggcatttgtcttgacataatatctaaagagtcaccaaaaccctcagtaattaagataaacaataatttaatgcagcttttttttttttttttttttttttttgagactgggtctctgtcgcccaggctggagtgcagtggcccaatcatggctcattatagcctccaccttctgggctcaaacagccctcccacctcagcctcccaggctgggactataggtgtgtgccaccacaaccagctattttaaaatttttttgtagagatgggggtctcactatgttgcctaggctggtctcgaactcctgggctcaagtgatcctcctgccttggcctcccaaagtgctgggtttacaggcatgagtcatcacgcctggcctacagtatttttaagaatcaaaaatttatgcaagaaaatctatagtgaacaatatacttttatttttatttaaaaattttttttaaaaccacaaggtcttgttctgtcacctaggctgatgtgcattggcacaatcatggctcattgcagcctcagcctcctccgtctcaagcaatcctcccacctcagcctcctgagcagctgggactacaggcaggcaccaccatgcccagctaattgtttggtatttttttatagagttggggtttcatcttgttgcctaggctgaagatatattttaaagtaagttttaagaaggtatagaagagtatgtagaacacattatattggtgtaatgcaaaagaaactgtatttgcatatgtgcattcttgtatatgcatggaacacctccagaaggttacacaaacaattaggaacagtgattctatctagagagaatgtgatggaaagaaaatagggtgaagggggggtgatgtttatggttcattgcatatccatgtgaattttgtaccatgtatttaataattttctctttttctttttctttttttttttttttttgagacagagtctcgctctgccgcgcaggctggagtgcagtggtgtgatctcggcttactgcaacctttgccttctgggttcaagcaattgtgcctcagcctcctgagtagctggagttacaggtgtatgccaccacaccctgctaatttttgtatttttggtagaagtggggtttcaccatgttactcaggctggtcttgaacttctggcctcaagtgatctgcccacctcagcctctcaaagtgctgggattacagatgtgagtcactgctcctggcctgtattttctttttttccaattaatcttacagcaaatataccatgcaggtgtgttttctgatcaaaagaataaatgtaaaaagcaaatattttaaagaaacaatatccagtaaagtcctcagtacttagaaatgaaatacctttctaaataatacatgagtctaaaatcaaaagagaaattagaaaatgtttcaaaattagaaagttatttgaaacagaatagtaaaaatataacatcagtctttattatgcagcttgaaagagtacataagagggaactttataactttaagtgcttatataactgaaaggaaaaaagcatcagttgtctatgtttttaccttaagaagctacaaaaaccaaaaataatgagaagtaaagagagatcaggagagtgtggcacattggaacataggacagaagataaaggagttttaaagtatctatttatcttgaaatccttgcaatttaggactgggagctgccttatttttttgatatgtttctgtttttgttgttaatgagtattttccaatgtcagtgaaaaattttcagacacaacatttaaaaatagtcattcattttggtgttccgaggtttatttattcattccccttctatcaaacatgtaggctgttaacagtgtttcagtattacaaataaacatattataagcctcaaactgccttaaaactgagaggagatttattggaggtttagtagaccagtctaccagaagttagacttctgggtactcagatttgtttgcttgtcttctgatggtctgtcaactccttatgggatgggactctgtccaattattttgggatccctactgcttaatttattgcctatgcacagaagaggcagacagtaatgatgcacttacagtgacatggagcctttgttatgggcgctctcaaagccctttatgcttgtaatgtttaattatcataactgaaaaatacataccattttaaactttatttaaccgacgagaaactaagttatggagagaaagttaaaaaaaaaaagtgccagggtcacatatctaataccatgtggcagagtttaagttttaggatacttgaaataaactgaatggacctttaaatttagggtgatggaaaagatgatttgggctttggagttgcatgcggctttgacattttacttttacagtctaattgtatcacaagtccttacttgtgtatgtgagcctcagttttctttttcttgaaaatgatgatattagtaattacctccaagtttattagggggacacattttaaaacacacacacataaagccaccttgtacagggctggaacaatataagcccttagtcagtgattggttattgtctctttttcctgtctctttcgctttagacttgttcttaaactctcaaagcttttctcttcatttataaaagtaaacataattatatttgcagatttgttgtaaaatataaatgagatttactctttaaaaatggttttaacattttttaagttaaaaaattgtggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaattgtgataaaaataaattttaaaaaatgtgaaatttgacatttaccagtttttaagtgtacttactgttccagtagtattaagtatattacatttttgtgaaacagatctctagaatttttttcatcttgaaactatgaagctctatgcccataaagcagcttctctccttccagcctcatcctctggaaaccaccattctactacctacttccataaatttgactacattcgatatgttatataagtgtaatcatgttatttattcttttgtgactggcttatttcacttagcataatgtcctcaaggttcagcatgtgttagaatttctttccttttcaaggctgaataatatttcattgaatttatataccacatgttgtttatttgtggatgaacacctgggttacttctaccttttggctattgtgaataatgctgctatgaatatgggtgtttgaatatctcttgcagaacctgatttcagttccttggtttatacccagaagtgggattattgaatctttatggtggtcctagttttaatatttttaggaccacccatgttgttttccatagcagttgtaccattttacattcccaccaacaatacacaagggtttcgatttcttcatatccttgccaaaccttattttctattttttaaaaaagtagcagctattataatgggtgttaggttggttttaacattttttaatgatacaaatttttagatagaattagcaaagtgactcctgaaatttcttggtaagctggaataacaaccattcatgccagcatgacaaaaccaaaagcatacgggagggaaattgacaaaaaaggccaactactatgtagctccgtttggaaagaagaaaagctgtcttatttatgtctgttgcttggaatatagatatgatgagggatagatccacactagctgctactgatattatatatatacatatatatatatatatattttttttttttttttttctttttttttttttttttctttttgagatggagttttgctcttgttgcccaggctggacaatctcggctcattgcaaccaggttcaagcgattctcctgcctcagcctcccaagtagctgggattacaagcatgtgccaccacgcgcggccaattttttgtatttagtacagatggggttttaccatgttggtcggggtggtcttgaactcctgatctcaggtcatccacctgccttggcctcccaaagtgttgggattacaggcatgagccacctcgcctggcctgatacagagtatggagtctgtagtaatggttagctttttcaggccatcatgagggataaatttaaaatgtatattgttgatttttcacttttagctgagaaatgcaggttgtagaagggatttacattcaccacaaggggtcctcctgacaccatcagacccccaggccagtattaatatgtctgtgactgcaaagcccaatttctgacaagtaacccagagcctttacagcctgatcagtggttttctctgtttcagttagcttggaaagttaacctaacttggaaagacacaatagcttgacactgttgctatttgttaaataaggtgagcagtcaaactgtggataaattgcatttatagggtaaaaaaaattgatggtgatgaaataagttgcatgtgtgtatatacattttccataaaataaaagttctatgtttgttttgggcaatgttagcgttaagtaactactggattgccttttgatgtttgcattattatggtcagtataagcaataaaaaaaactctgttttataacatatatggatagattgaacactttgaacttcttcttctgtcctgtgttgtcatgcttctaccactgcatctgaaaaactaatgcagcatcttacagatttcaggagcctttaagaaaaaagcaattacagcagttaacctctcagcagtttctaaatctggaatttagctttgatctctgtatatatgtcaaaacagaaataagaaattatcattaattagagtccgtaaaaatactacttagattaataaggtcagggttttgttgtctttgcctttttagataatgaaatagtttttatgccattaattttagaggtacttgagaatacacattttattgtcttatccaattggcagaaatattaaataagattttcatggtaagagttgcattttcccatctattttttgtatttcactgttgcttaatttagtggttatagttattttctggtgactttgatacatctgtcaagtaccagccacgtgtctagcaggtagtgtgatgacttttatctgaattcatattggggcaggattactgacactagaggactatcacatgagcctcatgatttggtgaattagggtgttgcatggggataagagcagcttatttgtcccatattctttgctgtgtttcttctcttcctttctttgtcccattggtcctcactgtgattcatttaccctttgtaggcctgtttccagactcttctctggaaacctttgtagcatctggaggtaggtgatactataggtggtggtttaactgtgtcatctggctggtgtccaagtgcctgatgcatatcccagctctgcacctgaccagttagttttaatattagatatgttacttaatttctctgttcctcagtttgttcatgtgtcatacatggattgtaatatcatctatgttattggttatttaaagtattaattgagaaaatagatgtaaagcactgcagcaaattggtgaagtacatggactctgtagccagactgcatgagtttgatttccagctttgcaattcagaagttctgcgatattgtgaatttaagttacctggcctctctgtgcttcgatttcttcattggtaaaatggggataacagtatctaccccatgggtagtttgttgtgataggtagatgagtcatcatttttaaagtacttggaagaaggcttggcacagagttagcatctacctggtatcatcatgtcaaaattatattttcattattattagcattgctattacgctatttcatgactggcaagtagtactcagtaagtgataggtattgttattgttactgtcctcattttgctgatgaagaaactgaagttcaggattttgaaatgattttctttgtctcacaggcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaaggtgattagatttattatgactaatatttctttgattttaaccaagtcataatttttgtggatagactaaaatttttgaaaaattgttttcgtggtggaaacagcaagacaaaatgacaggaatggtaattagtaatcttactggaaatgagcgcagtatgagatacctgacattctaaagttaggatatattgtaattatcaagtgctaattggaggaaccatattgtaaaactgtcgaagttatttaaatctgtaactccctgattaatgcaaacataaaagagttgaaagatgatatatttagaagtatgcatgtataatatgaataataatttttttttacattcctcctgttgactggcataaaagcatttattagtgctttactttgccaagtagtgctgccttggtgtttggtattccttaagagagacaaaattatgacaattatatgagaaatgtgaaagttaggctggtattttgtgaactgcttttggtgacatttacaagtagtacatttcctaatagttcattcccagggaccttctcatatatggccagggttttgtagctaagtcagattggacaaaattgtacatcatatgaaggggtttagagttctctcttatgcttactgatcttgcttataacattttttgcaaccctaatgattttatctaatctcacacactattttcatttgtgctctattaaaatttgcggtgaaagttttaatagtatcagtactaaaattatgtgatttatttttttatgtggggtgggaagaagcagtttacatgattttcctagactttatgtccatttttctcttctcatattcttgagaaagcaaagttttcataatgtttagttcacttattcattcaataagtatgtactaagccttcatactgtactgagatctggaagtgaagcagtgcccagacagccatactgtcactgacgtccagcatatacatataccttctctgtgaccatagccttgaaaagaaaacaaattctctttgccgtcttctcattacttagaggtgataggagggtggtggaatatggcctacacttcagtaaggccctggagacaatatgtacagaacagacagaatttccttctgtcacggagcttgcattgtagtgggggtagccaaacaataaactgaatgttgaagtaaatcatgaggtgttttagaaggtataagtgctgtgggaataaaatgaagcagggagagcagatgggccatgcagtttcagacagggtggtctggataggccttgttgagtaggcgacatttgagcatagatgtggcaggggaaagggagcaagccatgtggataacgcgggggcaagagtgtcccacatagagggacaggcagtgcagagtccctgacgtgggcagggagtggcaaggaggtcagtgtggttgtgccaaggaaactaggggatccttggcgatagaggggagccatatcacgcacggccttacagactgtgctaagtatgtaggtgctgaatctgggaaagttggagaactgttgatgagttttaagcagaggagtaaaattgtgtgattgatgttttggaaggatcagtgcacaactcagaagggttgtgaatagagtgtagggcggtgagagctggagcagagagaccaggtaggaggcctatggctgtaatccaggcagcctgggccggggtgaggccaggagatgtggtgagaaatacatgtattctggttatatctggaaggtaaagataagagtttacttttcaagtaggatttaccagaattgctttaaaatatgccagtactaaaagaggttggtgtaaaggtcacagaacttttaaataagtggttggcttttatattagtatgtagaattcataaataagggaatatagaggactgcttacgctttttcacttatgttgccattaactgtagtctgtttctgttcttttcaagatgtcactggattaggaatttaaaagcatagtttgtctttaatatttagcaggaagaaaataataaaactctgtatcaccaaactagccagtacttgcctcattttgcagctctttgaccttgggcaagttgcttggcctctctgaacttcattttcatcttctatgaaaatagggaagtagctgcttcactgagattgtgttatgggttaaatgcagttattttatatacagctatagttgcttgataaaaggtataggttattattagcagtatcacctgtatcctcttcagctcttctctgtggcatgagttggttcctaacatttccatagctgctgtttcaatctggtctctacttagtcaccttggtctctggcctggagaatttatgctctttcatatcttaacatcttcctatactctcaagatcttgcacattaggagatgatatttggatattgaaataaattatgaagtagttgcaggggtaggagagaaagcccccatctactggtcactttaaagtcacagaaaccaggttcatccctctccctcattctctccatcacttttcttgtttgtcctctcatcctctctgtcactgcgactgcattagctccagtcaccaccaccctgtgcttacaccactctctctcctgctcacctggtcctgtggcaggtgttcagtctgactaaaaaatccttcctgtggtagggtggtgtgctgtggtgtgaagaccctggcatcgtagatgaccgagtgggcttggtaactcctgtacctcttcctagtctatgaccctgtctttagtcttagtgctctcatttttaaaagaattgtaataccaagtttgtttaaaagatgtgaaaattagttgtaatcagtacttagtgtgtagaatataattgtaggttactaatgaaggtagcttttattttgtaacttttgagagccgtaagttccaagatggactcagtgtgcttggattatttgtacagtccattagtcgatggctcagattaaactccagtccgttctcacaggagtgtgtcagatatgcttgctggtggatgtgctcttatccttcccatcatgacagtggtcctttacagtcttggtctcttagtataatggtggaggctggggatattttttcatgtattctagttgatctagttgcttgtttcctctgttcttttcctagcttgctcatgtttttctggagcccctttcttcccagtgttccctggggtcagagttcatgctggtgaatgatatgttttcagtggagcatagaagaggtcacttgaactctggctactattaggagcctgaaagtaaacctagagacaaagccatcatcaagagtagcatgttagaaatgaaacaactgtcctggggcatcactggacacaaataagcctcttgttctcctcagcctttgttaagctattgttttcagaagttagtgacttcataaacaaagcctcggtcattttcactgttaagtaaaatacttgatttttgattggtttatacaaatgtactactaacaaaattacccacatttaggaaagctagaactgtagagtctcagtgtgtcttatgtacattcggagaacaaaggcaccaggagcctagttactaattatcttactgctaaagtggaatgtgttcagacagctaaatttttgagatgaccttgactgtctcacagtttgaatggaaaaactaagtagctctgcattttaaaaagttgctagtacagattgtaagggtgttttctgtctgtcttctttagtatgagtttattactcacttatgttttgaaacgaagaaaggaaatcatgcctcttggatacctcaatattccctaagctaatgttaaagaatgtggctacctcaaattcttgattttatgttttcgagagagtttttaaaatttatacacttactatgacagtaccaaccaggaaaaatattttacagcaaaaatatttgggtacctatagacatagagacatagatagatcaggaatttttttccagaaaggatttttatttcatcaaagtaattattttaactctaaggtcataaagaattaggttagtaaaatgacaaaggcatgactttgaaaacaaaaaaggtttgagaagccatctacagacatgatctgggtcagacttgatttgcagcttactcaattttagaatcggttgtcagttttgtaaacagaagactgctggatgaattgaacagaagggtgagattagcatattaataagttactggctactggccttctttttctcctccctcttttccctccctctttctccttccctgaatgaatctaggaacacagagccatggggtcacattactaagctggtttcattctgttcagtagcttgatctagccaggatggtctgtgtttcagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaaggtataaataacttaaaaatatgttccgttttatttgaattcatgcttttgcaccgaaaaggtagataaatgtttttcagaatttatttcaatatatttacagttaaatttaaggaaaaatggaaatagatttggtatgggtttacagctattacataaaaccaattagatagcttttcaaatagcaaatgaaaatattttttatggaaatgaattttaagtgcattaagctatcttttaatgctctgtcctatgtctcaatagttttatttttttcttttaagacatctgtattctgtaatatggaagtttttaaggaataaagaggaattttaacttaaacagggttgtaggaaataagagtaacatgtattttcttattttaaaaattagttttctttactcactgtaaagattgtatattcaatttgaaactcggtattattgtaaggtgggcttaggaataccatacataaacaattttcttctttaatgttgttagggtttttgttcacataaaaatgtaaatataaaataatagcattttcattgtaacattcaagacagtatttgggaaacatatttagaagttaaaaatgctatgtaattggtgcttgactaaaagcaaatcagctgttttgcttagagtagtagaaatatttaagttaggaaataaagttcttaatgaagaatataataaatattttttgttattatttctaatatatttaaatgtcatgttactcccttaggaaagatttttaaaaggaggaagctgcactgttgtaaaaggctgcagttttatgagtagaggtatagactgattgattttagttttcagggtaaaaattttagtaccactgggtactaaaccaagttagcaccaaactacagtttcaccattaaaatcgcttttatttagttgttgctgacatctattgattctttcctaggcttttaaacatttacaaaacgtgatattagaactattttagtattcattttgttcacttgattatgtaattagatactcagagtaaatattttgctgagttaaatttacactcttggattttaaagggctttgggaatgggaactttttaaaattttagtttctgagcatcagaaatgtatagtataagtgagtgtgactaatagtgttcagagccaaagaattctatacttcttgaaaattttggtcttttcctggatttgctggggttcgtttgcatattgccacctccattgtatgataacattgtgttagcactgatgattaacactaaggctctgatttccttcacaaagcctaagctgtattcaagatctacacatccagtaccaacagaatattaaattatcagctactggatttctttttattcagtgtgactttaaaaccgtgaactttggaagaaaagagattatagtgtttttgctcaccccaaagtgattgatggaaacaacttatttttcaattaagtttgctggctgtcagagcaaatgagtacaactatttttaactgaaatatgcattatgatagaggttagggttgggtgagagggaacagagctcacacgtataaaagatgggaaaaggtagggatagtgttaagggtcagaatcagtttcatatgtagggctgcagcaagccatctcctcatatacatggttttgctttccagttgttcagaggaggttctgacaaaacctgggagctgtcatcctgttccttcctggtgctgcacacactgcttccattgtgattgcccagtgtgtaactatcttagtaaacttcctctctctcccctcatgttactcttgtaccaggacagggaggcaggaaaccttgttgttatgctggttaatttttatctgtgtgataaggacaaagatgttggtgtataggaattggctgaattggttatattcaagtataaaagttacaacttgtagataaagacacagtgaaaagctcaaatccaaagaatatacaaatctctatctgcagttagacattctaaaccacacatttgattttatcagtcacattaacctcaaaaagcacagcagtgtcccaatttaagaagacacataaaataccaggacaagctaaaaataatagagcagactatatttatataccttgaactgaaacctttaaggtacccttaaagccttctggggtgtttgaaccaagctcactgtgcggttgaatttggtgtaaagaatccaccttaggtcccatccaaggaagattatattttaaagtattaaaaaggactttgttttaacatgggttcaactacatcatgattttctaggtttaaagacagttttgattcagaatattgaattaaatgtaaatgttcacagtggtattttaggttgcaagactatcaaatgcagaaagccctgtttgggaagttatttgattataccagtttttacattatttatttcatgtttttgaaaggctaggaaggactaaagagtgtcagatatttggttgttaaatcctgatctgatctcttgatttctccagctttgggccgttgtccttttgctcattaatagcacaattattttggcttttcagtgcctcaaacaccccgaactcttcctctcaggcgtttataccttctgttgcaccttcctagaaccatcatctctgcattctctgactagccaactcctacttaaccttttcggtctcagcttaaatgagctcgatgaggaagcaggtgtcttcatcttttgctcactgccatatgcttggcacatactaggtgtttgttaaatatttgttgaatgaatcaatgactagtgtgcacagaaaaatacctaagagtagaatgcatggtactgacattaaaatgcaaaaattactgtgggaatctcactccagtgctctcattcctgtcagtctaaaccaagttttctctagtgtcccctcctatatccttttcttctggtcttgtatagcacttactgtgatttgtcattatatattttacttttttggatttctgtcttctattagactgtaaacttcacagacataatgtcagttttttttcttcttgacaaatagttgacataaatgattattactttaatgaatgaataaattctttgtagggttagatttgattttaaaaggctctttcagagctaaaatcttgtgattaatacagtgttttgtaggtaaatctagttttaggatcattcagctgtcagaaataaatcttccatgtcaaacttttggccattctaatttcattgagtttgtgttttcttttttctcttagagtaaaagtatttatccagggtttaacatagcactctgcccatagtgggtggctaataaatgaatgaatgctttcctttttcctttcctttttcctctcctctcctctcatctgccctcccctgccctcccctcccctctcctgtcctttcctgtcctttcctggcagagtcttgctctgtcgcccaggctggttcaagcagttctgcctcagcctcccaagtagctgggattacaaacgtgcaccaccaagcctggctaattgttgtattttcggtagagacagggtttcaccatgttggccaggctggtctcgaactcctgacctcaagtaatccacccacctcggcctcccaaagtgctaggattacaggtgtgagccaccacacctggtcaattttacagtttctttctgctttacctcaaatcatggcattttaaaagagagctgtgcttcttatagtaatagctaaaatttattcagaaatactacatgccatgctgtgttctgtgcattaaacatgcacaaaaaacatacatgttattccattctcacaaatgtttgtaagctctctgagataggaaatatcattatccccattttccagatgcgataattgaggtactgagagattaaataacttggcaattgttgctcagctaaaataaaaggcagagcaagattctgaacagtgggaatctaactgcagtgcctgtattcttaatcaatatgccgtacacacccaaatagaaaaatggtaggatcataacggaattttcttttttgtgtaatttttgcattttgatatatgtaccatgtcttctactctcagatgtttgcgtactattcattcattcattccacagatatttaatgagaaccaagtaagtaagtaaattggttagtgtgatagaaggtgttaagtgttacagtgaaggtgaggtcagatgacagtcttatatagaatgtctatgtgtagactgcattgaaaaggtgcattttattgaagacctgaaggaaatatgggagttagccaagtggatacttgggaaaagaaagttccaagttgattgtataggtagagcaaaggctcttgctgggaaaatggcattgtggctggaacagagtgaatacggggttatggctatctttccagttcttcgtgcctacgaggtggtggtttaaccagagacacaggcatgggttaaaagtgaggcccactagaaacaagccacagtttgccgatctatcctaatccacattccttaaaaatagctccatgagaggagtgaatcagcctttaaatatcctcctgtgggaaacacatgcctcattctggttctctcaacagatgtcttaacagaaagactggtgaactctcccttttcatttctatttttgaatattagtaacatcaactcatccacaaacataaggcagtgggtattaaactttttctcatattctttttctggtcctcattattagtatttggggaagagactgctagttttgcccaattttttcctctttgtatgtaattttagagctgtcagtggataggtttcttgtttgtttgtttgtttgtttgtttgttttttgagaccgagttttgctcttgtcaccagactggagtgcagtggcgtgatcttggctccctgcaacctccacctcccaggttcaagtgattctcctgcctcagcctcccaagtagctgggattacaggaacccaccaccacagcctgcaaattttttaatttttttttttagtagagacgggttttatcatgttggccaggctggtcttgacctcctgacctcaggtgatctgcctgccttggcctcccaaagtgctgggattacaggcgtgagccaccgtgcccggcctggatatggggtttttgcccaaatatgaccttctaagtgaaggagaataacagcatgccccatattatgcttattgactgggtcttccatgtgtttagcattcccactcccagcctcctaagtgtcctggtttgggcaataaattatatgggaaccctaaaatgtgtcctcctttgatcaccctatgtatgtatgtatgtgtgtacctatgtatgtatgtggcttggtcttgctgtgtcatctggtctggtctcaaactcctaggctcaagcaatcctcccaccttggcctcacaaagtctaggattacaggtgtgtgccaccacacccagcccgatcaaacaatttaaaatggactcatcctcctgccatcactgtacccccatccctgttctgtcttttctatttgctcttaaccactatctaacatacctgacggtttatttatttacttctttggtttagctgctgtccctcagtgaaatgtacaccccatgagacaagggaatcctatctgtcctgctcattgctgcattcccagtgcctaagacgtagtagacttttttttttttttttttttttgagttggagtttcgttcttgttgcccaggctggagtgcaatggcgtgatctcggctcaccgcaacctctgcctcccgggttcaagcgattctcctgcctcagcctcccgagtagctgggattacaggcatgcaccactatgcccggctaattttgtgtttttagtagagataagacctccatattggtcaggctggtctcaaacttccaacctcatgtgatccactcgcctcggcctctcagagtgctggaattatagatgtgagccaccactcctggctggtagactcttactttaaacggataaatgaattaaatcttgtcttctgggagcaacagaggtttcagtcgttagaagcaaatgagagagtgatggagatttttgtggaaattaaaaaaacacttgttctacgaagaagggaacaacagacactgggatttacttgagggtggagggaggaaggagagaagcaaaaaaaaaaactcttgggtgctaggcttaatacctggatggtgaaataatctgtacaacaaaccctcgtgatacaagtttacctttataacaaaccttcatgtgtacccctgaacctaaaataaaagattaaaaaaaaaaaacccaaaacttggttctttaagggttagtgatgctgatttttgtaaagtgttcacaaatctttgatttcagattcatctataattgtttaaactgcaaggaatttattgtaaattcaatggttttctgtattttttttaacagttttcagttagagaaaaatctaactttaaaacagttatccctgaatattttaattttgcatttgaacattatttgcatacatttttataatgtcattgattcgtagctcacataattttagagttggatttaggtgtatattaacttctttacctagaaaagtaaactaaaatacatttgtatttttattttatattatacctttcttaaaaactgtataaaatgagtcattttaagtgttttatagaagtttgacgttgaacccaatgattagtaaattttttctttgactaaaacagtaatgaaatctttggttcatttggtgatacctttggttgattttccacgttcttattctcatagattttggttatttctttgttattgattacagtgttcaactgaatttgttggcttgtggataggaagtctcagcagtttataagttgaattaatatattttccttttttaaatattggggcagtgttgaatctatggattgatttgggagaattgacttatgaacaatattgaacaatacagtaatgaacattgtatatccagttatttaagtcttgtttaatttttctaagcaatgtgtgatagatcttaatgtggtggtctgggtgttttttgatgatattgtaaataataatttttggcttttaagtttaattttctggctggactcagtggctcacacctgtaatcccagcactttgggaggctgagctgggcagattgcgtaaggccaggagttcgagaccagcctggccaacatggtgaaaccctgtctttactaaaaatacaaaaattagctgggtgtagtggcgtgtacttgtagacccagctactcaggaggctgaggcacaagaatcacttgaacctgggaggttgaggttgcaatgagcaaagattgcaccattgcactccagcctgggcaacagagtgagactctgtcaaaaaaaaaaaaaaaaaagtttaattttacaattcttggcctagtatatagaaatagattgtcctattagtttatcttttggccttattataaattcgcttattagttctggtgatctgagtatagaaaatcaaaataaatctgttaatgtgttactggcaaataaaaatagttttcttttctgacctttatatcttcatctatgtctttgccttgaccaggacctctattatagtgttgagaaatggtgagaggagacagatttccccttttttcccccttagggagaacatgttcagtgttaagtttgttaactctagttttgtctgttttgtttttgtggatatcctttttcttttttcttttttttgagacagagtcttgctctgtcgcccaggctggagtgcagtggcacgatctcggctcactgcaacctccgcctcccaggttcaagctattctcctgcctcagcctcccgagtaactgggactaccaagctcgtctaatttttgtatttttggtatagacaaagtttcaccatactggccaggctggtctcgaactcctgatgttgtgatccgcccgcctcggcctcccaaagtgttggggttacaggcatgagccactgtgcccagctgatatcctttttcaaattgaaaaaggttcctttcaattcttaggtttctgagaggttttttttcttttttttattattatgagagggtgttgatttttgtcgaatgctttttctgcatctattcagttgctcatatgagtttttctgttttaatttttataatgtgatgaattatagtgtttaaaatttgtatttatctttattttttgagaaatgaggtcttgctgttaatacgttgcccaggctgatctcaagctcctgggctcaagaagtcctgctgcctcagcctcctgagtacctgacaggcacgagccactgtactcaagtatgaatttttttttaatgttaaaacaacctgcattgctgagataaaccccactttatcatgacatattatcctgatttttttgtttttttgttttttttttcttttatagagacagagtgttactctgttgtccaggctagaatgcagtgtcataatcatagctcactgtatccttgaagtcctgggctcaagcagtcctcctgcctcagcctcctgagtagctgggactacaggtgcgtgccaccatacctggctaattttaaaattttggttatttctttgtagagccaaggtctcgttttgttgcctaggctgttcttgaacttcttgcctcagaagatcctcctgcctcaggctcccaaagtgcttgtattataggcatgagtcaccgcgcctggcctattctattttgatatagctaaatttgataatactttgtgcagattatttgtatctatgtttatgagggatatctgtttgtaatttttttccttgtaatcgttttatcaggttttcttatcaaggtactggtgttctaataaaataagttggaaaatgttccctttttacgtttatgtatatgattaattatgtaaagtttaagaaaaacattatagtgatagcaatagtagccctttcggtggggtagtattaattagaaagggacatgaagataaaacattgatggaaatgttctgtgtcttggtctagggtggtagtcataaggatggagataaatgtacacacatatgtatgtatgtgtattttaaaagtcattgagctgttcactttaggatttgtgtattttataaattatactattaaaatcagactatcaatgtgtctcccacttaacattgcatttctgaaaatcaagcatttttctattttgcaaagggaaaattatatacatcagcagaaaacattaaaccagtttcttaaaaaaacagtgaaaagactagatgtgaacaaaatctaaaatgtaagattgaaaagatttaaaacatggtttcctgattaccagacaatatggttaacagttgtatgtggaaaatgtgccggctcttcactaaatattacaatgtatgataaaacaatataccatgaaataaaattgccagaaaaaaaaggcagacaaaaacctacaataaaaaagaaagtgctgggtgctgtggctcacgcctgtaatcccagtgctttgggaggctgaggtgggtggattgcttgagctcaggagtttgagaccagcctgagcaatatggcaagactccggctttacaaaaaatacaaaaaaaaaaaaaaaatttagctgggcatagtggtgcgacacttgtagttccagctacttggaagcctgaggtgggagaattgcttgagtcaaggaggttgaggctgcggtgagccgtgattaccccactgcactccagcctgggcgacagagcaagaccctgtgtcaaacaaacctataattatgaagtgggatttgaggcctttagaaagttggggaaggaggtaaagagcttgaagcagtctgtgtaattggtcagggaatggggcagatggttttggagagaatggggcaattcaggccaagaagttactgagatgtccagtcacttcatgtgactatagagctgggaagatttcatgatgttctttcagtgattgatgatttagagtaggaaaatgggaaattagagctttgtttacatccccattcgctgtattcttaatttctttgtttggggttataggaagcattagggtatctgtagaagaaagacttctatagcagtcactttcaagggttggagtcccttaatattctgatttttggcctccttttcaaactgtgattatgagaccctacagattaagtcctacaaattttacttggattgtaacttgagacttttccatacatacttttgtttaaaattatgtacgaagttttgaagatacaaatttatattggccaaaaactgttatattgagagatgtgtgtagtctttcatattaaaaaaaaaggcaagggaaaaatccagaaccttgttaaccagggagggagatgttctgtgggtgatgctagagtgttgtatttccttcaaggtctgttttgttacctcccccactcttttatttttctaagaaacaaaatactgttagaatatcatatatgttaatactgctttttgactgtgaaaatcttactgttttgtaaaattggcagaatcaatgagatggtaacagcccctgactattgtatattcttattttaacttttatgtaacttcataatggagttgtatactcatgatagattttcagtttagaaaaaaacccatattttttttaataggacaagctttaggagaaatttttaaaggaagatttgtgtctaatttggttattggattatgaatacatttcaaatataccagatgttaccatagtaaggttagttatcttttgtttccttttttgacaagcattcataaagatatgaggggtaacaggaaagatgttgattaggactaagtaatgatccatgggaaggtctcagtggatttctgtttaaagaatattcctactttgaactccccttttcttggccttagaaaattcagttcatccttctttaacaactgttattgtctgttgaatgctaactttgtttcatgtatcttggtaaacactttatatttattatttcaactcccactttacaggtatggaacctgtggtgacttaagagttgtataattgtgagagctaagcacagtccttgttattaaatgacaggtactgctcctcttgaagatcttgttcagatgtcaccatctataaagcttttcatgatatgtgctagttctgtaaaatttctaaccttctccagttgtaggctcaaatattagattgggcttgctttaaaattttattttggggatttaggtgaagttttagctgtcctgtaatctatagggtcttactcatggaaagtacgtaatggctcaaggtagagataatttagtcttgaaattctgagggatatacttaaccacttaaagtcttcaaagccataagagttgaaatgctgttgtaataaattattatccttactgtgggttgtctgcgtatagtttcacccctccccttcccttccccttccccttcccttccaacagagtctcgctgtgttgcccaggctggagtgcagtggcccaatctcgactcactgcaacctctgcctcctgcctcagcctcccaagtagctgggattacaggcacatgccaccaaacccagataatttttgtatttttagtagagacagggtttcaccatgttggccaggctggtctcaaactcctgacatcccagagtgctgggattacaggcgtgagccactgtgcccggcccagtttcatgtattttattatggaaaaattctggtaaaacatggtatattgaatgcattcttatactcaaaattgagaattaagtgaaatttggcatgttttctctctccttggcttctggaatcctggcaagagactgaagtgttcttttccgtggaaactggtcttagcaaagggctcgatttggacatcaggagaattggccccttctgaggggctgtcatatggtttggctgtgtccccccccaaatcttatcttgaattcccacaggcacagtggatttagcatcattcttaagggccttaggatttgcagaatgggaaatgagtgttggcttcaacttaaaatcaccagctgcattagcccctaatgagagacagcctgtcctctgaagctttgaagctaagcattgacttcacctctagctgtcaaagtcctagatggcatcttctaataaaagactctttcttcttcattgtgtcatttagtgtagccacattaatcagtgatgttagctagatcttttggacaacttggtgcagcttctccaccagcacttgctgcttcatcttgtacttttatgctgtggagatggcttttttccttcaaccttatgaaccaacctctgctagcttcaggctttccttctgtagctaccttacctcaatttatagaactgaagatgagcttgctctggattagtctttggcttaagggaatgttgtgactggtttgatctatccagaccaccaaaaccttctcagtttcagcaataaggctgttctgctttcttatcatttgtgtgttcagtggagtagcatttgtatttccttcagtgacttttcctttgcattcacaacttggctttttggcacaagaagcctagcttttggcttgtttcagcttttgacatgctttcttcactaggcttaatcatttctagcgtttgatttaaagtgagaggaatgggactgttcgtttcacttgaacgcttagaggccattgtagggttattaattggcctaatttcagtattattgtgtctctgaatagggaggccttaggagaggtgggagagatgaggcagcagcgggttggtggagcagttaggacacacacgtatcaactaagctcgctctcttaacgtgggtgccatttgtggcaccccaagacagttacaatagaaatatcaaatatcatgaatcagcatcacagaaataataataatgaaaaagttggaaataattgtgagcattaccaaaatgtagcacatttggtaaagtgggcatatgctgttgggaaaatgatgcccatagactcgctcgatgcagggttgccacaaaccctttgttttttgttgttgttgtttttgttttaaaaaaaaggcagttggatgaattatcaatttctatgattgctggggaaggcaaattatacagggctagggaagaaggtacaagttgagtatccctgatctgaaaatctgaaattcgatatgctcccaaatactcagcttttttgagcgccgatatgatgttcaacggaaacttgttggagcattgcagatgttgtattttcttatttgggatgttcaaccagtgagtataatgcaaatattccaaaatctgaaaaagtatgaaatctgaaactcttctggtcctaaacatttaggttagggatactcactcatagtagagaagaaggcagaaaggactagagtggttattcaacagtttagtaggttgaaccagcacaagataaagcaagcatgtgttggaatgtctaatataaattttttcgctaggaccagttggaatatccgattgcgtcctcttcatttggtaaatcagattgagcatctgtcttcacagtactgaaaatagtggaaacagtgagatctgcttgttgtgtcttcactggtattcttagtataggcttcaatcttaataactgtgagtttcttaagacattgtgtcaggtaactcatttcattgatttacttgttattggtatgtaaatattgtacttatttttgaggtatacgtgatacctgtatacaatatgtgatgatcaaatcagggtaattaggatatcatctccaacacttttctttcctttgtgttgggaacattacaattctcattttaaaatatgcaataaattattaactgtgattttcttgctgtactatcaaatactagaacttattccttctaactatatttttgtaccccttaacctacttctatttatgccctgtaccctttcccttcccagcctctggtaaccaccactctactctatacttccatgggattcactttttttagctcctaactgtgaatgagaacatgccatatttgtctttctgtgcctggcttatttcacttaaggtaatgacctctggttccattcatgttgctgcagctgacaagatttcattcttctgttgctgaataatattccattgtgtatatataccacattgtccatgtggattccatatcttggctgttgtgaatagggctgtaataagaatggggatgcagatatcacttcaatatactgatttcctttcttttgaatatgtattcagtattgggattgctggatcatatattctatttttgtttttttataatggctatactactttacattcctaccaacagagtgtggaagcattcctctttctctgcatccttgccagcacttgttattttttgtcttttttataataggtattacaactgaggtgagatggtatctcattgtggttttaatttgtattttcctgatgatagtagtgttgagcattttttccatatacctattggccttttgtatgtcttctattgagaaatgtctttcagatcttgtgcccatttttaaaacaggattatttatccttttgaggtttttttttttagagacaggatctggcatgttgtgtcttcattctcattggtttcaaataacttacttatttctgccttcatttcttatttacccagtagtcattcaggaggagcaagttgttcagtttccatgtagttgtgcagttttgagttttcttaatcctgagttccaatttgattgcactgtggtctgagagactgttatgatttccattcttttgcatttgctgaggagtattttactttcaattatgttgtcaactttagaataagtgtgatgtgctgagaagaatgtatattctgttgatctggggtggagagttctgtagatgtctattaggtccgcttggtccagagctgagttcaagtcctgaatatccgtgtttatcttctgtcttgttgatctgtctaatattgacagtggggtgttaaagtctcccgctattattgtgtggaagtctaagtctctttgtaggtctctaagaactttatgaatctgggtgctcctgtattgggtgcatatatatatttaagatagttagctcttcttgttgcattgatctctttaccattatataatgcccttctttgtcttttttgatctttgttggtttaaagtctgttttatcagagactaggattgcaacctctgcttttttttttgctttccatgtgcttggtaaatattcctccatccctttattttgagcctgtgtgtgtctttgcacatgacatgggtctcccaaatacagcactccgatgagtcttgactctttatccagtttgccagtctgtgtcttttaattgggatatttagcacacttacatttaaagttaatctgggacacagctaaagcagtgtttagagggaaatttatagcactaaatgtccataagagaaagcaggaaagatctaaaatcgacaccctagcatgacaattaaaagaactagagaaggaagagcaaacacattcaaatgctagcagaagacaagaaataactaagattagagcagaactgaaggagatagagatacaaaaaaactttcaaaaatcaatgaatccaggagctggttttttgaaaagattaacaaaatagaccgctagccagacgaataaagaagaaaagagagaagaatcaaagagacacaataaaaaatgataaaggggatatcaccactgatcccacagaaatacaaactaccattagaaaatactagaaacacctctatgcaaataaactagaaaatctagaagaaatggatacattcctggacacatacaccctcccaagactaaatcaggaagaagtcaaatccctgaatggaccaataacaagttctgaaattgaggcagtaattaatagcctaccaaccaaaaaaaagcccaggaccagacagattcacagctgaattctaccagaggtacaaagaagagctggtacaattccttttgaaactattccaagcaatagaaaaagagggactcttccctaactcattttatgaggtcagcatcatcttgataccaaaatttggcagacacacaagaaaaaaagaaaatttcaggccgatatgcctgatgaacatcgatgcgaaaatcctcaataaaatgctggcaaacccaatccagcagcacatgaaaaagcatatccaccactatcaagtcggcttcatccctcggatgcaaggcttgttcaacaaacgcaaatcaataaacataatccatcacataaacagaaccaatgacaaaaaccatgattatcaatagatgcagaaaaggccttcaataaaattcaacaccccttcatgttaaaaactctcaataaagtacgtattgatggaacgtatctcaaaataataagagctatttatgacaaacccacagctaataccatactgaatgggcaaaagctggatgcattccctttgaaaactggcacaagacaaggatgccgtctctcaccactcctattcaacatagtattggaagttctggccagggcagtcaggctagagaaagaaagaaagaaaggatattcaaataggaagagaggaagtcaaaattgtctctgtttgtggatgacatgattgtatatttagaaaaccccatcatcttagcccaaaatctccttaagctgataagcaacttcagcaaaatctcagggttcaaaatcaatgtgcaaaaattacaagcattcctatacaccaataatagagagccaaatcatgagtgaactcccattcacaattgctataaagagaataaaatacctaggaatacatcttacaagggatgtgaaggacctcttcaaggagaactacaaaccactgctcatggaaataagagaggacacaaacaaatggaaaaacattccatgctcatgggtaggaagaatcaatattgtgaaaatggccatactgcccaaagtaatttatagattcgatgctgtccccatgaagctcccattgactttcttcacagaattagaaaaaactactttaaatttcatacggaaccaaaaaagagcccgcatagccaactcaatcctaagcaaaaagaacaaagctagaggcatcatgctacctgacttcaacctatcctacaaggctacagtatcccaaacagcatggcagtggtaccaaaacagatattatggtactggtaccaaaacagatagaccagtggaacagaacagaggcctcagaaataacgccatacatctacaaccatctgatctttgacaaacctgacaaaaacaagcaatgggggaaaggattccctatttaataaatggtgctgggaaaactggctagccatatgtagaaaactgaaactggaccccttccttacaccttatacaaaaattaactcaagatggattaaagacttaaacgtaagacctaaaaccataaaaaccctggaagaaaacctaggcaataccattcaggacataggcatgggcaaagacttcatgactaaaacaacagaagcaatggcaacaaaagccaaattgacaaatggcatctaattaaactaaagagcttctgcatggcaaaaaaaaaaaaaaaaaaaaaaaaaaaaaaaaaaacaactctcatcagagtgaacaggcaacctacagaatgggagaaaatttttgtaatctgtctatctgactaagggctaatatccagaatcttcaaagaacttaaatttacaagaaaaaaacaaccccaccaaaaagtgggcgaaggatatgaacagacacttctcaagaagacatttatgtggccaataaacatatgaaaaaaagctcatcatcactggtcattagagacatgcaaagcaaaaccacagtgaaataccatctcacaccagttagaatggcaatcattaaaaattcaggaaacaacagaagctggagaggatgtggagaaataggaacgcttttacactgttggtgggagtgtaaattagttcaaccattgtggaagacagtgtggcaattcctcaaggatctagaaccagaaataccatttgacccagcaatcccattattgggtatatacccaaaggattataaatcattctataaagacacatgcacatgtatgtttattgcaacactgttcacagtagcaaagacttggaaccaacccagatgtccatcagtgatagactggataaagaaaatatggtggctgggcacggtggctcacgcctgtaatcccagtacttttggaggccgaggcgtgtggatcgcctgatgtcaggagtttgagaccagccctggccaacatggcaaaaccccatctttactaaaaatacaaaaattagctgggcgtggtggcgtgcgcctgtaatcccagctacccaggaggctgaggcaggagaatcactggaacccgggggtcagaggctgcagtgagccaagattgtgccgctgcactccagactgggtgacagagcaagactccatctccaaaaaaaaaaaaaaatgtggcacatatacaccatggaatactctgtagccataaaaaaggatgagttgatgtcctttgcagggacgtggatgaagctggaaaccatcattcttggcaaactaacacaggaacagaaaaccaaacactgcatgttctcactcataagtgggagttgaacaatgacaacacatggacacagggaggggaacatcacacaccggggcctgtcgcaggattgttgggggtaggggagggatagcgttatgagaaatattcctaatgtagatgacgggttgatgggtgcagcaaaccaccatggcatgtgtatacctacataacaaacctgcacgttctgcacatatatcccagaacttaaaagtatttaaaaaaaaaaaaaaaaagacaggatcttgctttcttgcccaagctggagttcattgagcatgattttagctcattgtacctccaactccttctattgagttttctaagctctttatagattctggttattaatccgttgtcagatgggtaggtgcaaatactttctcccattctttgtgttgtctttttactttgttaattgtgtcttttgctctgcagaggctttttatcttgatgtaatcccatttgtcttatttttgctttagttgcctgtatttttgaggtcttaagttgaaaaatccttgtcgagatcagtgtccagaagtgtttccccagtattttcttacagtaattccatagtttcaggtcttagagttgagtctttaattccatgtggatttgctattttgtgtatggtgagagagagagagagagagatgtaatttcattctcctgcatacagttatccagttttctcggcaccaggtattaaaggaactatcatttccccactgcatgatcttggaggttggaggctttgtcaaaaatgaattggttgtaaatgtatggatttatatttgagatctccattctgtttcattgccctgtgtgtttttatgcctgtaccatgctgatttggttactatagcttattgtaatttttgaagtcaggtagtgtaatgtctccagctttgttctttttgctcaggattgctttggctattcagggtcttttgtggttccatataaattttaggattttttttttcctatttctgcgaagaatgtcattggtattttgatagggattccattgaatctgtaaattgctttgggtattgttgtcattttaacaatattaatttttccaatcctttaacatgaaatatttttcaacttgtgtatgtgtgtcctcttcaatttcttccttttttttctctctttttgagacagtctcactttgtcacccaggctggaatgcagtggcacgatctcggctcactgcatcccccacctcccgggttcaagctgttctgatggctcagcttctcgagtagctgggattacaggcatgtgataccatgcctggcaaatttttgtaattttagtagagatggggtttcgccatgttggtgaggctggtcatgaactcctggcctctagtgatacgcctgccttgacctcccaaagtgctgggattacaggcatgagccaccacacccagcccctcttcaatttctttcaccaatgttttatagttttccttatgttgatcatttacttctttggttaaattgactcctaggtatttgatattttttgtagctgttgtaaatgtgattgctttcttgatttattttatacattgttcgttgttggtgtatataaatgctacttcttttcatatgttggtttttgcatcctgctactttactgaatttatcagttcttaaagctttttggtgaagtctttgggttataagatcatgtcatctgtcaacgaaactaatttgacatcttccttgtcgattcgggtgccttttatttctcttgtctaattgctctggccaggactttcagtactatgttgaataaaagtggtgagagtgggcatccttgtattgtttcagatcgcagaggaaaggccttcacattttccctcagctcgatgttagtttgtggatttgtcatatatggccttttattattttgagatatattccttctgtaccctattttttgggaatttttatcatgaagagatgttgaattttatcaaatgctttttcttcatctattgagatgagaccatatggttttttcttctttgttctgttaatgtgatatatcacatttattgatttgcatatgttgaactctccttgcatctctgggatgaatcctacttaatcatggtaattgatcttttgaatgtgttgtttaattcagtttgctagtattttgttgaggatatttgtgtttacgttcctcagtgatattggcctgtagttttctttttttgttgcattgttgtctggttttgttgtaaaggtaatactgcccttgtaaaatgattttggaaatattctcccctcttcaatatttttgagtagaagagtttgcagtagaattggtattacttcttaaaatgttttttgtaaaattcatcaattggcttattgaggttttcttgtttcttcatgattcaatcttgataggttgtatgtgtccaagaatttatcaatttattccagcttttcaaatttgttagcaaatgttgttcacaatagtctctgtaagagtctttgtatttctgtagtaatcagtatagtggctgagttccaagaaaaccgagggaatcttggtcaactctttttggtttatttttcttttggtaattgccttttatttcctagcctagaaagtcccttagccagagtcagaagcccacccagattcaaggagagggaatacagattccacttattaacagaaagtgtatcaaagttacattggaaaaagggcatattaaacattaagtaatttcatgttagctgctttgtctagtaaaatcaggaaatttaggttagactttttatgggaaaataaactcaagcgttatagaaaataccaaaatgatggagaagataacttttataccagtttagtttaaggagtcactttaactagaaatattacccagattcttaaagctcttcaagttaggtcataatttcttttgatttagctgtctcaatttgcattcctttgcttattctctcatgttctaacagtgagctactcttctttcaacaccctccctcaccactctccctcccctttacagcttcagcaaatgtctcaagttttattaaagggtcagtgtactttaagcataatgaggtagttatcttggtgggatcttaacatgtacagtaattataaatgagggaattctggagtaaagagtagggtgtttattatgttcgttgcatttttttcccttttttgtatgtgctgcattatgtagcatttacatcaggttgtgggttgaaccttggagcttaactccagaggttagtaacacttttttcttcacatctggacttggaactgccctatttcttcaagaggagaagaaacagttaggcactgagaacccttgatatgtttcctatgttaattaaagggagacctaaagttgtagacagctgagcagcaattattgacattccatcttctctcccattccagtccacatttgctctcttgcctacagtgatttaaactgggcagcctggctgagccaggactcagtaaagtgtagtcagcagactaatgttggtgcagatgaatgttggtgctggaactgtttaacagcctaggacaagataaggaaatttggtgtaagcatctagacaccttacagcaatttgatagtaattttatgtcgattgattctaatgatggaaattttgtgcttggcttaggtatgtctttttttaaaaaaacttcttttttctagaaattccttttcattgtattttacaaaagtattggtctgtgataggttggaaatttaaactggttcttcatcacagatgatttgaaaagtactggcctaagccacgtaaaaacagtttttggttttaaaatcttttcatttctgccttgataatttattgaaaaagatattatgtagtgcgcaaaagtggcagatctctgtgaataattaatcttgaaaagtttttaaaaatgtaattggccgcagaaacagaagggctacaataacaaagccctgttaaaagattacctttccatggtgagggggtaaaagacttttttcatttagagacacacaaagaattggcagccccagctgttcaactttagccatggatcagaagcaaatacagaaccacacaaacaacacagggaagtctgttaattggtagaaacagaatagtcattgtagcagaaagcaactcttgggacttgtcattctatagttgaggccattctttgaactgaccaaaccgtgatgagtgcccaaagaggtgacccagatgccaggatctcagaaccctcaagaccaacaaaaacatgaagacacgtgaatgccaccaacagggtacttgggaggttaacagcatcagacacagaccttcccggagagagctgaagaaggcctgatggcaaatatattgcatatttgagaatttatagcacagatcagattttgacaagcagataaaacattaaagtgtaaaacaaaataacattccttttttttttcttttggtaagttctgaaaggataggagcaaaatcacattctataatggaaaactgcttcattctggtaacattgtaacaaaagtttatctttaaaaaaatgttttggcctattttttgaagacctatttatgaaggcctgtttatggagaatctcaccattgatttttgggccacataggtatatttggattgtgtggtatttttggtttagcttctcccccgacatactccgtatttattccaagtagtgttttttcattgctagcatatcttttcttctgatgacttgtgaggtgtaatcttttcttccaggaagcagttgatactatgaatttagttgtctttatcttctaatttgggcttcaaaagagttagctaaaatgatcagaagtatagttgttgttttactatccagcagtcttgttacatttatttatttattccagcagtttatttgtagattcttttagattttcttcataatctatgcataattatagttttacttacatagtttatgaataatgatagttttgtttgttctttcccaatgtttatgttttacccaccccccccccccgtttttttggggggaagggggggcgtctatggtacttggcagtgacttccagaacaatgctgtacgcaagtggtaatggtgggcatccatgtcttatttccagtttggggaggggaagtttttttcccactagtatttacatttcatgtagatactctttgtcagatatatgaaatctcatcctatttctagtttgctgcgagtttttatcatgaatggttggtaaattttatcatatgtgttttctgcatgtatcgaggtagctggctcttctttctgaaaatgtggtgaattacactgattgctttttgaatgaatacctttcttctattcctagaataaacttttggtcatgatacattattcctttaaaatattgctggattatacttgttaagatttttgcatctgtgtttataagaaaggtagacttttatcgtttctcatcctgttctgtcaggttttgatatcactgttctgcaggtgtcataaaacaagttgggaaatgatctgtatctgttttctggaagaatttgtgtaagattaatatttcttaatttgttgaaagaaataaaatgttcctttgtggggagaattttagatggactattttaaatagaacagtctagtttcattttacattgtttcattttgctgtgttgtgttttgcaaggaattgtgcttatctaaattttcaaattcattggcatagttattaataatcccttattgtattactcattatctcttacctcttattatattctcttcttcatttttgatgttgctagtttttcttgactcattttatctttgattagtcttagagaggtgtatcaattttgttttttaaaagagtaacttttaattttgttctgcttttaagttgtccttttaaatatgcattcttttttaattaaatttttattggtacatagtaggtatatatatatttatggggtacatgagacgttttgatataggcatacagtgcataataatcacatcaggctaaatggggtatccatcacctcaaacatttatctttttttggtgttacaaacattctaattatactcttagttctttttaaatgtacatttttattgaccataatgcctagttgtgctaccaaatactagctcttacgcattctatttttctgtgcattaaccatccccccttcacagatgtgtattcttagagatactcaaccttcgcttctaatacatgaatttaaatacgtaatttttttttttttttaaaggagacagggttgtgctctgttgctcaggctggagtgcagtggtgcagtcataacttgctgcagccttgagctctggggcttaagcagtcctcctgcctcagcctcccaaggagctgggactacaggcacacaccaccatgcccagctgatttttttaaattattttgtaggggtctcacaagcccaggcaggtcttgaactcctggcctcaagctgtcctcccatctcagcctccaaaagtgctgggattacaggcgtgattcactgtgccctgccaaatgtatagattttactctaagtatagctctgtctacattcacagttttgatatttcttttcactgtaccatttaattcaaaatactttgagtttctttttgacttaaagggttagttgaaatacattgcttaatttcctgacaatggaacattttctagttattttgtaattgttgtctagcctaatgctagacacagaatatactctgaataattttagtcccttgatatttattgaatctttctctttcactcagtgtatgggcaacttcagaaaatatttcttgtgtgcttgcaaagattatgtattatcctattaggtatagtgtcagtttctatgtcaattagatcagatttgttaatcgtgctcttcagatcttctatagcgtaccaaaagttataagggtgtattcatgtatactcagaagtgccaccccacaccacatcctccattcctgtactttccatcttggtcacacctctcccatgtgtaaccagtctcaatggactcccatttctactttgtggggttattttgcacatatgagcagatacatttatattttcctattttcccccttttattcaaaaggtatactgtggccgtgatttgcactttgggtttttaacttaataaatcctggaattcatacttagtcaattatagggctcttcttctttccttttgtttttcccccagcagattcatagtactccattataggaatgtaccatagtttactctattagtctcccatgaatgggcatttaggtgtttcctaatactttgtaaggctgcagtgaataaccttatgcatatgtattttcatgttgttgttaagtatatctcttcacttgggacgattgtaacaaaatacataaactgggtggcttataaacaacagaaacttatttctcactggtctagaggctggaagtcctagatcagagtgatagcatggtggagttctggtgagggccctttttttccagttttcagactgtggacttagatcctcaggcatatctctggagagcagagagaggaagcatgctcttggactttcacaagggcactaatcccattcatgagggcctcaccattatgaccttatctagttcagattccctccaaaagaccctaccttgtaatagcatcacattggggggagtatggtatcaacttatgaattttgggagcacacagacatttagttggtaacagtatatctttggcataaattcctagaagtggaattgctggatcagaagacacatgtagttttgttattgtcaaattcccctttatacatactatagaaaattcacattcccatcagcagtgtatgagagttctgtttccccacatccttaccaaatgacagggtactgctatgacctttttaaaaaaattatttgacagttgtttatatatttatattttcacagaggtaaaattcccataacataaaattcaccattttaacaacttcaaagtgtgcaattgagtgttttttagtatattcaaccatcaccatgatctaaattcagaccatttctctcatccccaaaagaaactccttatctattagcagtccttcccaactctgccctacccccagccactggcagccagtaatctactttcttctgtatagatttgcatattccttcatataagtggaatcacaatttgtggtctttcacgtctggtttccttgtagtataatgttctcaaggttcctccatgttgcggcatgtatcagtgcttcgtttctttttatgctgaacaatatttcattgttgggcataccacattttgttaatctgtttatccattgatggatgtggatatttgggttattatcacttttcggtattgtggataatgctgctgtgaccattcacatgtgagggtgtttcattttgttttatgtcagggtctctttctgtcgcccaagctggagtacaatggcatgatcacagctactgcagcctcgacctcctggactcaagcaatcctcggcctcccaagtagctgggagtacaggcacatgccaccatgcccagttaatttttatagagatggggtttcgccatgttgcccaggctggtcttgaactcctgacctcaagcagtcctcctgcctcagtctcccaaagtgctgggattacaggcatgagccactatgcccagccatgagtttttatttggacatacattttcagttcttttgggcatatgtctacctagaaatggaatggttggttcatgtggtaactccatgtttaaccttttgaggaactgccaaactattttcatagtagttgcaccattttatactcttccagcaatgtaggaaggtttcagtttcttcacatccttgcctacacttggtatatctttttaattaattgtctggattgtctcttgcattcttttctatcatttcccccctcattttaaaagaatttctgtatatatatagggtattagctttttactgtgatacatggtacatatgtttttcttttgtgtttttggcatcttttgacttggtttataatttttttccttttactgtgctgttataccatttttttttttaactaattggagaatgatttggatgaaaaaggtattatttatgctttgtttgataccaacagagggttggctcttttctttgctggacagatagtggggagttgacagggtctggctctgtcgccctggctggaaagcagtggcacgatctcggctcactgtagccttcccctcttgggctcaagtgatcctcccccctcagcctcccaagtagctgggaccacaagcatgcgccacgactcctggctctttattgtaatttttttgtagagatgggttttgccaagttggctaggctggtcttgaacctttgggctcaagcaatctgcctgcctcagcctcccaaagtgttgggattataggcatgagcatctatgcctggctggatctgtggttttgtgtgtgtgtgtgtttgttcgtttgtttgttttgagacagtctcactctgtggtccaggctgaagtgcagcaatgcagtcacagctcactatagcctcaacctcctgggctcaagctatcctcccaccttagcctcctgagtagctgggactacaggaacacgctaccacgcccaagctaatttttgtattttttagtagagacaaggtcttgtcatgttgcccagactggtctcaaactcctggactcaagcagtcttcccgcctcagccttccaaagtgctgggattacaggcatgagcagccatacctggcctgccacgatggatctgagcaggaattgtactccaggtttacaaagctccctttgcttctgcacccagctgttctcactgcaagcctggggatgtcctaacactattctggtttattcctgaagtcttattcctgtttcctaaaccctttcactgttttgagaggctccttctcagcttgggttcaggattccgtaactgtcttcaggagacaacctgcagagtgtttgacacagtctccacccttccttctcaccagaatccaagatttgatcccttgctgccgaaagctctgctggtttctctcccattcgtagccttttcttgtctcttcaggctctgaagggctcagaattggcaaatgccctgtgggaaaaagcagccagctgttaagtatcatttcctgtcttcatctgtgtcactcattgtcttggttgcctcagaatatctttgtctctgagcccttcaaacattgtttgagttaaaaagatttttaatctggattttcatgtttctcgatgggtgtttaggcttgtgcaggctatttcttcaaactcaaatagaagtcctttatcgcacttaaaaattttaattgtgcatgcttttttcgttttgttttcagttgctgtctgtctgattctcctgttaacaatgaattggttaagccagggaccttattttaattatagtgtttttaatcaccaatgcctagtatatataatgaatactcattgaatttgtattatatgaagaaagaacttttctcttaggtaaaagttttcaaaagcagggagcaaattaacaaatttggctttgctatgagattttccaacaaatttaaaggctatgattaaaaaaggggtgggggtgggggtattacattgtttgtagatactttttgacacagctgaaattggagtcctggccttttaataatttttttttaacaaatatttattctgtaaatcaggtcctactctgggtatggggagagacagctattattttagtggattaggtctctattctcctcagactccttccgcatataacatatcaagagagagtataggacatttgatataaacaacatatcacattgtaattggtagatttcaagtattatacacaaaaaattattttgttcttttaacagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcagggtaagtacgtttttccatgagacatctttaatgtttatttaggttaaaatgtaatggcatgtatgaaaaaagatagtgtaataatttttatttaacttatcggggacttttcatattacagaaatgctatttttaattataagatttattagttaatatgtgactgaccagcgttctaattgttgtaaagtttcttagaaaaataatgactgaatcatattttagtcataaaataccattgacttatttttcccttctaggttttttttttttttaactcttggatgagtactaggcaacaatgcaactaaaatagcctctaacagtcatgaaataaactacttttctagaaagtgtaatttggaaggtatttgcatgacttcagataggataatttcctttaaaactcttgaacatatgctgtgtgtcaggcactgtgctaggttctgaagatgtaaaaggtccctgtgaagtccttgatcttacagcttagagcctgtagagggagagacatcatgaatgtgattatagtacagtgtagaagtgcttcacgggaggttgttgtggaagcttggaggaataataccttttaaacgtagaagttagtactggaaaggatttcctttgggtctgggaaggtgaggaaagatagtgatacagaattgtgggagaagagcatgctaggcaaaggtaactacatctttctgaaggtggggaatgaaaaggtagcactgtgatttcagaaagctgagttcagtatttaaatgttcagtatttgctttgatgaagtgttaaatacctcctctttcttaccctctccacctagtctatattcatctttaaggagaagtttccagtgacaaggaagtttagatacgtcttttttcttttcttttctttcttttttttttttacaataagtaaattaattaatttgctactctctaacttacatgcccttattatttttaaccaaagcaaagggattggtagaatttagatttaaggccaacaggtcgggcatggtggtccatgcctgtaatcccagcactttgggaggccaaggtgggcaggtcacttgaggtcaggagtttgagagcagcctggccaacatggcgaaaccccatctctacaaaaaatacaaaattagccaggtgtggtgtcacatgcctatagtcccagctactcaggaggctgagacaggagaaacacttgaacccaggaggcagaggttgcagtgagctgagatcgtgccactgcactctagcctgggcaacaaagtgagactgtctcaaaagaaaaaaaagaaaaaaaagatttaaggctaaagtcttgtatataaattttacataattttttgttacctctaaattttaatattagcaaactattcaaatggattaattattaaaaatatgatagcctctttttttttacaaactctttatgaagctggttagcttttttgcgttttctgttttttttctacttctgtgttttacttttaactttataaaacactgtcatttggtagaaaggcctgcaatgagcatcctgccataaggtttatcagataattcatactggaaaaaaaccttgtagatgtaactttatgtaaggcttttagtgtatgttctagtctttgtagatttcagatacagtgaatgaggaaactctccaataaaaccattgtatcagccctaatgaactctagggcattcatacaggagggaaacctttcaaagattatgaatttgacaagacatttagcaaaaatgttcaagacttacatcagaagactcacctaggaaagattttaacagatgtgccatggttttagtatcaaactttctgcatgtaaggggattactaccatagagtcagtgtcactgcaggcatgttagcctttagccaatgttaaaaacttcctagtcatacattcatattgtgaagaaaaatttacatcagatacaaatgtataagttatcagaactcatttagcaaacttgtgaagatcaatctgatcaaatctatgtggccacaaacaacgtgttttatttcacagtaattggcaaattatcagtcagtgattttcagattgaggcagaaaaatcacagttggcattgaattcaccatagccctttcctgggatagcatgaggttctcatgatactgagtcactgtaatggaagattggatattattcataaccaacttccattgaatgctttaatgctataacatttgaaaatgcaatatcataattgtaaattaatgagtggatttgtacatctgaacaaagggactgaacaacataagaggtatcagacaaaggaacattatggatacagagtattgtcaggaaagagaaaaatggaagaaacatgacagcatttgaaggcctgatgaccttagaacaggaagtggggattgtaggatttagatttaaggattagattagtaaagaatccaagtataattacttgtcagaaagaaactgaccattgaatagcatcaaaggggatgccacacaactattttctgaaatgatacggcttattgttattcaggtactgaataactcgattcagtcttaaactcattatagctacgttgcccattatcgtagccatgtgcagttgttgagcacttgaatgtggctagtctgaattgacatgtgctatagtataaaaatatataccacatttcaaagagtaagaaaacagaataaaatatatcaatgtgttatgattacatgttaaatgataatacttttgatatagtaggttaactgaactatattactgaaattgaatttacctgtttgtttttattttatttttttactgtgactactagaaattttaaaattacttatgtggcttgcattatatttctgctggacagtggtgttctgtagaaagcaaattctcagaaagactgcttggttcagaaaaaacaaaactttttgaggagtttaaagatttgttttcaccaagaatatctggatttttgtaacatttcattatagagcctttatcatgcttcagttaataagtattagtgcttttacaattatgtgtgctaattgtatgttaattaatgtttgattgttgaaaagatttgcaagatttcacagtttataggcaaaatccattacagcaacagtagtaaaatgatactcattgaagtgatctggagatcttgggtacaggcttcttggccttggacatgatttttctgtagatgtgaaaccattactggcttatgtgtgaagcacctcagtatgaggaagtggtggggatctgtgagagggtcacacaagcactctccatctacgtagccagcctcaacctgtggacctccccaggtactgccaaaatcaggtacaccttgtcagtccagttattattacaaaatcgcactgacaagctggtatattctgccccccaaacagctcagggtcccatgatcacaaacatcacttatcttggccatagctttggccaagtgtcagtaccgtgcttcaggcagctctagagataagtgtggggtcaatctagaacagccaagagaaacccaggctgtacaatgttgaataagaccagtcatctagaaacatggcagtgataattcagaaaaataatgacataaaattccaaattctaccagagaaattccctacttaggagaaagaatgacgtttacaccagacttttcatcagcaatgctggatgcaagaagacattggaacagtatcttcaaagggctcagggaaaataacatgtactttagaagtctatatcagataaattattaatcaagataatgtgaaatgaaggtatctgcagagaagtagtgacatagaaagctaatagcatgggctctctttgaaaaaacaattagatgatataatgcagcgtggaaaaaagttgagcccataagaaaatactgtagcaggatgcaagagacagtggtccattgtcatacttgctgccttgtatgctgtcttgtacctctcttaatgtccccgtagtctcttgaatctaccaccatgatttaatccaaccttctgcctattctccacctgtcgccatcctgtgattggttacattctagatttgcaaccttagtgctacccagctgtcatgctctatccccccatcttgttctctcctagacaaccatttcatacctcgtccactttcttcaacctgcagtacttggaaaagtccacacatttctatatcttccctttccccaacatttgtacctcacttctctgtctttacacttcttgctacaaaataaccatccagtgctccagtcaaagggttacctcatcttttagttactcagatccatttgcaatcgtcttttattcctcttttgctctcaagccatatcgaatacattagctaatcctgtccacattatcttcaaaaatatatccagaacctacccatttcatattgcctccactgctacccctttctttgagctcttcttcagtagctgccttaaaatgtctcttccatacattatggcatggtatcctaactgacatcttgtttccctacttgctctccttagtctgttgacaacccagcagccagaatgatcctggagagatgaaagccagagcacttcactcctccactcagaacccggtttcatttagtcaacatgcacgtcctttgagagtctcacccatctcccccatcctgtcccatcatgccctgtcacctctgtcctagtcactcactttttctttctgcttcctgtttctctaacatactaatcaccgaatcagtgatttgcttaaatccccccaagagctccccatttctcccagactaaaagccagattccttttgtggcctacaaggacctacgggatgtggctccttgcttgttctcaccctgcccttactaactctgcctgccagggcatgccagtctaagaatgctcccttatgcctcaccattgctgtttttctgtcactattttattttcttcagatcattattattgacatcgtcttgtacttgatttgtttgctcatttattagctgttttcttccccaacttcttaagttctgtgacatcagggatctttgtacttcatggtattattgccaatgtctttaacagtgtctagcaggcaaacagccaagtgctcagtaggtataggtacttttgttgaatgactatatggcatccaaggtgaaatggaatatttctgagagaaatatgttaggaacattgaccacagaagtagaaagccttaattgacaaataaccacaaagatattgatttgatagccaaagattatacctattcaaagccataccccactttactgatatctctgtacctagcttattttttaaaaagacattacaaggactagaacaaataatttcatgcccatacaccaggcaagtactgggcaaatactgtatgatgctgcttaagattacaccaccattgagtacttggacagtattcttatcccattcaaaaccccttaaaatttttctgactggtacattgaacttttctaaataaatagcatatcctcaggtttcagtactagtcatgagtcagtagggaatggttggtaaatctgaatctgtaatagtaaatggaaaaaaatcagttcatgtagtttgttaaaatataggtgtgttgggttggattaatactaattactgttaccaagctggtagtgggaagactggtaatgggaagtaacgttgtgttcaatttaaaatcatccttctgataggaatgggaaaatgtacagtgatttgggattctgcaagaacaaactatgctataaacaactggtatctgtaggggaagggaattcttcagggagttttccctgagtttggccataggtaggtgcctggaggacttttcagagcagtccaacggtcttcagtgtttattgttaggtgtcatcactggacactttgtgtgtgttagaagtgtaagctgttctctctgacagaggagcaggtgaatgtatgtttaaaaacatttaaaaacaattgattattaataacaatcaattgaacattgattgttacggattcaaatagttttgattctagaaaggactatggaggtcttagaaaattaaactcttcctttacaggatggaaagtatcatctaggaagaaagctagaaaggaaagctttaagaaaaagcataaaagccatgttaaagaggagaacctaagctaacagagcacgaggaagaaaaaattttgaattcaaaatcctgagagatagtgattgaggtagtgatttcccataggtagaatgttggctcctaaagatgcctacatcctaatccccagaacctgtgcagatgtccccttacgtggccagagggacttgtaggcgtgatgaaggctacagaccttaaggtggggagatcatgagtccttcactgcagcaggccttttcttaaccgtggtcagtgggaggtgaatatgaaagaaggatcagatgcaacgttgagggaagaagacgaccatgagccaaggagtgcagtgccctgtagaagctggaaaagacaagctaagagcctccagaaaacagcacatccctgctgacgtctttattttaggccagtgagacccatttcatacttgtgatctacaaaactaaaagataatgcacttgttgtgttttaagctcccaagtttgtggtgatttattacagaggtaatagggaactaatacagtgactgtggaccaccaagataaaaaagtacattctttgtcttggaagacttttagaaggactcctagtttatgactggaccaagaggaggaaacgtactaggtgttggagaacaggatttgaatttctggatctttctttttgataacccaatgatgaaagcctccaagaagaatggtaggaatcccttggttttctaaagctgaagagtatctgaaagagaaacacaatgagaaaaagaaacactatactatagaagaatcagtaatgatgattatatttggtaattcttaggaagcagtaaggagataaacagtgtcaacaatgtgtgttgcttcagatatctcttctagtaataaatctgaaaattaagtgtgagactatagctaaaaatataaaatatccctttttgtcccctcctccccacaaaccacttaatactcatttgcacatgttcattgtcatgtctttctcctgtgagactctttaagacttctgagggtcagaattgcatcttaaccgttattgtgtcactagcatcatgcatgtagtaggcacttcagatgttcatgaataaatgaatgaacagtttatgaaagaatgaacatggaggaaagagtcacatgacctatttcgaacagtggtgaaggtcatttgtttgaaagtactgtctaaaaggtaagtggctaaatggaaccaagcaaaataataaaaactttcagaaatgaacaaaagtatagcctcatctcactagtgagtaatcagggaaattaaaccatcataacaacagtaaaatacctgtggaagtttttttggtcattaaattgatcatcataagattaattttattcattaatgtgagataaatgatactctgtaacattatgcatcaagtataattggtatagttttgttgatggccaggaagtttggttgtgcttatcaaaatgtttcagttaaaggaaattttgtctgtttctatgcagtggtcataaatacctttgatgacagctagaaggatgttcatagcagtatttttatttacaccttcctttctccctcagaacaaggaaatctttattcatcagtagtaaaatgaccttgcacatttaatgttatgttcctgataagatacaggcatgatgtgaacactggcttttattttaaccttgaaaagaattcttttaccatgaatgtctactatgagaatttaatcagaaaagttgtgtatttctgacacttgggttatgagagacaggtttcagagtagccaattattgttttgtatttcataggaccagatagatgtgtcttcaaagtcacgatgagaaatttaaatttaattctggtacctttagtggcatattaaaaacccatgtcctattatccttttagagacagtcatttttattctaaatgtacgtgtgtgtgatatgaaaatggggcacttccatatggcagcactgtagggttggttgagtttacattcctcactaaatacgtagttctcagaattatttgttgagttatccagaccagatatttagttctcaaaattacttaagttactgagtatatgcatttagcaccacatatttaagcactttgtatatttataatgtttgccactatccagagaaatttataagggtgctagagaatgagcagtaggacagagtacgatatggatgcgtaatgagaaagcaaaaaatgaaacagaaggtaatatctgtgtgtttattgcttttcactgtttcatggagagtgaaagttgaaagctggtttgctcatgaggtactactgtatgcaaaggctgtgtcactcagatccacactttgaagtcactctgagtctcttcaggcagcatgatcaagtgaatggaataagattctctctcttacgtgaaactccaagacagaaacctgcctttccctaacagataccacagttctgggctaagcctctttgagactggtttgctgcaggtctcctatatgtgtgctgtgagttcagcagagatgaagtgactttttcatggggtcactacagaaggcaactggagaagctgggctttttcttaggatgtgaatggtgacaattatgagaaatgatttgtgttccttactgccttatattcaacatcaggttatggaaggttagtagaccaagtgacctgaggcagatggctagagaccactgtagacactgatcgcagctctaacaagagagagccgcctcttgaattggtagtagcagtgagctgtggagcaaggagacttactgacctgtggtttaccaaggataactggtgttggtgcgtactgggtgttgatctggcagagctggacagggaaccaggagcttttgtgggaatttcacagaggtgctagcttccatcctttatagttcatggatttgtgtgttggcaagaagctgcagaagtcacttctgagagaattgttaaaaggtgctccttcctttaggcaagttccccaccccagagcacaaggtttaaagactagaacgtggactcttttcaccctcagctggatatccttgtgtaggtagggtactgtcatttacagtggccctgtcaggaattctgggcttggatcaaaaagccaggaaggacattttatgcctctgtcagttccacataggagtctgtaggctgcaaacatccttcctgtcctgatgagaattcatcatctttatgaacctgtctttgactcttccagcctggtcctctgttgatgctttctctcttgataccatgtttactcctttcctttgtccctctctctgccacttcctgtgcttggtaaacaactttgtacctgggattgagttgtctgaaagagagattgactctaccacttcattcactcagtgccctgggaggtctgccacatgccaggtaccagtatggggagcacagcacagcagcacacatcctcagtgtgcatatactgggttttggacagtttttgtatatggtacatgttacgatttatctttgcttatggagaaggctggggataatatcctttatcatgatcagcagcattgtgctgtaataaagcaatacttgatgagtgcaggaacttttttgtatgtcttaacaagttgtattatagcttcaattaattgctaattttaaaaagcagtgattattttctttcatagacatttttcattttaatatcagcatcatttaaaaaaaaacttgtcttatcacctaaaagattgagaaggtcacagttggttgtaatttgcataccctcgtgtaaaggacagcaaatggttctgtcatgttcccaaatgagtcttccatacatgctgcccacttaacaacatattctctcatggccctcatacctaggtaggtacagggcaagagtcagttctaacacttaacctgtccattgctccaggagaaatttcaccatctctagggaacattccctgatgacctcattcaaaggtgaccttctctgaactcaagggaacacatgttagaggcattagatttgggagtatttaagattgcttcataataatttttaaagagcaagtaataataaactgattaggcccgaattcaaagaacttttcatgtatttccagtgtcaccagaaacgtagccttaactgtgtgttcctgaatgtatgtttttttaaaaaaatgattatgaatgttgcagcctggtcttgaacagtatgatctccctgtttttgaaagtataacccctccttgggtctggaccttagaaagtagtaactgaaagatagctggtgtgctttgacaggttggggggtgatgacagtggaattgcagaaatgtgtttttaagtttacatgccttgttaataaagaaaggagagaatctctttatgttttcttttctaaaacttctccttgttcttgaaaatactatttcagaaacaaagattcctaagtaatttatttaacttgatattctcataccaaagatttctgataattgactaaaagaaatgaacattgcattactttttagcatatagttttttttttgttttgtttttgttttgttttggtttttttttttttttttttttttttcagtttataacagtcattcttgtggggggtatgttttagggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaagtaagatacaaacctgctttggtgtgatgcacacttgatttcttttgctttttaaaaacatgcacaagataacaaatgtatatgtttaattttcacactgcttgtcattacaactctggtataaataaaattcgttagtaattattaacgaatgatctcttctagacctctagtctagcttttgggtattattaattatactttgagccatctgatttccgttttctgtgatggtcttttgctagctaatttctcatcagtgctactttgtttcaacctttgctcccaataaaactcaaatcatatatatatgtgtgtgtgtatgtatatatatataatgttttcatcccttgtcatccttttatgtagcaggagttgctgtcactcctaaataccttattaatgggctacatagcttgttttattatgccctgtaatctagagcgcacctacaaagagtgagtgtatatttgatattcacatgcaacgttaaaattaggacgtaatctcttaatgactcctgttgaaatgttaaggaaaataaaattatttcagggcaaattaaaagaattccctataattgttctttttctggtctcccctactaattttttttttttttttttactactaagcaactcaagatgttactaggaaattgtacatctaaaatacatttgtgagaggtataacttgtaaaaatgggcttctttcactagggttctaatttttataggcaatgctacagaaataaagataattgtaggctgaagagtgcattcaaagggtcagtaactttgaaggatctagattgattagggtagacattttaaaagacaaacatgttaaggtgaataattttttttttttcttttttgagacagagtctcgccctgtcacccaggctgcagtacggtggcatgaacatggctcactgcagcctcttgggctcaagcgattctcccacttcagcttcttgagtagctgggactgtaggcacagaccgccacgcccagctaatttttgtattgtttacagagctggggtttcagcatgttgcccagacagatctcaaactcctgggctcaaacagtctgcccaccttggcctcccaaagtgttgggattacaggtgtgagccaccatgcccagcctgaataaatcttatgttgaataaaaccctacgccagttacagagttcatcaaagaaatatagctgtattttcaaatttgtcaggtagctggtaccaagctaacaaaatactccttgagaatatagtttcattggttcacatcaatggctagagaagatttgacttccaactatttagtcaattaagcaagtgagcattccaaaacaaaggatatgtaaaagttagataaaaatacctgcagggtttttgtgttgttttgttttttgagatggtcatcttgctgtgttgcttgggctggtcttgaactcccctactcaggtgatcctcctgtgtcaaggtacttttatttaacacaagtctattatcttggtttatatggacatgtcagatgcagactttgttataatgaaatccttagtgctcaataaaatggtcattgaatctaaatctcttagtagattgttgttgttcttttaagccaatttatttactttgtttcaagtaaaattgaataggcactgctttactgactgggtcttgaatcctcaaaaggaagaaaaatttaggtggggttatatagaatttctcacagattgaccctactagatgaaagggtgatcgggatactactgctcataataatactaatgatgatgatgatgatgacattgatgccttgtcgtcataagtggctgagccagggactctgccatctgtatgctgcttacaccagataacttaaatatacatttcatttaactgtccccaaaccctaggagttagagactatcgttcttattttacacatgaaaacaaaattgataaacttgtagttacatagtttgtgacacagctttgattcgaacttagctgtctggcttcatagtacaggttttaaaaattagattgcctatctcaatatgggaataatgttgtcttaaatactctgaaaatgtagctaggcttttaagattagtgaaagttggctaggtgtggtggcccacatctgcaatcccagcactttgagaggctgaggcaggcaaatcacttgagttcaggagttcgagaccaggctggccaacatgagtgaaaccctgtctctactaaaaatacaaaaattagccaggcgtggtggcgggtgcctgtactcccagctacattggaggctgaggcaggagaattgcttgaacctgggaggcggaggttgcagtgagccgagatcatgccattgcactgcagcctgggtgacagagtaagactctgtctcaaaaaaaaaaaaaaaaaaaaaaaaaggattagtgaaagttacatgcatagtaggtagagatgatgacagaagaaaatgtgacagataaactgatgaggtattttcaagagttatgagggttaatactgatggttctgtatatttaaaaggggaggaatttaagtgtcagtaaggaaaaggagactatcaaaaataaccaagagaatttggatagtccaaatagaagttgtagaaatcacaggattgataaaatagcagattagacatagctgaaaaattagtaaacaagagaaaaaattttccagaacataccacggagagatgaaaagatggaaaatgtgaatgcaagtctatgtaacatgaagaatgatgtcaacccatttctaacagaaactcaagaagaatagaataaaaaagaatggagaagaggaggagataatcccaagagataatggttgagaatattttataatcaatgaatgacatgagccttcaaatacaggattaacaaaatcccaaatagagtcaataaaactaaactgatgcattggcagattgtattaatagtaaaatattgttgtaccagagaacaagacaggatgacacccagagaaaaattcagacttttcaacaacaataatagatgccaagaaaatagtgggataatatgttcaaagtagtgaggaaagtagctggcaacctgtttttgtttgcccagttaaattgccattcaagaacagggtgagataaagacattttccttagaggatttgccaccaaaggaacctcttacaaaaacaccttaggaaaaacgaaaatcatctctgaaggggagggtctcggatgcaagatggaaaaaattgggtagatctaaatatgcattggccccatgaaacaagatagtaactgatttttaatttgaagaacgcacacataaaacataagcagaaagggaacaaagtatatcagacaaatagtaaccaaggggaaaaggattataccctgttaatatcgtatgaaaaaaattttaaacatcttttaaagcatcattagggatatagaaggcaattacaatacaagctattatcaccaagaatttaataaatattccttacttagctttctggataccaaactgctttggttttccttcattgaccattcatagcctttctgaactgtttggcctttaaatgttagggtgctccagtaacctgttttcttctctttctagtctccctacacctgccttgggcattaaatcatacatttgattggatggaggcagggaaactgagaaacaaattagtggaataacccaggcaaaaatcctaaaagatggtgcagtaggggaataataatagaagttgtgagaaacagttgtacaggattgtatttttaaggagggagctgatgggatttgctgatgtatctcttagaatgtaagccatccaattatatttataaatcatttgggctcagaaacttccagtagcttctcatcacactcagagcaaactctggagtttctgatgacctcacagtccttatctccttctgctcttcctcttcctcctccactctggtgacatcagtccttttgatttcagttttccttccattaaattctttaatatattttagagttctttccataaatactcaagttgggatctgatgtgatggtttcttctctattgccagactttttaattgttgaataatatggcccttcatcttaattaacgctttctttgtctcacctcccttttttcctttatcgtttacaacttttcactttctcaactctagctccctggctttcttattggggcctttgaacttggtgtgactctgctgagtatgttctgccttttctaggcatggcttggacctcctcattccaggaatgtgcttgaatgttactgctttcctgtggtctcctactggctacctaaagagcccactgcctacctgaagctccttgtgatttttcatcagctcatatactctgttaattttttacagacctctgaagactgatattatatatgtgttgtttatctttctcagggactttgttttcttcactcctctattcctggttctagtcatgcctggtatacaataggcacccaataagcaatatttgaatgaaaactgactaaataatatattgataatgcatgtgtaaaagaagcccagaagcaaagtaatttgatggtttagaaacttgttttcagctaggaaccaaacaatattagcttaagttaataacagtattaccatattaacacatgttgtttactgtgtgtcagacatttgatgtagttcatcaaaattaatttctattatgatagtcttatcatgtaggtactctctttttgccattttgcttgtgagaaagccatactttggaaaggcttaataacttttcctggagatcatatggcttaaatgggtggtatactagaaattgaatccaaacactcagctgtttcttctctactcctgtattagatatgtaaatacaagaagctgaacatgacaaatttttttctgtcacctgcagacatctaagttcataggtgggtatgtgagggcagctgcagttctggctttaattctgagaagtaagatctctagtcaaatgaaagtgctaggactcagcaatataattgggtataaattttgatttccatgacgtttttggacatagcttgttcttttgtgctatctgctatagagtctattcatactgttgaataaacctgaaatacagacttgttcacttggtcttcactcttcaaacagcttggtaagctagcttgcagcacacgtatttggtcataactgtctcaggcaggatgaccttagagagctctttgtcatgacatgtcactgggagaaaggaagagctggattgataaatggctatccatgtaggaagaagagcaacaacaacattggatactacctcaatacacaaatctatgagatgtacaagtagtgaaacatcacatgcaaaactgtaaaaaaataagtttagtgggaagtatagttgaatgtatctctggccctgggataggaagattttcttaagagctccaaaacgttcactataaaaagaaaggctggcaaattctactgtactaagattaggacattccgcaaaagatatattttgaaagtacaagaacaagttgcaaagtgggagaagatatttgtaacacatgcagtcaacaaagggtggtggtaagagttctgatcaatataaaaattgctgactgggcactgtggctcatgcctgtaatcccagcacttttggaggccaaggtgggcgaatcacctgaggtcaagagttcgagaccagcctgactaacgtggtgaaacccccgcctctactaaaaatacaaaaattaccaggcgtcatggcggacgtctgtaatcccagctactggggaagctgaagcaggagaatcgcttgaacctgggaggtagaggttgcagtgagccgagatcgtgccactccactccagcctaggcgacagagcgagactccgtctcaaaaacagaaaaaaaaaaaattgcagacacttcagtaatagatacacaagagacatgaagatgttatcataaaagagaaaataagtttggccaattaacatagaaggcactgtcaacttcattattgatcagggaaatgcaaatcgataccttagtgaaactctacctccagttggcaaaaagtcagctgtctgacactctctgtagctggagaggctgtggacctgacagtcttttacctgcactgctagggagaatgttttaataaattggtgaaaccacctgggaaaccagcttggcattctcttgaatgtcaagtgattacatgccctaccatcctgcagttccctttcaagttctctctttcagagactctagctctagtttctatactaggctataactgcaataatgttcatggcataagcagtgacaagtcacttggggattattcacacagtagaatgtcacacaagttgaaatgaatgaactacaggtacaagtaacaatatgaatgaaacttagctgtataacatcatgtgacaaagtaagtcctagcacaactttgtgagtacgctaaatactactgaatttcacaccttaaaatggttaatattttatgttaattttacctcaattaaaaaagtcctggaatatgacatacagcatgacactttttataaagtaaaaagtgaaaaaacctaacgagattgttgggaacacatgttaagaccatatggaacatgtaaataagggaatggtaaattccttcagaagtcactggaaggcccagagccgtggcaggggtagccaccagctcttcccaatccccacaggctccaggggaacttctgttgaccattagggtctgaggctgagtttgaaaatcactcctgaagtgtgcatgtgcaccccagcctgtccccagcgcttccccagtcagtccaggggcaggtgggagcttacctgtttctaggatgctgggagagcccagttaagtaggtagtatttgttaggagcttgagtcaggcaaaaatgtttaatcaattttgtatttattcacttatggtcaacatattgattgtataatgtaggctataaagtatacataaaagtagaaaatttaaaagcatgcagcgggccaggcgtggtggctcacacctgtaatcccagcactttgggaggctgaggcaggtggatcacttgagactgtgagttcaagaccagcctggccaacatggtgaaaccccgtcgctaccaaaagtacaaaaattagccaggcatggtggtgcacacgtgtaatcccagctacttgaggggctgaggctggagaatcgcttgaacctgggaggtggaggttgcagtgagctgagatagtgtcactgagtagctgggactacatccttacgccacaacacctggctaattttttgtattttagtagagacagggtttcaccatgttggccaggatggtcttgatctcctgacctcatgatctgcccaccttggcctcccaaagtgctgggattataggtgtgagccactgtgcctggcctagtatggtttatttttttaaagaaaatcttggttaaatagttgttttgagacaaggtcttgccttgttaaacaggctggagtgcagtggtatgatcatagctcgctgtagccttaaactcctgggttcaagtagtcctcctttcttagcctcccagttacctaggactagaggtgtttgccatcacactcaactaatttttaaaataatttgtttgtacagacaaggtctcattgtgtactgggatcataggcgcatgccatcacggttggctgattttattttattttagtagagacaaggtcttgatatgttacccaggctgatctcaagctcctgggctgaagcagtcctcctgcctttgtctcctaaagtactgagattacaggcatgagccaccatgccccacttctgattcaaaggtcttatttcaggttttattttgttattgcttttaatggttgtcatagctaaaagtattcttgacaaagatatgcataattaaatagaaggggtaccagtatctttgtgtgcttaatgatgatactgatttttcattgccagtcaccaattatgtaaacatttgttgaaatttggtcaataaatttccatattccatgatcattcctttcagtataattgattttgaaatatattttcatattttaacatcagatttttttatttagtggagaaattttgaaatgttagaaaattttgttttcagattttttatgagcagtgcatccactcctttttggtgacaaagttataaattgatggaaatagtttagacttcaaaatggtctgtccataacatgacagcatgcttttctttgttgtttttaattttaatcaggattaacattttggccaaataattctttgttgtagggagcttttgtatatgttgtatggcttctacccactaaatgataggagcccaccaccccaccctcttcagttgtaacaggcaaaaatgtgtccagttactgccagttgtcccctaggggaaacaggaagggggcagaatctcccaaggttcagaactactgctctaaaatataaccaaaagttgttaaaaatctccaaaaattattcttaatttcataaactatcccattagtattcaaattttaacttgtttattaaatatcatgacaaaatttttaaagataaattatttgaattaggatccaaattaggtgtgccctttgtcttttaagtctttgtaatctataacatctttatatccagtttctcccctttgcttgcagtttgttaaggaagctgtgttgcttgtcctacaggtttcccctcatctggattttgtccgtgacatctgtgtccattgtctttgatgccttctgatgtcttctctgcaaagcctttgtgtcatctttactaagttaattcttactctataatatattgctattatgtgggttatattttattatttctgtttaccacttatttctaaattgagcacttagctcacttgttttcattcattcatgtttactgataaatgtattttactataaatggtcattttagttgtgtctatgtctcacaactttgttagatagtgttttattatcaatcagtgttttgatatttgtttcaagatttttggaagaaaccaaggggtgattaagtgtattgtttaggtttctgccatatgtgcttataaaagaaaagattattggttattgattttattttgttgcattataggaagcataacaattttatggtgttgactttttttaactatgttgagatgattctttgtgccttagtacttagttgatgttttcattccttttgaaaagaaggtatgttctgttattataaagagggcgggtgtgtttgtgtacattttttcaagcttatcgtcatgttatttgaagattatattgttcatactttgcttgaaaagtgacatttaatgtatttaattgtatatattatacacatatatgttttgctacatgctcatctcaaagaaagtattcaactgtaattgtcgatttactttttttttttagtaattctgtcttgtgattctttatgattttaaggctatgttgttaagtacatataagttcatgattataatatcttcatctattctttctgttaccagtacctagtgcccctctttctttgtttatgtgtttcctatcagcaacatatttattgtctttgtgtatgaattgatgaattgtagcccattaaattagaggtgtgcccattcccaatttcattctctattctttgcttccggaggtaactgatatcctgacttttgtcataatcatttttttgcttaaaaaaaaaaggttttactacttatgtattgtccaagtctgacatcgtgatcattcattatctgaatcagaaaaaagtggctttatgatgctgttaagggaaagctgtgctgatcagtcacagtctccctgagcagaacacactactgattctatacaaggtttttggaagtatgaagttgagaagctggccaactttcagaggtggaaatgggttggcatcaattttagatgtatggttacccaagttagactgttcatctttagaagcatgttctttagagttagttcctgtttggctaaattaaagaagaagctgccagtcagttagttgacttgcagatgcgtgttcattgaggcaagatatcaggcgctttaaaattagtttcaagtgggtctgtggctgtacaactcatatttattgaccaagctgatttaaaactggttttgtgtgtgtatgggttgggggggcgggggcgggtgtttgtcaccacagctacaaaagggtcagtcttgtatatgtgggaatttaaaaattctcaatataatatcaaaagttgcaaaatagtacacagaaatcctgtgtacccttcagccagtttccctaaatattaaaatcttaaataatatagctagtaaaaccaggagattaacattgatacagtcctagtaacaaatctatatgacttattcacatttcccaattattccacttaccgttccttttctggttgaggatcaattcagaataccacattacggtcatgtctccttaagtcttctctaatctgagacagttccttaatctgtgtcattatgacctttacatttttgaagaatactcactggttatttgtattgtgttcttcaatttgagtttggtattgtttttatgattaaggttttgcgtttttggcaaaacggctgcagtcaagatgtcatacctttctcattgcattgtatcaggaagtccataatgatggcacaacttaatttacaggtggttctaacttggatcatttggttaaggtaatggaagccaggtttctccactacaaggttactgtttcccctttataattaagaaatatcttctgggaagatacatagatactgcaacattctgtttctcactttcacccactgatcttagcattcattgatgattctgtcttgcagtgattattactgtaatttttgctaaatgataaatttctatttccattcttcccttttttaaaaaaattggaagtctattgtaagaacagactgttcacaccacattttttttatgagggcatctgtgttgtgtgaagttaatgctttgtttacttcactaaacacggactagctagctaacccttctcagtatcaggactatcatattcttaatctagctcagcttttcaaaaacataccctctccctccttatcctcagttggttacttttgggtgtcttagtgctcatatttggtggtaagactgaggaagctggatgacaatggcatgaataggaatatattgcctaagagtaggaacgaaagaatgattttatttggggcatagtatttagctgctgttgggaatccatggagaggcgtatagcagggaagtggaaatatgtatcaggatgcaactagactcttaaaatggcaaacagacatgtaaagaaactgacgagtttcgtgtaagagcagagtggggatgtcagctctagtggggcacgagaacatggtgtcaggcattgcagtttaaggactgaggaaagtttcagtagagttttgtgtgaaatatgctagactgtagtgtgttgaagcagggaacaaagttctttttaactttcgttttaggttcaagggtacatgggcagatttgttacataggtaaactacgtgtcacaggggtttggtttacagattatttcatcaaccaggtatttttctgatcctctccctcctcccatccaccactcttgttagtccccagtgtcttaattcctgctttatgtggatgtgttctcattgtttagctcccaccaaaattcttaacatgatctaaaggccttgtctaacttcacataagcaggcttgagttaagttcttttctgtttttaagacataggtgccttttcttcgtatcattgtgcctttaaatattcatgcatgttcttgctggagaggaatcccatgcctacctctaaatagctgtgggatctagggaagattatgtaattccctaaaattctcttgccaatctgtgaacataaggtgaatattaacctggctattatttctcacccagaatcttgctgtctcctcctagtctccctccttcttcctttggtccccattgtctcttctgcatggtgtataccctaatcatgaaaaatgaaaaccctgtgatgtcatttctctgtgcacagcatgccattgacttgctttctcattgagaaagaacccgactatcatgacttggtaagggtctgtgtgaagcttcatttctactcactgccctcatgcagcctgccccagctacacttgccttcccaagcatcctccagctgcagggccttttcatagtctgttccacctgactagaacactttttctctgcatataactgtataactcccttcctcatctcctttatttagatctttgttcagatatcatcatatcagagtgtccatcattgactaccctttataaaaataatacttaatcatttgttattcccctttgatttgtttttatgacattgactgccatctcacatatatttgtgtatttgctgtctgacttctgccacaaaaatgcaaactttttgggagttagcactttgcctgttattcactgttgaatttccaaccactccaactgtacctgagacatgatctgtgctggaataaacagttatcgagttatcactaacaataaaccttagaaaccatttattatgatatgccagtgactgttctgggtgttttgtgtttactgactcatttatttcttgtaacatccttataaggaaattgaggcacagagaagtgatagctgacagtgaataagtggcatggcccaaattcaggcataggtgatctttatctagagcccatgttccttatgcttctctaaaaagaaatcatctgtgtaaaatgctcgtcacaattcctgtcatacactaaatggacagaaaatgttagttgatgatcaccagcagcatcagaatgctggatgttaagagaatggatgtggagccaggctgcccattgtttcatgttgaacctttttccttatctttaatatgggagcttcccccaaccaaaaaaataaataaataaaatgggagtcccattaataccaaaagcctccttggacctgtttgaatcgttgactggaactgataactttttgctgagcatttttttttagtctgcagaatgcgaataattatacctttctcctctgattattaaattgattaagagaaatagtgcccaggccagatgtggtggctcacacgcctgtaatctcagcacttcgggaggccaaggcaggcggatttgttgaactgactcaggagttcgagaccagactgggcaacatggcaaaaccccagccctactaaaaatacaaaagttagccagccatggtggcaggtgtctgtagccccagctacttgagaggctgaggtgggaggatcgcttgagcccggggaggcggaggttgcagtgagccgagattgtgccactgcactgcagcctgggcaacaaagccagaccctgtctcaaaaaaagagagagaaatagttcacataaagtagttacgtgcctggtaaatcctaagttgaaaataaatgaaatctgttatacttacataataacccaatgtagaatatctacagtaagttattgaactctgtctgagagtaaaagtgaaatgaaaccgaattgtttggcaattttgtattttaataagatggacatttataagtcttagcagaacttgcgtatgtgtaccaaactttgcttcctcaaaagattgcattgaaattttattgagtggttaaaaaaaaataccattaagccacagaatggaagaggatattcactatgtctaacaaaggcctcaaatctagaatatataaagaacacctacaaatcaataggtggtgaaggagaaaagctagaccatttagtcggaaaacaaggacaaaaacttgaacatggccaggggtggaggctcacgcctataatcccagcactttgggaggccaaggtggaaggatcccttgagaccaggagttcaagaccagcctgggcagcatagtgagaccctctctctacaaaaaataaaaaactcaacaagcacttcacaaaagaggatagtcaaaatgaccaaaaagcatgtgaaagtattcactttcattacttaccaaagaaatgccaattaaaatcaccatgcactatcacagtatgccaatcagagtgagtaaaacaaaaaagttagaaaatgccaagtggaggcaaagatatagaggaactggaacacccccatgctgttggtgggagtttgacttgttacaacctctttggcatgctgtttgataatatctactaaagctaatggatgtatttgttatccagtgctcctaggtatatatgcaaccgaaatgtgtacatacgtttaccagaagacatttataaaagtgttcatatgggtagagccacacatacacataaagagagaatgagaaagataaagagcattctggtgatgttggtttgttttatccattcttaaagcttagctttctgaacaagtaagagtacatactgtgcagttccactgataaaaatttagacgtgggaagtcgtggaagatgttagaagtcagggcagttcttcccctgagcagtggtggagaatgacccatgggttggaaggacttctgggcctcttactatgctctgtttccttgaatcactgagctgtagcacatttatgatatgtgctctttttttgtgctaaaatgtttaaaaattacatttaaagattaattgatgatagcttttatttgaaatcatctttcagagtaattaggaatgctatactcacaatattataattgtagactgtaaattgagaaaatgactgatttctaattgttctgttttgtgaattatttttagatatgaattgagaattcgttatttgccaaaaggatttctaaaccagtttactgaagataagccaactttgaatttcttctatcaacaggtattagagactgctttcatatacttttttgtttgtttctttgaatcctatttattgcatatttttattttcaaatttgattaaagctcacgtttggaggaatagaaatttgttgctgaatggcaataagaatcttttaaccaataagaaattattaatttttttgttctttgtgagcttttgtatacttgagcaaatcttaaaagataacttctattatatggagacagtaggtctacaatcatttcttgagctttaatttaaatacaattattatgcctgaatagcaatgaatttgtcataggtagagattgttgcagagccaactatacccatataaaattgatctgctttgctttttaccccgtaaggcattagatagacaataaatacatgtaaggtaaaatgccaaaaatgctaataaacatcagaaagacatttgtacatataattttgtcattaaatgtacttggtaattttttttgctttaataaaaatatttattaactaactattctggaccgggaatgcagaaataaatcgcataatccacacctttaaattcttctgtctagtggaggattcctgtcatcagttgctttgtgtttgagcctttgctgttagtaagcacaaatgacgtgactgtgcatagaagagtctgctgacccagtatagatttggtattgagatggctccactgaaaagcatcatttgaggagtcttcaactttgtagaaaaggaagagttgtgttttctagacaagaacacggaggggagagagaaaatgtggtgcagtcttagctaaaatagttcataacattttggtgagagagggaccacaaacattatgtaaacaggggtttaggttttctcctgcagatattgggagccatttaaaaacgttagttagcaaatgccgtaaccagaatttttttttttgagaccactctgattagatggcagtatcagggatagattgaatttttaaaaggttgcaagcatgtttagaggctcttcaatcattctggcaagaaattaaataaaagtgaaagtatattataataagcaaatttagtggatggatttgataggacccagagattgaactaaaacagaatatgaaaataaggaagaaaaaggcttattatgtaagtctaggcacttactgccatgaaagagcaatggtggattagattcaaaagaaggaggtaagaaggtaagttgttctatatttttctatgtgagataatgatagatgttaccatttaaaagattcaagctgagagagtaggaagctaaggaagtttccagctgttggcgggggtgtgtctgttttcatcttgtctgtgaagaagtagtcacataggagataggttggggcctgctgctttacctaacacctttttggcaccagcgactggttttgaggaggacagtttttctacagaccagggccacagggtgtggcagggtggggtgtgggggaatgatttcgggatgaaactgtttgacctcagatcatcaggccttaggttctcataaggaatgcgcaacctagatccctcacacgtgcacctcacaacagggtttgcgctcctatgaaaatcttatgccactgcttatctgacaggaggcagagctcaggcggtaatgctcgcttgcccacagctcacctcctgctgtgtggcctggttcctaataggctactaactggtactgatccatggcccagggtttggggaaccttgaggtaagggattggtgacaagttttgagggtttacgataatacagagttgaatatgaaagggagttaagttggtaaaatggaaagattaagaaggcgtttttagattccagctgagcttattggaagcctactcattgcaaaaataattttcatcttacagactggttctcatgtattattacatctcatcctttaggaatctgttgaacttcatattttggcgaaggagataacaagagagtttaaataactcatgtttatttagcatttttctcttggtatgtgatctgtgtcactacttgtattacttctttgaaaaaaaattctacccaccgaggaaatacatgggtactttagtaacattgatttccagaatgcataatacaggcttaagtgactcctttttataatttctaggctaacctaaaagtctgcaacttttttgttcctagttcacactgttactaggttgtcctactttttctttgttggaagactttcctatatgataaagtgagtactgcacataccaatgtatcccagattttcttttactaataggatatattttatggtagtctatagaattcagttcagcggtctttataaaacccaagagaaagctaaatgtaatgaacctattaaaaattcagtctatccctgatactgccatccagtcagagtggtctaaaaaaaattctgatcaaggcattcactaagtatagttaagtgttaatgaaatttcgcttaaaggaatatgcagtgaatacagtcgtgtgcttgttctgtatataatagctctgtgattttaggtacctctgagtctctttgtgcttaattgtttcatatactaaaatatagatatggaataactattgtataggactgttaagttcattatatgagataaaattgtctgccatataattgcccagtgatattttgaatttcagtctgtagacagtaacagacttagaggattcagcatttgccatttgcatatcaccatacaagtgtgagctgcacattatgggatggtacatagcttgccttttccttcctatgtgcactctgtagagcctttcagctcctccaccccactctttgctgtcattcatttctacagtttctcttcttgtctttttaatttttaaaaatctgttaaattatatggtacattttaatatttttaaaaattttattttatttttatagagacagggtcttgctctgttgcccagtctggagtgtagtggcatgattatacctcactgcagccttgaacttctgggctcaagcaatcgccctgcctcagcctcctgagtagttgggactacaggtgcgtgccatgatgcctcgctaatttttaaaaagtcttttgtagagatgggggtcttgctatgttacccacccaagctggtctcaaattcctgtcctgaagcagtccttccgccctggcctcccaaagtgctgggagtataggcatgagccaccatgcttggcatggcacacttttagaaagttcaaaaaataattctaaaacattacttaaattatctctattctaataatcactttcattttgtgtatccttttgtaatagtttatcaagtacatacattttaaaagaaagtatagtcatggtcacattcctttcccattggtgattggcaatgtcgttgtttttccgtgctagtatttcaggctcaagtaatggtaattggaggaagttaaaggtggtaccaaagtcataaaaagggaagggaggaagaaagaaaatactatgattgtctgggtgcggtggctaacgcctgtgatcccagcactttgggaggccgaggcgggtggatcacctgaggtcaggagttcgagaccagccttggccaacatggcaaaactccgtctctactaaaaataaaaagattagcagagcatggtggtacacacctgtatcccagctactgaggagctggggcaggagaatagcttgaatccaggaggcaaaggttgcagtgagccaagatcatgccactgcactccagcctgggcgacagagcaaggccctgtctcaacaaaaacaaaatactatgatttgtcaaaatgcatgaattggccagtataccaaaagccttgagtatgttcacgtcctccagtttgttgggtgaccctgttgactgccatctttaccgtaagtaaaaaacagttgaaacgttggcagttccctatgattggacctaataattctacttttatgaatttattcaaaagaaataagatttacacatgtatgcatacatgtacaagggtgcttataagcatattacagtaacaagaaagaaattagaggcgttgcagatgtctttcaacaggttagttgtactgagtttcaaatttatgtatccctcattaacagggaggtacaactgttcatggatgtggaaggtattaacagcattaaatgctgttgtttaaaacaggccatgtataaaacctgtataattttcgtttatgtgggaaaaaaatgcatatttttaaattttagcctgatctggcaagaaagttttgaatatactatgagtttttattgctggtttggtaagtaattatatatttgacttctcctggtaaagtctcaatgcagaatctgccctgctacatgcttcgcaattccagaactgttataagtgatccatatattgtcctgcacaggcagcacccaacttgggaaagggtttaattccaaagttgcaaaatcagtttggaatccagaggtttctgctatttaaacacacatgtcgggggtgggcgggagggggggcacagataaatcagtaattgtcctcatcagctttctatagccagcgtatatttatctgagaatgcagctgaaacgttacgtaagtattgtgtgtgagaaccttcactgaagtgtgagataaattagtcactttataatggcctcagaatttgatgatacgcattctctaacctttaaagtctttaatatttgatgcaaacatttaagatggatacatatatacataacatacttccactgaattctaggctaaatcagtgatttttatggggctcagaatttgatgacattgataatttttaattctgtagattctataatatctgatatatgtttattcttttataaggtgtgataattgatgataaaatgaatacccatgaccctactgctcagatgaaaagaacatcctgatacttccctgtcccatgttcctgtggcccacctcactgtacacactgccctttcactccactcagtgtaccattatcctgaattttgtatttatcattcccatgcttgcttttgtttgccagttgtcatgctttacaacatgtttttattcttcagttctacccttaaggtaaaagctgaccttaagttctcccatagacttctctattcctgtcattagcttgagtattttctgttttgttttgtttcccagctcacgtaagcattcaagaagattttaaaaaaataatttgttcagcggttttagttgctttcagctaggtggttggtcaggacattcagtataccttgttggtataaatggaaaagtgatcatccgtggatttaataatttatctcttttggctcattttgaaaataattttgcattgtagtcaagagactgtggctcatttgatactaattgtttaagttccgtatggacttgtttcatcaccttgcacatatttagatattgttaaggttccagttttgcttgagtggaatgtgtcttctgtaattgtttggcacaggctcaataaatagccattatttcaagatttttaattgtgttatttagatccatttttctaatgttctttttttctcctgcttgaaaaatagtattgctgggtacacaaatcagggtaggcattttctgtcagtattttgatggttatttcctactgtctttaattgtttatttgctgttgagaactcagctctcattttttctttctgtgtaggtgacctgtcttttctgtctggatggcttgaagatccttttttctctttggtttttacagcttcattacaaacgagtcgtggattttctttttttctttctttctttctttttttttttctgcccttgcttgatctgtgtcatgctacatgtacctctagggggtcatgtcgttttcatcatttctggaaatctcttagttgttgtctattctgatatgaccttttcttagttttttgttatttcttctgggattttgggttagatctatgttagaactcctcagtctctccatatgtgttagcttgtttttcatgtttttaatttcttgtctttctaaaggatacataattcaggtcagtctagtctggcagattaccagctctcctcaaccgtgaccagttttatgtttggtgcatttgttgatttttttgcttatgatttaaaaaaagttttttaaattgccaggccactttgtatggcccttattatttgctaatctatctgccttttattaatatttcttttaccatttcatatgtaatgaatgtctctattctgaatgtgaattatagcatctgaagtccttgggctcttcacgtttgttgttggtggctttcacagtgacttttttccttgtgtgtgagttctgaactcttgttttgttgaacttcacatgtggaaatcttgagggcctacctagtttggggattctttcctctaaaggtttgtatttgtttgcttggaaacaagttactaccaaatggagaccctttgagtagattttgaagacaccgccttactacatgaatctcaagataagctctctcacttggcggaagtaaggagaagtggtcagtcctcagccagctgagagcatacatgtcctctgttcctgtatcttacagcccatggcttctactaggatcttagcttgtatttgttcttatttcgtccctctgccccattttcctttaccttcttgtgaccccagtaatgtaagaataattgttataatgcatccagaatctggtcctggtttatatagcaggtccctttagcaatactgttggaatcctaagtcattgaattgttatgatgcttaattgcctttccacacttggatttgatacaaaggccccttgtagaagggagcttggagattcgaggagctgataaaaagccagtgtgactggagggcagggtgagagatgagacagtaagggatggcttgagatgcccttttcagtcatctgaccttgattgtgaagacactgagaagccagagaaagttaagtgcaaagggatgacagagttcagatccaggttgcaaaaaatgtcattctcactgttctgctaatagtatataagaaggtaaaggccactatgtggagacttaaactggcgtcaacaagcttcatggctgagtgtgatcactctgatcaatggcttaactttaactgtggggaaattatttctctgtgcctcaaaattttattttttctacgacattgtattatgaaacttcagatgtactgcagtgttgaaagaattttataatgaacaccagcatacccaccacttagattctaccattaacgtttgttatgcttcctttatcacataactgtttttatctctccatccctttagccattaatccatcttaaattttcatacatttcaaagtaagtttcaagtgtcagcacacttcaacataagtatcgttaacctagaattcagtattcaattatggtttttgttttgatttatacacagttaaatatataaatattaagtatacatttattgagttttcacagatacatacaccagaataatctgaatgcctctggaatgtagaatatgaccatcaccccaggaagtttcccactgacccttcccagtcaatccttgcccccagtcattgccccaagcaaccattgctcctgtgtttttcccaccgtagtttagttttgcatgttttagaatttcttataaacagattatgtagtgcgtatttttatgtgaagtttcttttctcatgtttttgagatttcagtagttttcttgttgagtagtattctgttatataaatatatcgtagtgtatttatccatttttctgttgatgaacatctggactgttttgttttgttttgttttgttttgttttgttttttactattattgagatgactgggaacattctttggcaagcatttttgtgaacatgggctgggactttcatgttaaatgaaatttgtatctaccctttgatcctttacagttgtgtgattttatatttcctccagtaatgtatgagagttctggttgctctgcattctatccaacatttgatgttgtcattgttttgttttagccttttgactaggtgggtatgtggttgaatcgtggtggtttttatgttcacttctctgggtaccaactaataatcattgtttatgttgtttattcttccatgtgcatattgaatgttagtaggtctccttttttgaaaatctgcttaaacctttttgtacaatatgtattgtaaaatcgtacgctttttcttcccaattttttttaaattgtggtagaacacacacttaccatcataaaatttaccatcttaaccatttttaagtgtgcagttcagcagtgctacatacattcataatattgcacaaccatccccaccatccttctctgtaactcttttcattttataaaactgaaagtctatagacaatatttccccatttgtcctccttgcagcccctggcaaccaccattctactttctgtctctatgattttaaaatgtaggacttttcatgtaccttgtatactagtcctttgtcatgttatgttttgctagtattttctctgagtctgtggcttgtctgttcattttcttaactgatcttaggttttctttttttgttttttttgagacagagtcttgctctgttgtccaggctggagtgtggtggcgtgatcttggctcactgcaacctccgcctcctgggttcaggcgattctcctgcctcagcctcctgagtagctgggactacagtcgcccgccaccatacctggctaattttttgtatttttagtagagatggggtttcagcatgttggccaggatggtctcaatctcctgacctcgtgatccacccgcctcggcctcccaaagtgctgggattactgacgtgagccaccacacgtggcgacccccccctttttttttaagtctagaaaatgggcagaggggattgttgtgagtcttcagtgaaacagcatatcaaagctcttagaaatgtctggcacatagtgaacacactccttagtgttctcttttaatttctatgtaaatgaatcagtatttttaatggggccagatgcagtggctcatgcctggaatctcagccctttgggaagctgaggctgaaggaccacttgtgcttgagtttgggctgcagtgagaaatggttgtgccactgtactccagcctgggtgacagagcaagacccagtttctaaaaatacatatattttatacatacatatatatatttggtttagccagtgcagaaataaaataattatgtttaaattatttctaccaccaccccatcccatgaaaagaagagagggagggaaatagattacaataaactcccctaattttattatttctcattctgaaaattcatccaagtccattttgggtggggtcatgaggaaaacactgatgagtgtttgagcgttatattactagttagacataattattaaggatgcacatagcttcattaaaagatggcctaaatgtaactaccaatgtgaaaatttcaatgacttactaaatattttgacctatttgtgaatattctgaaatatattaattagcacattctaaaaataaattagaatcttgttataacagtattcactgttataacagtatatagagcaggaatttataaaaatgagtttgacaataaagctaatgactcatgaggaagcaggaacagtttgttttaccccggaatcaaatttttttctttaccgtgtaacgtttattttttctctcacaactttcatttgttaaagttataagtatttcattggcaactttttgcaaatgatggtggctgttagtttgaaggccagtgtccatgtttagtcaagaagtcatattaatctgcattgaggatgctgaacttgtatagaaatcttttagcactgttgaaatgttcagctcttcagatgcctgagcctgatacgagtttgtcattgtttactcctacagatgttttaagacttagaatgagtatgtccacccattaacttttaaatgacattaaataatcagtggtttccttgacaaaaggagttgcaataggaagttgaagaaaatactgagtctaaaactgtaacttaactctatggtatagaatctaaacttaactataggaacatgtgaggtgccagggcatacttatttcttattggtcaccttccttttatttttattccagttttcttttgtagttttacaagttttcagataattgtgtcattagaaattgacttccttctctatattttcttggccttaaagctgtcgttaagatacattttgaaattgcaggtctaagaggtaaaacttagtttaagcctggcattctcagtataggaattatcagctgcccttttccagacagaagctaaaatgtaatgtagtctaactctcttattagaaggtttattttctgtggtttgaagatttaattgtgtacatttcttctccctttttcactcttgtatatttttgataattgaaggagaagcactcatggttaataaagggtgtgacactcatgcacacgtgtgtttactgtggcactattcacaacagcagagacttggaaccaacccaaatgtccatcagtgatagactggattaagaaaatgtggcacatatacaccatggaatactatgcagccataaaaaaggatgagttcatgtcctttgtagggacatggatgaagctggaaaccatcattctcagcaaactatcacaaggacagaaaaccaaacaccacatgttctccctcgtaggtgggaattgaacaatgagaacacttggacacagggcagggaacatcacacactggggcctgtcgtggggtggggggaggggggagggatagcattaggatatatacgtaatgtaaatgacaagttaatgggtgcagcacaccaacatggcagatgtatacatatgtaacaaacctgcatattgtgcacatgtaccctaaaacttaaagtattaaaaaaaaaaaagagtgtgacatcatatgcaaaggtttgccaagcagagactctggcctgagcttgagtgtttaaggtgtgtgttggaggtcagtctcataggcatacaacgcctacgtgactgacctcatttattcactttccagaccctagagagaaaacaggtgtttaccatcaaaacagtgtgtgcataaattatctggttcaaattggtggccagttttttcaccagttggtggtcaaattgtggccgtcttcaggtatgcagaagcactcttatcagacagaacatttcaggggtttagtttctaagagactaagggccagccctaaaaatatgcctttcgtgggaatgaacaggatttgagcatcccagacctgccgctgagttaacattttcctgtataacttgccttttctttcctggaattaggttacttctgctcagtcttcagctcttaatttaaatggtgctttccacgtaaagccttccatttacctgtgcatagtacccgtacatttcccatacaacatatacacattttaaaatacaaaatttgttttattgaggtataatttacatacaataaaataatttaagtatgcagtttagtgagttttgacaattgtatacagtccagtaattaccacttcagtcatgatataatacaatataggaataaggaaattgatactggcagaatactgttaactagactgcaaacctaatttagatttcactaatgtttacacacattcaagtgtgtgtgtgtgtgtaattctgtgcagttttatcacaggtgcaaatgtatgtaatcatcataatcaagatacagaactatcctatggacacaaagaaaatccctgttgctttattagtcacatgctgtcccatccctaactctagcaagcactgatctgttgtttatacgttatatttaactgtcgttaatctgttgtacctaccaacagggtgtgcattcagtgagagcaaataagaagtctgtcttcttcaccgttgtatccaccacacagtagggcatgggttttaggtgctcagtttattatcttcgggaatttaatattgagaattgacttttaatcctaatgccctgatattcaaaacttttagatgagatttattagaagatgtcatgaaaaaaatccaagaaataaagcaaatttttgaagtttgagaaatcagattgtgtgtgtgcacacacatgtatgtgtgcatgtgctcccacccaagtacacacacgggcacacacacactcaacatcaaatgttcttttaaaagattgctatgcagttagattcatttactacctttttttttttttttttgagataaagtctctctctgtcacccacgctggaaagcagtggcatgatctcggctcactgcaacctctgcctcccgggttcaagcgattctccttcttcagcctcccgtgtagctgggactacaggtgcacaccaccatgtctgcctaatttttgtatttatagtagagagatgtttttgccatgttgaccagcctggtcttgaactcctgagctcaagcgatccacctgccttggcctcccaaagtactgggattacaggtgtgagccaccatgcctggccccttcatttacttttaataaaatttggggttacttaaccattataaatggacaacaaaaagagataatggaaacatttgttgtcatatagctttatggtctatcctcaatagaacatccaaagtaattatttttaaatgaaaatttaccattacctttgtgtaagttccatgtttgttttattcactataatatcctggcgcatgatagtcattttataaacatttgataaatcaatgaatgtgtaactgttaaatactatgttaaatgacattgaactgtttaaaagtatataactcattaaggtagcgtaattgttcatttgtatatttttatagcttaggtatgaaagaggaaaaattaagttagtattaatttggagctgccattgagttccttctgtatacaaaatacttcacagtatctgacaaaaactcagtcagctaggctctaagagtaaaattacttgcttttggtcacccagctagtaagtaaacctagtcagttttttctttgtctgccctctgccccatcctctttctttgctaccaaggtcatttgagtccaactgataaatttgtgtagctgttagaatattcaaaagagaccacaataaaacacaaaatctcatgtggtagccaaatcattgagttgacatatgcaatacattatggagtaatttagcatcaatattttctgttacaaaatgtgaacagtttttatattaaaacctgtgcttcattcattctattgcagagtatgatgaaggaactccttgatacaaatacaatacttgcacaaagaaagaagtccaaatccatcctagtttttttttctttttcttttttgagatggagtctcgctctgtcgcccaggctggagtgcagtgacacgatcacggctcactgcaagctccgcctcccgcgttcacgccattctcttgcctcagcctcccaagtagctgggactacaggtgcctgccaccacgcccggataatttttttttttttttttttagtagagatggggtttcactatgttagccagggtggtctcgatatcctgacctcgtgatctacccgccttggcctcccagagtgctgggattacagacataagccaccgcgcctggcccgtcgtagtttttttttgagacgaagtctcactgttggcccccaggctggagtgcaatggcacgatcttggctctctgcaacctccgcctcctgggttcaagcaattctcccgccttagcctcccgagtacctgggattataggtgcctgccaccatgcccagctaatttttgtatttttagtagagacggggtttcaccatgttggccaggctggtctcgaactcctgacctcaggtgatccacccacctcggcctcccaaagtgctgggattacaggcgtgagccactgtgcctagccaacaaattaatttttaaaaaccaactttcagaagtctttttttttggaaggatcttgcaaatttcctggacctgggtataatccacaatagaaaaagagagtacaacacagtgccagtgttccaatacctcaggagatgcatatgaatctattgtggttgatactggggatgcaagggtaaatgagaggtggttcctatttgttaatcttcattctagtagagaatgactgcactgtgaaagagttgacaagtagtaggtacaaactaaagctggagttttcggggttgatacatctggattttgaatcctgactttaatacgtgttcaacacgaagttaagttttctgatctttatatataataggactaataaactctaccttgaagaattattgtaaagatcagaaatatacgtaaaatgcttagcgtagtaactggtccctggtggatactccttaagtaggattattatctactgctatcattttgatcaatcttttaggctttttctgaggctataaaatggggatgataatagtacccacctcacagtgatgttctgatgattaaatgagatattacatgtaaatctgcttgacatggtgctaggtatatatactttatagaaacctaaatgcttgatcagtttggtttcacaaatgatagcaattctgctgggagttagtggaagacaggtggtcaagaagtgttttataagggatatgaacaaagtgtgtacataattctgagtcttgaagcccagcctcaggatgtggccgtgcccagtggcttgagagaacactctctagagcctagatgacagggagcattgagacactgaatagagtttgctttctctctggcagcagaggggaagctgctttggggcttgaggggaggacacgggtctgtggtgatgccttattctatctcagatctatactctttgcagaatactttgatcacatcgggccacaaatagatttcagtgtgtgatcatgcagctctgataatcgagattaaagctataggaaaaacaactctcagaactttgaactcattctcataaatgagattttttaaatgaagattattataatttccccctttttcatttttacaatgcgaatttggttttgatgatgaaatatagcatttgattattttttctacctgtgaatagtgtttaaaaattgtggcaattaatcttcaagattaattgaatttggtaatggtgcattttcctcatcatgtaattggtggtctgcagtagttcctctgaaatctgcatcagacaactaaaagccactgaatgtttccatcagagtaacggtggtatttttctgcctatctaaatacctatcttggtttaattcttgcgcctttatttttgtgctcgataataaacctacttatgatgcaaaacaggttttaaattgagacttattttttgttttgtagaaacaagagcttctactatttgtagaagttaaacgaatagttctagacctaaagctttttacttaactgaatgaattaattcagttccggttggtcagtcttgagtgcctgctttgtggaaggagtagaaactcttgttccttgtaaaggagggaaaatatatatggaaaataacatttatgtacccaccctccagtttgatgactgtttgttcattcgtttatgcattcattcaataaatatttattgagcacccagccttagatgctaatgcagaaaataaagaaaggttttgagacgaatagtccttagatcagtaatagcacatagttgtccactgctggttgagggaatgtttctcctactttaagagaaaataatgagtaaatgttcatacttttttagtgcatattaggttataaattcctggtaggttaaagagagtatgctcatctgatgtgttttatcttctctgtaacaaagagatatggcaggcttactggaggaagtatgaaatcagtgaattgtagcgcttcctaggcatgcattgttcaatttccagatagttttaactggccatttgagatttgtcttcatgagttgaaagtggagtttatactatgatttctccagctgctcatctaaacatgaagaggatgagtgggtaggttcaacgtggcttgggtttaccaagcaattcagacagagggataatgggagacaggggagctggttgtctttgcaagggacggtcataatgaggaaccatccagtatgaagtagacaaagattggtgtggagtgagagatgagttaactgggggtgggactctttgaacaaatgggctagcaggctaggaggcagtcattgaagaacaggatgtttgaaaatttttttagggtagaagtcaagacactttttatataaagggtcagagtaaatagtttagactttcaggaacgaggcaaaatgcagggtattatgaaagtacagaacaagaaagaagacaaatttccacaaatttttgtgttgataaaattcataatataataattgagcatggttttcttgtaacacaggtgtactgctgaagagaatgggatgcgtcttggaggaggggtggataacatttcatgtgaagttcaaaatgggtactctcatcaaaatcaattgcagattttaatcttttcaggctaatctacaaggaaattgtacacatttcgtctttgaaaatgtgttcacagtgacagttacttgcacgtattgatatcactcttatcggcttttaaaattgagttgattcattgtttagaaggcatttcaagaattccattagattcttctctttactttagactttaagcttgtattactttgcagattaatcacttaaaattgatggttagatgaaaacatctgagctgcacagttaaatggattttgaagtacgtaaatcctttgccttttcactggagtccaaaatatgctgctggaactgtagtttgaggtcagaaaatacatctgcaaatttttgtagaaatggaaatttcccttcttgtttttacttttgacagcatgggaaaggtgtggagcatctgaaggttattatgattcagaccctattcgttgtttcttaatgtcccatttaagtggtcatatatgagcttttcttaataggagaccattttatttctttaattattttttggtataactcacgtttatatctttaacatcaggcataattaccgacacaatgtaaactatatgaaaggtactgaagaaacatttatttatatctttaacatcaagcataattaccgacacaatgtaaactatatgaaaggtactcaggaaacatttatttatatctttaacatcaagcgtaattaccgacataatgtaaactatatgaaaggtactcaggaaacatttattgaatgcatatatctaatatttttcttttaaaacagtgttgtttttcccattccttttgttgtaggtgaagagcgattatatgttagagatagctgatcaagtggaccaggaaattgctttgaagttgggttgtctagaaatacggtaagatgataactatacattgcggcctttatttatcaattttttaattatttttgaatattttccaggtattttccttttcttcataaggattatcagtgaaatactgaataaaatttgagtaaattatgaactattggtttggtgcaaaagtaattgcatttgttgctgttaatttttgtttattattcagatgcctctcccccagtttttatcacttaacaacacaaacattccttatatatacatataaatgtatgtcttccctgattttaggcgatcatactgggagatgcggggcaatgcactagaaaagaagtctaactatgaagtattagagtaagtattgtacttacaatctatacctgcaaatatgcagaactaaattcttagtttattttaaaattaaatactgattctgaaacactgctatttctaaaattttatatccagaagaggaaaaggacagaatccttgatgacattaattgtgttaataaacatttagatttgttgatagatgtcttaaagctaacattgtatatggcccattaacatacactttgtgtagatttaatcattgcaagatgatatttttttctaatttatattgaattctacagctgcctataaattgcttataaattattattcatgttctctgtataagttactacagattgttttgcacaaatagagatacggaagttactgctcatgtatcagaaaaatctagaataactagaaatttttccaataatgaaattaatgtgtgcatcagactgttatattagattgtattaaattaacccaacgtggagtttatgtcgtgggaggctagaaaccctatacttcatctttttcataattaattcagcaaaagataactgaacactgagtcctttgtagctaagtgccagagattcggaaataaaacaaaattttaacccccaggaagcattccactaaaaggaagactctcagacaagtaagcaaaattataacataatgtgctagaaactaaagtggaagtatcagctgggtgtttacaggagaatggtacttgatgtgtgaggtgttttcacatggagatgttatttaacctaagtcttaaagaatgagtgattcacaaagtgtagatatgtggggtttgttgcatgggagccaggaagccagtcaagaggataaatcagcatttgcaaaggcacagaaacatggaccatcaggcaaaggttaggaaactgagttggttgggggtagatagaataccattcttatgagggagagaggggtatgtatacagggaccaggtcattacctatctagtacattcttcaaagagtctggacttggcctttgatcatcgctgactcatcatttcaagcaggacaattatatgatgagattcgcaatttagaattccatatttgtgagattagaatttcattaaagaagattgaaaatggtagcaaggagccaggaagctgttgtacctttcttgtccatgtgagaatgatgaggctgtgagacagaaggaagcagtggccatggagacacgggctagcagaggtagagtctgactggaggctgattacatttgaattagggacagggaggaacccaaggagtctcttggttttctgtcgtgggccactatggataccagtcacagaaaaggagtgtgcttgaggagaaagaagacaagttactcggagcatgttgatttttagttctatgggaacattcatgttttttaaaatgaaaaaggaaagataaatgttggtttatttcactgttatgaaatgacaaataccagtagcattaaaaaaagtctcttatggtaccctgtgcttagatcttggtttctagtaccattcttcagtggaaggcaccagagctgcttggaaaaatgcagtttgagggagaggaggaataatacacgggtgagccctagagcagcttgtagtgccagaaagaaggaagtgctcaaaaagcaaaacgatggggctgtgtcaaaggatgaatgagccagtggaaagagttcccagtgacaaaagctggaacaattcgagcaacaaattaagttacatagtattagattgtaacccaaagtataaattaaatacccatgagtccatagtaatatagatacttgaataaataaataaaggagcagtgacaaatttcctctatagaaaaattccaaataatttatgtaaataccctctctcaaaggaggtggagcataaaacccacctctaacgtatgagctacatttagtggcttgtttctaaagagtataataaggaaaggaagtgtggggaaaaagtaattttacagtgaagaaacctgacaggcatgaccttagccaggtggtcaaagtcaacatcaccagtgatcagtcatgttgatagtgtgcaaccataatgtaatgtgttgagaaaggcactttacctctgtggccttcctcataataaaaacccataaccacagtctaatcacgagaaaaaacatcaaacaaatccctcttcagggacattttacaaagtacctaaccagtactcctcaaaactgtcaaggtcatgaaggaaacagtggaagtcagagaaactcacatatccaggagttgcctaaagaaacaggatgattacaggtaatgtggtgtcctccatatgatgttggaacagaaaaatgataggggaagaaaactgatgaaatctgagtaaagtatagagtttgttaatcataatatatccatactggtttattatttgtgacaaatgtaccaaagtaatgcaagatattaatagtagggggacctgggtgtggactatacaggatactctctttgtaactcttttgtaaatctaaaactattgtaaaataaaaggcctatctaaaaaaaacctgatgggagaattgaggtcagcaagtagttagagatgatctaagaaggtacaatagatggcaaatagttaatgtgaagtcaagaaaggagtgctagttgagtggcctggctgagttacagagagaggactccaggaacacatgtgatcatctttcagggtcactgtggaagcctactctagtatagtggctggggaaaaagaataatgtgaattgtattctaccctatctgtatgtgaggccaagataggaaaatgaaatggtaactgaaagatagagtctatgtgagaaccagaggtatacaaaggaatgaagagagccagacatactgtcaaaaggatacagagttacaggaagagagatacttgaaagaaatttccatgaataatacattgacatatttttaacagccaaaacagttaaagaaagaaaagcaggttgtctgtcaaggtgaattagtgaatggtatgtttggagagaagaattttaagttcaagatctgtttgaaatgagagtcaaattttgcactgaagttagtgtaaatttggcttatttctggaaattacagaacttcagatgatcagagaagaggtgaatagaagaggacaacttagggctttaaccagtgttaaaggctttcaaaaccttacgcagtttttgtcaggggtcagtgaaatggagaacatgagaattgctatacataagggcttgtgattattattacttgaaacaggagagctagacacagcataagtttgtaaattagatccttcttagaggattgcatggaaagttgaatgatctattgttttgatatggctgtttcatcttagttaatttatatgtgtgatatttaaagtaagtaaatatgatagttaaaagaaagaggaatctttagtttattgtagttctaggatgctattgtgcttattttgctgtcccctctttctaaattcctgtgcttttgctccactgtagtgattcgttgcagttatacaacttgtgtgaattcagcaccctatctccatataagtagattagttgagtgacctcttgaagcagaatatctgggttcaagtccttatcgcaccttgactattctatttgccaaattttattagtaagctcttggtgtctgtttccaaacgtgtaaaatggggataatggtgatacctacctatatatgagattgtcgtaaggagttagatgagataatttatgtcaagagcttaatacctcttgtacccaacactgaataaatgtggactataattatgattattatccatgggagatattgattgtcaatcaggataaaaaccaaactgtagagtttctttaaagagcattaagaaaaaaaaatagaaaacaatgttattgttcatctgttgatttaattttgagcccttttaaaatgatttttaatttatttattttcaaaggtaataatacattctagttagagaaaaagtgaaactacagtgtcaaataagaaaatttcttcaactcctctcactgataaccaccatcatagttttaataaatatccttatagctctctgttttaacacttgtgtgcacattcaatgcatagttttaatataagtggaataatcctatatgcatcttgctttttttattcaactttatgtttaatagatctttccatgtgactaaataaaaatatacattagtatactagtccacccaatgagtatataatgctacatacatttaaacagccacataatagtggacattcagttcaggttaataacaatgtaaggcatggtgccattttttgttcatttttgcctatatgataggcaacagatgataacttgctttatattagtttgattactggtgatattaaacctcttcacatatatggccatttttaagttttttttgtaaattaactatattttaaataagcttttctaatatattttttctttattaattttaagcagtctttgtcatgttaacacatcttgtaatgttagttctgtattttctttcccagctcgtcattttctttcaactatgtgtatatggctctcatcattacagaagtttgtctttctttaatgtagtaaaatcgtattttcattttggtttttgagttttaagatccgatttttaaaaaggcattccagaacttaagattgttaaatgtttgttttgaaacttttgtgtattcatttctgtttttacattttcaaatgtgtggattttaaaaatattttctttttaaattaacttttggcttaatgacattatgctcagatagcgtggtctgtgtgataagagcttctcaacttttatggagacttcttttgtggaccctagaataagatcattttcccctagtgttttatcatgaaaaagtttcaaaaatacaaataagttgagagacttgttcagtgagcatctgtgtgtctattacctgaatgctacagttattaacattttgttgtatttgctttgtgtgatcagtttttataaatgttttagtgtgattcaaaaaatgcacttcctaatcaagcttgttaacatacccatctgtgataatgactttgccaatttcttcctataagtctattaatttttccttgatattttgaggcgcttttatttaaacatacgaacaatataccttcttggtaaattgaattttgcatcattatgtagtgatcttctctatgcctgataatttgttgttgttgttctgaaatctgttttgctttctttaggttagccttgacctggtttatacttttcatttcttcactttcaacttctctgtgtccttatactttcaggtgtgtcttttaaaaatgtcatagtgctggatttcttaaatccagtttgctaagtgtttctttgaactgacaggtttagtacatctgtatttcttaggatgcgtgatatattggactcgcttttattatttatttccggtgtcctagaaataagctgtgtgtgagtgcatgtgctgtgtatttcttagttggtattcttattccacattttcttctgtaattacgttgaaatttataaacatctctactctttcattagttacccttacatttaaccttctatattaaccaactccagattttaaacttatctaaccctctcttaaacaatacaaggacctttaaacaccttaactctccccatcttcttccaacttacacatcattttttcctgttattttagttatatcttttcaaaattgaaactccaaatattagacattattattattttatacagttattatttttggctttccctacatgtatatgattttatttcttaaacatcctatattgggccaggtgcagtggctcataacctataatcccagcacactgggaggccagggtaggaagatggcttgaccagcacggatagcatagcgagacctcatctctacaaataattataaaaattagccaggcgcggtggcacgcagctgtggtctcacctagtcgggaggctgaggctggaggattgcttgagcccagcttgttgtggctgcagtgagctatgatcatgccactgcactccagcctgggcaacagaggaagaccttgcttaaaataaccatttttgtatctcagaccacccttctggtatgcttttccttttattccaaatatattgttctgctcattgtttttttctcaacactgtaaagatactctgttatgacaagaaatgtctgttgacatttctttatggttgctctttcttttaaggtccttttcctacttttcatcttttctagttttattcatgtcttgtgcttcgatttctttttataaatccagttggaataagacatacttctcaattctgtagattcatgtttttcatctggaaaatatatgccactatctctttaataatcaacagatatatttctgatctttgctgtctcttacatttttcgtgttttctatctctctgtctctctggattctctcttttttgggggagatatttctttggatttgtcttataattctttaattctcttaagtagtatctttatgccatacgttgttcattgtttttttcattctaccacttatattttttcatttctagacattccatttcatgtgatgtaatcttcttcatgcttggtaacctctggtatgcccatctgtggtgtttgtgccgtttatttcttcaagtttttatgcatagctgttttctgttctgtatttgacaataaccttgaggtactggggtgtctcaatctgctgttactctgactctcactcaggccaccaaagtggcttggattagaggctggtggccctagactgggcaagctgagttccagggggctttgtttacactgctgcggcttctggcaagagccaggaaatgatgccacttccgccttcgtcaggtccaacctcagtgcccaagcgccgggttcatcatccccaccttgcaggtaccgtcggtccagaaacccaaaaacagtttcccttctgcctgtcgtgctttgtgttagtgtgtgtgtgctgggggcgtcctagaaaccggcatgtttatcaccctgttgcctaaacattcttcattgtagctcaatctgtttccaacattagtttcccttttacttttacttataagttttttttttgtttttttttttgagacggagtctcactctgtgcccaggctggagtgcagtggcgcgatctcggctcactgcaagctccgcctcctgggttcacaccattctcctgcctcagcctccttagtagctgggactacaggtgcccgccaccatgcccagctaattttttgtatttttagtagagacgggatttcaccatgttagccaggatggtctcgatctcctgaccttgtgatccgcccgcctcggcctcccaaagtgctgggcttacaagcgtgagccaccgcgcccggcctagaagtttttaatatgtagtttttgataataaaattctgtttttaaatctgtctctttttaaaaaatttcacccttgttcttgaaaggtagcttaacagatgctggtcaagcaatcttcccactttggcctcccaatgtgctgagattataggtatgagtcaccatatctggcccgataatagcttaacagagaaaatgtaactattaacctggttacattttatataataaagatacttaacaatattgcatttggccattgtaaaggctgatgccagtgctttaggagtggcctggctgagaggatgtgcagggactcgcatgcacacaccatggctgttctaccacaggagcaactgggaaccccagcagctctctcaaggagtgtgttggcatttctttttcctattggttttggctagtaacttggagccatttagaaatttatatttcttcggtacagaaaggaattatacatgaatacagaatactgcttgtttcttattagttcatttcatggttctctttttcctttctaataagaaaactcatgatatgttccacataatttattagattccggcaggaattttaaagtcaaactcagttgtttacagcctaatgcacaatgccctttcagctttactgtacttttttttttgagatggagtcttgctctgttgcccaggctggagtgcagtggcgtgacctcggcttgcagcaacctcctcctcctggattcaagcaattctcctgcctcagcctcctaagtagctgggattgcaggtgcccaccactgtgcccggctaattttttttgtatttttagtagagatggggttttaccatgttggccaggctgattttgaactcctgacctcaagtgatcagcccgcatcggccttctaaagtgctaggattacaggtgtaagccaccgtgcccagctgctttactgtatttctaaatgactttttttgtttttgtttgtttgtttgagacagagtctctctctgttgcccaggctagagtgcagtggcatgatctcagcccagtgtaacctccacctcccaggtgcaagtgattctcctacctcagccacccaagtatcagggattacaggtgtgcaccaccacgcccagctaatttttttatttttagtagcgatggggtttcatcatgttggccaggctggtcttgaatgcctgacctcaagtgatccacccgcgttggcctcccaaagtgctgggattacaggtgtgagtcaccacgcccagccataaataactattttgagttatactagtactactactaccactaaggcatagtttctgagagtgtgacaaatacatctagaagcttaagggttttttctttaaaccaactagagagttcatcagtctttcttttcatgtctttccaatctaggaagaaccaaggtactttttttgtaggcaaaggaaaagtataagacactgaagtcccccaacccctgtccctggtacgttacttcctgtgggctcacacaacagggaacaactggagtgcaaaacagacaagacttttatttacatcatttgtaaataagaggtgaggaggagagaaggcagctaccaaaggaggtcaaatgttttaagaaaaatgtttttcgttagcctttaaaagtacattgctgatattgacaaaccaatacagtgttaaaattaggatttctaatatggcattagagaaggaagactcttattttccagtaattattccccaaattagagaactataatgtgaaattattttaaatgaaccatctaacttttcatttctgcttgattccttattaagtggtttgcctttttttagaaatttgtttttaatcatctttgcatttagtatattttgctatagtggtttgtatagttgtttctcttcactatggagaatgtgagctgcattctgttgtgcggggaatgtattccccacacattatatagtatctgatatctgtaagatattccataggtatttctagaatggataaatttgtggtttaaaattagctgagcttagttatcgctgtacttgttttcatttttcttgtcaacagtagtcaattgcatcctttagctacttataataaatatcaaagaaggaggtgctggtagatttggcaggaattgatggttgcctcactgagacagaagtttatttctcttatataaaagaagtgatagacaatcagtgtttctcagtcattggggctacaggttactttaattttaccattttgtaatccatagccacctcatagcctaagaggctgctgaacatcactcatcaccacgtatgtattctagtccccaggaaggaggaagagatgggcattctctttttcttttcaaggacacaaacgtgtatacagtaagtcttcacttaacatcaataggttcctggaaactataagtgaaacgacataaagtgaaaccagttttaccgtgggctaattgatataaacaagagttaagttcttgtggaatgtttctcgtcacaaaaacatccccagcttctaagtagagacccaaaacacttctaatattaaacattggaataaatgtaagcatacattttaaaaagtctgattaaaaaaaaaaccagataattatttacccagttattccagttcagggtcgtgggtggctggaccctatcccagcagctcaggatgcaggtcaggagccagccttggacaggatgccattctcgtcacagggagtactcactcccccaaccccatactcactcatcctgggacaattcagacacaccagttcccctaacatgcacatctttgggatgtgggaggaaagtggagtaaccatagaaaccccacacagacacagggagaacatgcacactccatatagtggcccagctgggaatcaattttttttctcatcaacactataatgaaacaacattacataataatgacattatttatgaacctgctgtttaatactttcccttagagggacataggagaaaacatagtcgcatagccatacctgctacagaagagactggggaaggcagcactttacctggccaaaagacaacttcatccccaggatgaaggggagaatgtcattaagaaacagcaatctctgttgcagttagataattttaacatttgtctgttaagaagcttgagtataatttagaggtgaaagtaccaccatactatttctaaattaaatatactcaattctgacagttttggagaaagagtaagagttactacatggaaatgcctatttaagttatatttgaagttagttttggctgcatttttgcctgggttttaagtatttgagggattatgttcacaaaatattaaacagggtcaacagacaagaatcttctcagaaatattgccagaagagaaataaatttatccttgacttaaaaatgtgcttataataagcttagtttctttttaatatgtaaagaaagttgattcccatctgaggcttctaaaagccagctgtgttatgaatttgtggatatgaatacacgtgcaggataaggccacaggctgggactagatgggcacctagaggattcatctcagtgagtggggaatgctgatggcagtcagctggtgcaggtggggagaggccctcctacacagcctcttttcctgcagcattctggatggccactgtggtgtgaaaggaggaatatgaggaggtgcatagtcatcatgcaggaatgtgggagggcagagctctctaaggattttccaaaaatgctaaatggcaacaggaatcagtggagtgttaaatgggattctgaggtttagcaaaagagaaagaagaccatatcagtcagcagtgttctaaatctttcacttaaaggatagaggtcagttaaacattaagagagttctgtttaaaattggccagaaaaaccttaaatctcgatggctaagtgtattggttttaaactcttatcttatagtacctttcacactgtgttgtagttagttgtttatgtaattatctcacttaagaaaaggaaacatattagcgatttttctatcccatgatctgttatagtgcctagtatgtcatatggtctcagtgagggagtaaatgaatacagcctctcttttctttgtagcttcaaatctaaatgatttgaatcttagtgaatagatcatagaaaccgtttttgttagtcctgagagagaagtaggaaaggtaatacttagaagccctctgctatgtatatacaagcagtcccaacgaaaggcttcttaacatacagctgtctcctgtgagatctgctgccttctgcattgtcatggtagagctctctcctcatgcctctataccttctttccccagtctttctgagcaaggcaagaaccttgagtggttgtccctgtggtaactctgcacctattcccagtgctcatgcatttcacccatccctgtgcttactgaggagcctttgggcccacagcaccaagccctagagaatgagggtggctgaagtcctagattcattgctctggcccagccccacccattgcagctttctgcgacaatggaactgttctgtgactgccccacctagtttggtagcctctagccacatgggactgctcatcacttgaaatgtgatgagcattgcagttgggaacagaatttttaatttaattcaactaatgtaagtataaatagctacatatcactagcggttgtatattggacaacacagttctaacctaatattagtgtcttgtcatctgtgtatgggttcaagaggtttctctgaactgatgtgggaatctaataaactgatgcttgggtttgggaattggggtttggcaatattctaaaagcttcatgtgagttagttttttattacatgagtttaaatgcatttaggacatatcctttgacagttaatatagtaaggaattattgtatgataaaggttagtaattatattttgttgatgatgtgtaagttgtatttgttgttttattcgcatacaggacagttgtgtagagtttgggctcaaagaaggtttttacgccacttgaggcaaaactactgctgattagagtgcacattgtaaaccagtcccaaacacacagatcatggagagaggcgacctcatattaaaaatgggacagcctacaagtccctgtttggtttcctaaggctttaaatttagatatctataataggctttccctaaaaactttgaacatagtaccttaggtgggctcagagtcctctatcacaaaacctgaagtagtttgatttcgagattaaattaaaatgtgttaaaggcagcgttgcagaatttttaccatgaccttgtgtacttgagcctcatttttattttctcaactgccaggtatcaaaaaagttctaacatatggacaaacgttacaaattcattattagtcaaaagaagtttaagaaaacctaaactgtatatatgctaattattagccttcaggtttcttttttttttaatggagttgtcttcacctttgaagtaaaagcaatacctagtattcgtctttattttcaaaaaacatatgcttcctttcatttttcttgaatcatacaacacttttggtttatctttaactttcttatttgtgacagcaatgaatatggtaagttctttagttatgcctggctctgagaaaaatagatgtgtagctgggttgattaatagcagttgacagccacacagtggcggagaggatattccctgccctggtctttccctcacccaaatactgacgtgtgtgttgccttcttgaaacatggccagttgccttcttgaaatccctactagaagggcgtgcacgtacaccttgcccatgggtctgttttaggccctcacatgtctaaaacagaactgttgatgcccacccacctttctgttctcggtgcgtagcttcagcattccctcacacctcatgtccagtcactcatccctgttgcctctttgtccacagtagcccctcaatctcaccacttctcaccgcttctcctgtccaccagcaaacctcaggtcaggccatgcctccctctgcagtaaacagtgagacacagggcatgtggaccagaagctgtccagacagcagtgctttcttctaaggcagaacagaaactgcccccttcacattccaggaacttcataaacagtcttacttaaacctcagcaccactgcatggtagtaggagttcacatccccactttacaagtaaccggaggttcgcaggtgttaacagcaagtctgtcctatggcagagccaagattcaaattaagaactctctgaggctgggcgcagtggctcatgcctgtaatcccagcgctttgggaggctgaagcgggcagatcacttgaggtcaggagttcgagaccagcctggccaacatggtgagaccccatctctactaaaaatacaaaaaatagctgggcgtggtagtgcaggcctgtaaacccagctacttgggatactgaggcacgagaatcgctcgaagcctgggaggcagagggtgcagtgagctgagattggctactgcactctggcctgggtgacaaagcgagactcagtctcaaaaaaacaaacactctgatatgaaaataaatgcttgctgttaaggaatagtggcttgaaaatgtagatagaggcagaaatcctcaagaatactgccttgtagattccagagtgtgtcttttgtgtactaattttgctacttttccgtagtgattggcataaaaattcttaaaatgcaaagaccctgtgtttttaggaggcaaaatgaaaaggaggaacttgtgtggattcttttccccccttcatatccaactgtcaaaatagataatgatggttttgtaaaggtaaggaagggaagttacaaacaaaagtggctagagacagaaatgtaaaaccagtagttaaatgaattaactgatgggtaaaaccagaaagtagtatatcatagaagctgagagagaattataggatgtaatgaacataatatcagaataagaaagaatgagaactgagaccagtttcgaatttaccagaggaggaattcattggcttaggaactactagcagttagattatagaataagggatttaaaatgtttgaatatagtatcaaccaaataaactgacatgatgtctctggttttgtttataacgtcagctaacttaacagttacggatgaagaagtcatccctgtttcttgatactttatattcagtttattatatgtgatatagtatgtgattctgaaaagatacctgtatttcccttttctccttgatccttttatgtgtttcctgacgttccttaatgtcgtcagaggcattatttcacattgctagcacacgagtgacacctagtggccaaaacatctgagtaagttagtaaccaaagtactaggaaaagaatcagctattctttccaacctattttcttggccagagcgttgaggttcttgataataatgatcaatttaattttgttgcctgacttaaagaacattgctgcgatttccagcatttccataaattcaccttttttacctagggcataaatttatctgtttgttttttcctaatgtgaaactgagacaagtgaatgagtcacttaatcaaaaaagtctatttttaaaaatagtcaacttttaggataaacctaagggatttatttctgtaacttctcgggtatatcctgaatcatttactaatcaggctagctattttctctacaaatacagtattacccagttggaagtgatgtttataaccttcaagaaatatctgaaaaaggacagtttttaatacactataatttacaaagagggaatattttagaagagttttcaacaataaaggtaaaaaaagaaaaaaccaaaaggatttctatttaaaccaacttgtattcatgtttccagtacatatctagaaaatgatttgtcccatccttcctgtgaatatactggtaaattaaagcattattatacttgtttccttcctaaataatatatggaaggataaataatttacagtgcttttatgttcttgcaagtttgtcatattaattgatttggtggtgttatttgttaatacgcttctttttatatttcagaaaagatgttggtttaaagcgattttttcctaagagtttactggattctgtcaaggtaattagagtctcctttatcataataaaataacaaaattatgccaagaccttttccccagtggtaaattgcttttgggaaagtaaaatgtagtttccttccttacatgtaaaatatataatttaaaaagctgacatttattctagtcacattaatggcaaataggtttttagtatagctttctcccataaaacatggttttacttcttaattgtgtttgatactctgctaagcataaaactaaaaaagttatgtgcacagttattcctgtcatctaggtcttcacaggctaaaatattttgacatgcagaagaaaaggagcaatatgtaaaataatcgtggtggtggaatcattaatattgtgtgtgtgtgtgtgtgtgtgtgtgtatgtgtgtgcgtgcatgttagtgcattttgaaggtctgtcttttgtttcaaccctttggatgcttccccgcattagtagctttggcagagcctcagttcttatccttcccatatccagcgtggagagcaccttggagtgaggtgggaggactctgaatgtgtgattcccccagctaatccagagcacacatcaagattttcaagcgcagcaggggatacaaactttagggttaaggcagagtctggctcagatgagctctgccattttctagcctcagggtcttgggcctggtttcttatttctacaatgaagaaaatagtattttgtagggttgatgtgaatatttaacagattagtaaatatattacttaccacagtacctgtcacatagcaacagtggatgttactgctcttactttttatttttcaaagatcttattctacatcccatcagctgaagcccaagcaggagaagatactcattatgagaaaatgtagctaactttggataagttatttcatcttttggtatttcagtttacacatccgtaaaatggggataaaatccatttctaacacgagattaataagaggattaaatcttagaaagaccaaaagagagagaactgtcgacgtcatgttgattatcattgggccggagtgttggtataatttatcagatgcaatctgtgacaaaagctctgtattcagatatctgggtcctgctctctgtcaaacccatccagaataggactgtaaggattagtcactgtttccctgagtccagaaagtaacagtatcccttcctctctcacatagcttcttgataatctaatgggaaaaatagatataaaggtgttggctttaaaacacaatgcattctagaaatgcaataagacgtgcatttaagaatagtacaggaaaaatatactctttatttcaggctctctttctagtgatgctgctcgactttttcagtgttcattcaagtttcctgatctattagtgaaatactacagtgaattattagggaacagagcatactccatttagtgtggttgaggccaggactacagatcgagacactgtcccagtctacaagtagcccacagaccattggcatgagtgggttgagtcagatttgaaagagaacaaagagttttaaatgaagtttggcacagtggaaggggaatgagagagaatgacacaattgtgtccttcgagagagttattaggtgtgggtggcccatactcttgcagttgggagaatgggagattcagtttgacctggaatgtttttggtgtgggagccgagaaggcatgggaagacccttaagtggaagggatgctgctgtgtgtaaacctgctgggtgctgcagtgaggaggatagtggagacattcaaacaagtgtaagctacagttttagtgaatttacattgctgttggatagaagagtactctacccaatgttctgttgatggttatgtcacattagtagtattggtcaggggttttcagttgtgaagcactggtttatgaagcctcagaattattgcaaagtctccttaaatctgtatgtgtataaacaattaggaaaagagtgactgttgtcatttaggagtccaatacattctagatttttaaaggatccccatattcaaaacggaaccacaggtacaggtcacaggtgccatggtgtgagtgtagccagagtgagacaggtgcccaaagaggttcggtagaggactggccctgtctcctccatgactggtccttctgaacctctgcttcaatgttccctctcctactcttttctcaccacgcaaagtggaaatggcaaaatactcccttcaatcttgggaccctgtttagtatcttaatttttaattctactttctctttttttttttttttgttgagacagagtcttgctccatcgcccatgctggagtgcagtggcgtgatctcgactcgctgcaacctcctcctcccggttcaagcaattcttctgcctcagtctcccaaatagctgggactacaggtgcctgccaccacacctggctaatttttttatttttagtagagatggggtttcactgtgttggttgggctggtctcgaacgcctgagctcaagtgatccacccaccttggcctcccaaagtgctgggattacaggcgtgagccactgtgcctggcctcaatttttaattatgtagtttgttacttgtttgtattttatctgccttcctccgctatattttaagattgttgagggcaaagacaatatctgttgctgtctccactctacaccctttgtttgacattgtacctggcacgtagtaacatttggtaaatcctacttaatgaataacagcaatatgatgagtaaaataaggggagacactttctgaacactgagtacaatgtgaacaaaaggtgtgaagacaggataagactttagaagatagtagaattgaaaagctagaaagtttctttccttggttatgccttccctactgctctccatccccacccccctaaaaaaaaccctcctctgcaggaaatttgtgcaggtatcttaagatatgtttccaggctatcgtttaggcttccattgccctggcctttgctgctgatgcccatgtgctttttttcctgccatcttgagctgtacctgggtatcagataactcctggtggccagagagggctcacaccctagaaacagcgagccctgatagccagagagggctcacaccctagaaacagcgagccctctctgtttctaggctgtctaggaaacagaggtcagacaggaaagggggttttggttgagtagagtcaatatgggatcattgtgggcagtcacttggtgtgggcttaaatgctgaggtaggagttgagggggattggggactcattgcagagtgtgtagagtatgcagagagtgcagagtgtgcagtatgatctctttttggattctagaatataaatttgacagcaacatggagcacagattgaaagcaaaaagaaccaagaagacttgggaggtgattaaggaagatgagatgtgcaatgatcaaggcctggatggaatggcttctgtaagaatgggagggaaggatgactagagggacttgagaaaacttcttttccttttttttagagacagggtctcactccgtcgcccaggctggagtgcattggcgcgatcttggctcactgcagcctcggccactcaggttcaagcaattctcctgccttagccacctgagtagctgggattacaggcatggaccaccatgcccagctaatttttgtatttttttctgtagagacacggttttaccatgttgccctggctggtctcaaactcctgacttaagccatccacccgcctccgcctcccaaagtgctgggattacggatgtgaaccatcacacccagtccagaaaaccaaataacagatgtgctttttgagcaattcaattgctgctgattttgatgtaaatagaattaatttttagctactgttagctatggattcatcagatttatggagtggctcataaatacggttcttagaactggtttctcacatgccctttttaataagggaatcactgtaattttgtgtacccaatagtgtgtatttggcttaggaattcataaccttagcccaaggttttttcacatttgacataaattctttggacattgcactgattgccatgaaacttctatggaatatggtaccaacatatgctcatgggggtaacaactataatacaaattaggtggtgtctagacagtcccttcttcaaagctattgccagtgaaacttcagctagctagaaattcacaccagtttcttgtttcttctgaaatagctctatagaatggctaagtcagttaacattggcttttccataaacaggctacatttgtttctccaaaaatcattttgttttacctgattttttttccctttctatttatattcgtagaagattatttataattaacattcacattgaattgttgaaagattgttttattatctttagtgaaacttggattagctatgttttatgccaaaaatggaatctgggatatatgtgcctcaattactaagaataatttgcaagtattttaatttccgtctcgttgatgttagtagttttaaagacacatttaaaaattcactgtaccagtaaaactgtcaaacccaaattgagggacattctacagaattctgatgattactcttgaaaaatatcaaggtcatgaaagataagacccagaagctgtttaacagctggaggaggctgaggagacaagatgtgtaaatgcagtgtggaatccggagcagtgaaaggacattagtggacaactagtgaaactggagtcacttctgtagttcagtgaatgttgtcctaccagtgggtaccaagggtgctccccatactggcattacaactctactctgagcttaaattaggcagcaagtcaaaataggcaaattttaatttattgcaatataatgcacagtagaaacctaatttcagaactagaaatgttaagagatcaatagttatcagtttttttagtatctgattctcaagtaataatgtggtttcctagaatactaccaggaacacatgattttattcttggagaaaatagtcattattttcatttctaggatgagcagatgactattttaagcttaatattttcaccaagcacagaaatgcatatcttggtacgatgttcagcagtgaattcctgttatctgctgtatgccaggacctgagttggggatgctgggtggggagtgaaacctggcctctgcttacagagcttatcatctgatgtgggtcctgtagataggagtaagaagaggctctcttcacgcgctgttaatgtatctgcatttaaagcatttggtgtttgggttgagaagttattccttaaaaactctcttattgcagattttccttggcattgccttacaacctttgcatctgggaagtcctaggaatctattgttgctagcagcatctgataatcattaggttgactaataggaagttatttttgtagctcaacatggatgaatagcagcagtttcttatggttcatcctagcaataccacttcattttgaagaagtatcacattcttagtaaatttatcactatatgtaaattggtttaaaataaaatagtgtgcgtagatgccttgtttccaaaatccaggttaacacaagcaggtgttcaaacttgaaatgcaatgagaacagtcttgtttacttaaacaagttctgcaagtgtattgattaatatccagagattctacacagattttgtggaattttgttccccactgagtaattaggaaagaactaatgctttctaagatatccttttcgtaaaaactgattttggagtttcagacagcagagattttctagtttctgtccagcactgaacaccataggtttggaactcacagtcctcattggcagtcgcatttaagtacagaccataagaacttgggtatattcctgccaaaggcgccaacagttttagttggtggagaatgagagagttgtttctgtgtccataggaaactaactctgaatgatatcgttttcctttactccagctgcttgagcttactggtttgttgtgttgtttgttgctctcacttcttgggtctcagcttgttaatgtgtaggatgagcaaggtaacaccgcctacagaaaaagcagcatgttttcccacattcagctgaatgagacaaatacagtaaaattggagtccagattgtctcttaacattgcatagttattactttcaaacacatttgccccagttacttggaaattttccagcagattaaattatcggggagagcagttgagttctttaccaccacacacattccatgtctaagagtttgggatgagaaaatgaggatcaaaccaaattgactcactttatttagcaaagggttgatggcttcaatccctgttgtagaagaacagcacacaacttctttttaagattcttagtcatcagatgctgagaaataagaggccaagagaaacaaggagggcttgaatttaaaggaggcagagggtagagagttgttgggttacatttgaagaatgttacgggcgtaaagtctaacaggacttagctactggtctaatgtgggaggaggaagaagaaaatacagggcctggcctcagatttctgtcccatacacttaagtgctgtctagtgctactagtcaagagacaatattgaagcagaatctgaactgggtgggactgcccgtgatgcattcagctgtgtaagtagtgaactagaagtgcctggagactatgggggtcaaagggaaggggtataggaaagagtaagttcagagtgatagagttgcaaccaagttagatgtatatgttagggtccagtcgggtagggccaataagccaccacggctgaaatctcagtgctcttagtggcaggttttagatgtctgtgagaaactgcagtggaactgtcaggtaggcaggtgtgtatatatatatatgcattttaacctcaagagcagattctgtttcctcgacttctatctccgttacttcatagaatgttttaggttaattttaaaaagcattgaacaaatgagcaggtgtcagtatattataatattgccaataatttatatataaaccagcagctggttgggaattaggtacaaagtagagaattgactttttttctgtacctattttacataatttttgatcactgcatgtcagtatttacctgagttgaaatattcctcttagagtcatgaatgaatataccaacatttggttaatgttaatagaaatgttttgtcattgtgttctggtccctgtgttcagttgacaactgttccttgcaactgctaccatattccaatttattgtatcatacacttaaagagatttttttatattccagggcttttgctggacttattttctattaatacttgtagatgggagacatttcttacactcagagcatttgtacattgaggcagcatgttctatgatagaagtttgaaactaaagaaatctgaactgtcttcccacttacttactagaaagtgaaacctaatttatcacaggatagaactagattttattcatccatattatctgtttgagagtttgccagaatccaagttgttatggcagagacatgtaattattcattgtaaaagcacatcattgagtttcagctgcgggctatactcttttctttggggtaacaaggcagtgcatgctcccttatcaccaacgtggatcttatataagtgccatgtctaaaaatacattcaaagcagtatgagacccatagggatgtggtggttgtttcttcctggtttcttctatcaagcagagcatcttagaaaaggaggtgtttgaattggtctcatagcaagtaaaaagaaatcaagtagttctggattagaatcacaattcttgtaccccctcgttgttacctaatgtttcagtctctgtttgctcagtaatatatgaaaaatagtatctcccttgcaagggtcattgtgaagactttgtttatttccacggaagggcctacagatgtcttttctggtatcattttttggtagtgtgtgtgtgtttgtgtgtgtgtgtgtgtgtgtgaatcagcgcctaatagcactatatgcacagaattatactgttcctcctgtagccatgaatgaagatcagaatgctctttttccagctgtactctgaatttattgagaatagatacctgttctgattatgcagtgtatgccaagtgccaagcacagagtagaatttccttagtggatttgttctaggtccagagtgtagcgggcctgcttcttagagactgctttatattcagcaaagtcccaaggtactatattgttaatttataaggagaaaaacatcatgtaggtggctacaagcagtactcaaatctccatgtccaatctgcatgctctgttgtagagtctgtcctacataggtgatcataagcagagaatgtttagaaagcctggagtcaaaccaagaatatgcttttcggacttttgtttatagagcatctgaggctgaccacctcactttccatgtgatacattttatagtcaagccttgctaaccttgaacccattttattgctcttcagtttaagttctgtgaagctgtaattaatccttttcaaaacagctataattctcttattccactctgtcatactcacctgtcaaaacctcagccctggttaaaaccaactattggtcagcttacttagctttggccttctcttttgtcttcattttatttgcaggtgccatctagtcccatgtatttaaatacttcagctggtggctctgaaatttctagcaacagtgctgccctctcctgagctccagacttagatccaaatgtctccttgatggttcatgttggaagacttcaaggtcaaacacatgtacagggttaacatgactttatttttttcaccaagcctgcctcttatgtttgcctgtttgttccatctaaaactctacttttcctggattctttactttccagttgtcttgcatatgatcatccaaatgtcccaaaagtgcccatttctcttcttcaccactaccttggggtccatgccactagtgttttcttgcttgatctgttacagtgacctgactggtctttctgctttcactcctacacactcccccaaccctctgtgtgcaagagcagagcgagctttttaaaataaaagtcacatgccttaggtaatcctcccatgttccactatcttggctcattgaattcctgtcttcaggaatcttgtcctctgccttacctcaacctctcactctggtcttattcatttccagtaatcgaaccccctccctaattgtgtgtatccttctctctgaccatagctcctgtctttccagctcactttctgtagtatcccagatccagtaatccttggatcctactaggaccttcaagccactacagacaggctattacctccatgaccccaccaaagtatgccatgccctcctagtttacggtgtacctgacttagcagccacacctcaacctgggcccctggctgctccccatgtccctgacccactgagattagcaggtcacctaatccatcttccctgtctgctgggccagccaggacctccccttgaactccactgggcccttactggcctgcttgacagctccacttggatttctggtattcttctggcattctttctgacctttacccaccaaactgctcctctcacaatttctgccatttcagtttaatggcaactcttaattattagcatatcctgttggttctatgtttaaagtaaatccattggagtccagttactctggaaaaaaaaaaaaaaaagaagaagaaagaaaggtagggtctgactacttgactacttctcaccctctttctggttctgtacttgtgccatctgtctcctcctgcctggattatttgggttgccctgacttggtctctcctgctcctttcatactgttcacaacacagtggccagagtatccctgttaaaacataattcaggccgggtgcggtggctcatgcctataatcccagcactttcggaggctgaggcgggtggatctcttgaggtcaggagttcaagaccagcctggccaacatgatgaaaccctgtctctactaaatatacaaaaattagccaggtgtggtggtgcacacctgtaatcccagctactcagggaggctggggcaggagaatcgcttgagcctgggaggcagaggttgcagtgagccgaggttgcgccaccgcactccagtctgggcgacagagtgagaccctatttaaaaaaaaaaaaaaaaaaaaaaaaaaaaaaaaaaaaaaaaaaccaaagtcagataaagtcactcctcttctcaaagtctcctgagggcttggcatctcatcagagtcaaagccaacttgttaactatggcctacattctcttgcccctcttcattagacctcatcacattccctttatccatggccttctcagactgcttcacacaccaaggactgggggtttgctgcttggaaagcatttacctctgctatgcagatttccatgtgtttaagtagaaaactcaaataagcgaaaaaggactggaagaccacctatcatcttacttcatgaaaaaagcaaaagcatcgttgctttatctccttcatgggtacattgctgtgtgctcaccaggacccacacgtgtgctcttgccttttaaaggcatctgtactccatgctgactgttttgtcatcttttttcatgtaacaatgtaatatgggttttaatgccagtagattagttctccaaaacagttcttgaggctgcatagaatgttggttgagaagatagatacaccatagtttacgtaaccaggctctctattactgtaaacagttctgcagtgaatctttttgttcctgaatctttgcatgtatctctaatcatttctaaagaataatgtcctggaattttattttatggataagcattgtggtttttttaaagtttttgatttgtgctttccttcagaaagatatactgtttttttccctcctaacagtggaatgtgcaagtacctttatacctttggcctggtgttttctgagtcatgtgcacatatagtacaaacttctgtttaagaaataaaactctatatatgaactttacagttaaaaatggttaagatggtgaattttgtgttatatgcattttgccacaattaaaagaataaagctttgataaatacatttatagttatttgacaagtatactttttggcagtaatttgaatgtaggtgttagtaagtagttggtaggaaagaaatcttaccattattgttgtggtctttactcattgctgatttttacaagatgttttggtaattttgtcatgcaggccaaaacactaagaaaactgatccaacaaacatttagacaatttgccaaccttaatagagaagaaagtattctgaaattctttgagatcctgtctccagtctacagatttgataaggaatgcttcaagtgtgctcttggtgtaagtatgggaatatgggaaatagtgggctagtttgattttactttttcttgtctcttgctgtatatctaaatttctgatgaaaaaatgctaacttgtcccatttttttcaataaaatgatattttttcattttaccatgtgaaaaatagaaaaagaaaataattaatgtgagaataaaatcacctttttaaaaacagcatgcctagcttcatagttaggtttttaaaattttatccctgtgatttgttaattgttctctaagggctagtttacctatttagataatcatcccagagaaacccttggcatcaggcatgctggaataagcacagtgcactttgtgcaggcttaacacatcctgggtcaatgaagttataaatattttatcttatttggttagatagattaatagcaaaccaaaccagcccctgctttggtcctttaacatatccacggctctttatctaaagtatttcttttttccttctgccacctctgttctcacttgtttcaccttcaaaagtcaagctggattatttcagtggaactggcaatcggcccagaagaaggaatcagttacctaacggacaagggctgcaatgtaagtctgctctgacctttcgggaacttggcgttacacaaagaagaatcaaattaaggaaatggggcattcttttggaaaagatcattttacaattaaattttcctattgcactgcatttattgttcagtggagtgggggacaagtaagagaaagtctaggtgctgttgaaatacctcggaattacttagttttggaaggaaaggaatcatacaaacctaacatgtgttagtgagacctgaatggggttgttactgtttatctggagaagttttaaatactaatttttaaaattaagttctgaatgatttgggtatatttgtactggcatcttaccctttgaaacagcctcttcaggttatttccaggaaaaaaaaaaattatacattcacaattctcttgaaagccttattaaccttatttacctcgaagaaaaaatgtccatcagatggaaactcacacttctaccccacacctcacttcttttgttatcttcctagcagaagtgctgaccatttcctgtgtgatcctcattcttccaacaagtattattgagaacctgcttggtgccaggcagtctagaggtttgagatacaataaggaacaaaacagaagtcctttgtctttatgtagcttatagttgagtgcacaaaataaatatggaatacatctgtgtcatacaacaataagtaccgagatgaaaagtagaacagtgtgagggtgggtgtactgagaagggcatgctcccatttagatgagtgttcagggaacatgattctaggggcttcttctcaggccttgcactagtaacatttcttttccacttaacatagtgtagtgatttgaactttttacttaatttattcataccttgacctgtacatataatttcctatacatatataaatgtgccaaaccgtgtctgacctgcttttttccaagtgtactctggtttccattcccactctgctcagctcctgcctctaccattcttttctcttcagccttctctgtaaccccccaccccctgcccatacttaacatgtaagtgatttagtaatcttctgtgtttttcctcatattcctgttttgttattcagaaaaggggtcatcatcaggcacactgtcctacttggttatttcactctgtgaacctggtagaaattttttcaagccccgcctttctttgccccttcctccctgggggccagatgggattctgtgaagggcaattactttgcttttagatttctgccccaagacaatgacataataaatactcctttatatataatctatgtactactgctttttctccttgtggaagagatttccaaggatggaactgcagggttcgtttcaaatagttgtaattttaaaagaagctgttggattgcttttcagaaaagctaggaaacttcatattgtcactggcagtgtgtgagagtactattttcgcactcattggatggcagttttaatagctcttttaatttttccattttaatagatacaaagttattcttgtaacttttttgctcacttagatgtaaagcaaggacctagtaactttaaacatattttcatgtcttgactgtttttcttctcacctctgtgaattaactgctcatatcatgtactttgcctattttaccaacacaattgtccttttaaattaataagtccctttacacatcaaggaaatcagtgtgttttcctgttaccttttttatgatttttttccccaaatctcttgttggctgttgactttaaacagaccggcctcccttgtcccacatcctaaggatgaccactgtcctgacttctgccatcactgattaaatctcattaaatgctgctgtgtcagctggatattcacagaggaaaacagaataaatttttgtgaaattttgtgaaagtgctttttttttgatattgtgtttcaggacttcttttatacccttcaataagatctcaatctttttcagataggtcttccatattaaaccaattcataagtattttatagttttgggccttatgttgaatgactttttggggtttttcttgccacttacaatttaaaatttatattgtgagcatagaagatattcttgattattgtttaacatacagtctgcaaccttattattgattgaacaggttttttattagaattttggattttataagtgtataataatgtaatcagcaaaagaataattttacctttccccacatacaattttttccttcagtcacaagaagctcaaagatcatgtttaataacagggcagtagacaatattcctattttgttttagattttaatttatcaattaaaagtgtgtcattatttgggattgtttttattgttgagttttaataacatgtctttaatatttttatcttttgcttagagttttatgagtagctcctaaatttaatcaaagacccttttagcatctattgatatgatcctttttctcctttatcattatagtagattatattaatagttatgataatattgagccaattaataatatacaatattcttttaaaatattgagttatatttgtagaatttttgcaactatttgtgagattaatctagacttttttatgttaactttattagacatggtgttaaagttatattaatttcattaggtgaattggaatctttcagtgatttttttttaaaaaaactttttaagctcaggggtacatgggcagatttgttatctaggtaacctcgtgtcacacagtttatcatacagattactttgtcacccaggtattaatcctagtactgattagttatttttcccaatcccctccccacttttaccctccaccctctggtaggccccagtgtctgttgttgccctctgtgtgtccttgtgttctcatcttttagcttcccttataagtgggagctaaaagatgcagtatttagttttctattcctgtgttattttgctaaagataatggcctccagctccatccatgttcctgcaaagaacatgatctcattcttttttttttttggctgcataatattccatggtgtgcatgtaccacattttctttatccagtctaccatcgatgggcatttaggttgattccatgtcttggctattgtgaatagtgctgcattagacgtacatgtatatgtgtctttataaaagaacaatttggccgggcgcggtggctcacacctgtaatcccagcactttgggaggccaaggtgggcggatcacgaggtcaggagatggagaccatcctggctaacacggtgaaaccctgtccctactaaaaatacaaaaaatcagctgggcgtggtggcatgcgcctgtagtcccagctactcaggaggctgaggcaggagaatggcatcaacccgggaggcggagcttgcagtgagccgagatttcgtcattgcactccagcctgggcaacagagcgagactccgtctcaaaaaaaaaaaaaaaagaacaatttatattcctttgggtatatagccagtaatgggattgctgggttgtatggtacttctgtttgtaggtgttgaggaattgctacactgtcttattattttatgtattattgtgaggtacattccttcaatgcctagttcattgaggtgttttaacatgaagagatgttgaattttattgaaagccttttctgcatctgtcaagatgatcctgtggtttttgtttttagttctgtttatgtgatgaatcacatttattgatttgcatatgttgacccagccttgcatcccaggaataaagcctacttgatcatggtggattagctttttgatgtgccactgctgggtttggtttgctaatattttgttgaggatttttgcatctatgttcatcaataatattggcctgacattttctatttttgttgtgtctctgccaggttttggtatcagaataattctggcttcatagaatgagttagagaggagtccctccttttcagtttattggaatagttttagtaagaatggtaccagctcatctgtatacgtctggtagaatttggctgtgaatccatgtggtgctgggctttattgggttggtaggctatttattacggattcaatttcagagctcattattggtcacttcagggcttcagtttcttcctggctcagtcttgggagggtttatatgcccaggaatttatccataacttctagattttctggtttatgtgcatagaggtgttcctaagattctctgatagttatttgtatttctgtggggttggtggtaacatcccccttttcatttctagttgtgtttacttaggtcttctctcttctttattaatctgggtagtggtctattttattaatttttttttaaaaaaacaactcttggttttggtttagcaacaggcaggaatggtttttccatctcactctccttcaattcatcctggttttggttagttcttttcttcttctagttttggggttggtttgctcttcttctagtttggggttggttctctagttcttttttgtgatcttaagttgttaaactgagatctaacttttcgatgtgggcatttagtgctacaaatttacctgttaacactgccttacctgtgtcccagagattctggtacattgtgtcttggttctcattcatttcaaagcacttcttgatttctgccttaatttcattatttacacaaaagtcatttgggagcagtttattcgatttccatgtaattgtgtggttttgagcaaatttctcagtcatgatttttaacttggccgtgctgtgctccgagagaatgtttattatgatttcagttcttttgcatttgctgagtactacaaatttacctctttacactgccttacctgtgtcccagagattctggtacattgtgtcttggttctcattcatttcaaagcacttcttgatttctgccttaatttcattatttacccaaaagtcattcgggagcagtttattcaatttccatataattgtgtggttttgggcaaatttcttagtcatgatttctaatttggccatgctgtgctctgagggaatggttattatgatttcagttcttttgcatttgctaaacggtgttttgtgttcaattatataattgattttagagtatgtgccgtatggtgatgagatgaatgtgtattttgttgctttggggtggagagttctatagatgtctgtcaggtccatttgatccaatgttgaattcaaatcatgaatatgtttgttaatttccatctcagtgatctacgtaatattgtcagtggggtgttaaagtctcccactattattgtgtaggagtctaagtctctttgaaggtctctaagaatctggcttattaataatgagtgctgctgtttggtttttttatatatttaggatagttaggccttctcgttggattgaaccctttaccattatgtaatgcccttctttgtcttttttaactgagttggtttaaagtctgttttgtctgaaattaagattgtaacccctgtttttttctgttttccatttgaatgatggatttttctccattcctttattttgagcctatgtgtgtcattgcatgtgagataggtattttgaagacagcataccaatgaatcttggttctttatccagctctgtgtcttttaatgggggcatttagcccattaacattcaaggttagtattgatatgtgtggatttgatcctgccatcatggtgttagcttgttattaggcaaacttgtttgtgtgtttgctttatagtgtcactggtctgtgtttttgtgatggttggtaacggtctttcctttccatatttagtgctcctttcaggagctcttgtaaggcaggtctcatggtaacaaatttcttcagcatttgcttgtctgaaaaggatcctatatctcctttatttatgaagcttagtttggctggaattataaaatttcaggttggaatttcttccagaatgttgaatgttggcccccaatctcttttggcttgtagagtttctactgagaggtctgctgtttatctgatgggccttcctttgcaggtgacctggcccttctagtttcctttaacattttttctttcatttccaccttgaagaatttcatgatgatgtgtcttgggaatgatcttctcgtgtagtatcttactctgcctttcctaaatttgaatgttgacttctctagctaggttggggaacttttcatagatcatatcctgatacatgttttccaagttgcttacactctccccagctctttcagggacaccagtgagacatagatttggtctctttacataatcccgtatttcacagaggctttcttcattccttttcattcttttttctctattcttttctgactcctatttcagaaagacagctttcaagctctgaaattctttcctcaacttggtctgttaggctattaatacttacggttgcattatgaaatctttgtagtgtgcttttcagcgccatcaggttgattatgttcttttctattctggctattttttctctcagctcctgtattgttttattgtgattcttagcttccttggattgggtttcagtgtactcctacatctcaatgatcttcattcctatccatgttctgaattctatttctgtcatttcagccatctcaacccagttcagaacccttgctggagaggtggtgcggtcatttagaggaaagaaggcactctggctttttgagttgttagatttcttgcagtggttctttccatcttttgggccaacgtttcttcaacctttgaagttgctgacctttgtatttttgcttgtttgtttgtttatcctatttgatgaccttgagggtttgattgtggtaaggtggactcaactgactggctgcatttctggaatattttaggggaccagtgcccagcccccaactcctggactgtgtgctctaattctgggagactggtattgggctgcaactttgttctctggctcctggaggttaggaatccactgcacttgtggagtgttgggggtaggggtgctcccagaccactggtcactacactccaatgggtggtgtcagccaaagcatttcacagtgtggtggcataggatccgcccttgtttccatgtgccagcagcagtggcagcacactgggatgcacgctcatcagcccggcaggttgctagtgggtactggggtgcctgtctccatttgagcattcactacagtggcagtagcagcacggtttgggtggggggttgcctgttggcaactgtgcagcattggtgctggtggtggtggtagcacagggttgggttgctggcaggcccaggtctgtgtgtgcaccctgtgcactgtaagcataggtgtttgctgtgggtaggggagaatctgctattctctgtgcctgctttcactcttgggataatgttgacataagcatggggtgctggcagtggggacagggctggttggctctgtgcctgccaaggctccgactgaggtggctgtcaggcatgggtgagttttggggttgcgtgcacatgtgcactggtgaggcacggaaggcaatacctgcctgcgtacacaggtgccagcaaaactctgttgggaattgctgtgggctagaggaacctgcagtgtgaggaaggagcgggtgggctggtgtgtggcaatggaggctgccccgtgggagctctctgctggtcagaagcggtcagccactgcaggggctatgatgtgggccccagggcacccaaggctaccctgcaagcaggctcgttcaggctgggaccccaggagaagccagaagcccaaggggtgctcaggtcagactaacccccttctgataggtaagcccaccctgcagagttcaggtccaacagttcccctagggctaaagtctcttatgggagcaagtcagggcttccctggccatgttccactacagacgctcctgcaccaaaccctctgggctccacctcagctggctgcaatccctagcacttctctaagcagctctccctgccacctcaagtgtccgtagtagttgaggggccccctgctcggatttaagaggcctgtagtgagagcaggttgctccttgccagttccactcacccattcccccagggtaattgtgggccaggaatgagtcttggtgtgtggtagcctcttgcagggttcccagcttcctcccccttcagcccagcttctgtgtctttccttcatccattctcagtgccttccctctctctggtgatttttaatggcctgaaatattttaattcaaattggaattgcatgttgtttaaagactaggtagaactgatctacgtaacaacatgatgcctttttaaacggcaggtgtttatctttttaatcacttcaaaagtaatagatcttttttgagacacggtctcaccctgtcacccaggctggaattcagtggcacgatcaaggcttactgcaacctctgccatctgggctcaagcagttctcctgcctcagtctcccaagtagctgggactacaggtacacaccattacactcggctaatttttgtatttttttgtagagagggggttttgccatgttgcccaagctggtctcaaactcctgggttcaagtaatctgcccaccccagcctcccaaagtgctgagattacaggcgtgaaccactgtgcctggcctaatagtaatcgatctatccacattttccacttgtgtcggctttggtaatttagcatattatccatttctctacattttcatcttgctgccatagagttgcctctcatagatctgttaaaatctttccagtaactttgtctctatattcctgtttcatgcctaagctcttttgatttggctctttttcagacttgtaaaggtctgtctattctaattgttttttgaaggacaagtttagtgatgtattgcagcagtactattcattttcattgatttcagtatttttcttcattctgtttttgtagtatcttcattatttttgtcttttttattgtgctcttcccttttaagtgcatctttaaaatgtattcttgtttactttggaggccattttcttcttgcacaacttttaatatgtcttacctttctaggtatgtggtattcttctttccattgtatttctgtatactcatttgaagttttatctttggccaggcaccgtggctcatgcctgtaatcccagcactttggaaggctgaggcaggtggatcacctgaggtcagaagtttgagaccagcctggccaacatggcaaaaccccgtctctactaaaaatacaaaaattagccaggcgtggtggcgcctatagtcccagctacttcaggacaccgaggcaggagaatcgcttgaacccgggaggtggagattgcagtgagctgagatcacaccactgcactccatgctggacgacagagtgagactccatctcaaaaaaaaaaaaaaaaaaaacaagaacaaaaattttatttttatttctctttttcattatagcattatttagaagaatattacttaagtttcaagtagccctggggttttatctcatttttatttctatgagcatattatgagccaaaaatttcatattggcttatgagcaggtaatatgatttttaaatgttaactgtttcacagttgttaagatcttctttatggccaagcgtatgatttttataaatgttccttgaaaatatatgttttccttttgagtttataaggacctctgtgcctatgaaataagaggtattagttatataaagtagaagaaagcaagattggagcaatcaggatagagcccccagaagattccttgcactgcacttctcacatttctgcctgccacactcctcctcctcatttgttctgcctcccatgggtgaacttcatgttcctgaatgagaccaaccctctgctatgtaatggcttctatcccatcttacctgttcatggtaattcttcagttctgcccactctttcctgtagcagcagacatttctaacatactggattgttcctgtcagcatagaaaaatgtatagtttctcccatcctaaaatcccctcttttagccctgtgtccctctctctccctggtacctcatgttttcgtgtcatttattgcaaaacttcttgacagattatctaactgcattgtctttaattcttcccactccctcttcaacctgcttcaaccaggcctttcctgcctactaccattacactaccaccgtccacccctcaatgccttgccaatgatgacagtgatcctcctgtagataagcccactgggtaattctgagtcctcatctactttacttgacttctccagtgctgtccaacagcaatacgatgtaagcctcataggtgatttaaaattttatagtaaccacatttaaaaagataaaaagataggtgcaattaattttaatatattttatttgatccagtatatccaatgtatcatcatttcaagatatagtcagtgtaagaattcttgagactttatcttatttttatcattccaagtttttgaaatctggcatgcattgtaccctaccagcatatctcagcctggaggagccacataccactgggtgctccatagctgtgtgtggcttcctgccaccagttgaacagcacatctcagattctccttctcaagtgctctttccctctctttttgcccttgtaatgaccacttacatgcctatcttgagtgttaccttagtcagtttgcttatatattgtgtgcagctgccttgtgctaggtggtaggctagattctgctggtgcagtactgtatctgaatgtaatatacctagtcttaagctcgtgttgctcaagtcttgttctctttttcgcagtgaaactttttctgaggctttatttcctccctcctctcctttccaataaattagatatttttatacagcaccgtgtattgctttgttatagtccttatcacagttgtaatggtttacttgtgtaatgtttgtttaatgtctggattcatgttatccttgtttgctgctgtatatctgatacttggaacacagtctagcacctaataacttctcatacttcattcacttacatgccaggcatggccctgcttccttgtaatctggtggtggacaaggtggacatgatactcccatcctcatggggctttccttctagttataaaatagaatataaagaagaaaataagcaatataaataatgggattgtgctaaagggctatagtagggtggcgtgagagagtatctgagtgtttgatttagagtaggtgggcagtgccagcccctcttaaccctgttctctttataacagatgttttaaattatcttttgctatcctgaaattaaaattacagagcatgttattcccctactcaaataattttttaaaatctctatcaatatcttaaagtttagcacaatacattggaaggcactctagtcagacgcacctacttagtaaggacttttaattggagggagaacaatcagaagccactccatacaagtggtgtaggaaagtgatagggaaaagttatgtgactgaccttggggaataatgccagagtgaggcagaaaaacaattttaaaaaatataatttccataacctagatgtcttactgtgccttcgaattttttttttaattatgagatagcaataacaaggactaattgagatagtattcctcatttcatgtgtcaccaccaacataatgatgttcagctctcggtctgttggaaggcgcctccgacatcctctgttacgtacgtgcatgcagtagctacagatgcaaactgatacaggtgcattttgtcactgaccaaaataactatagcaagtcttgcccttggtggtgtcattctccaaaatggtgaggaactcttaataaaacttcaaaaacagcatagtataggattcccttgcattacgcgtaagttgcattcctggaaagttcaatgcagagcatactttgtggttttaaacagactttgtttctagagtcagatttttcagtgacataaatacacaccaggacatttgaaagccgtcgaggatgcaggacaattttttattgtgcaggaattacccatgcttcatgtgacatctagcagccttggttataaaaacaacccaccccctgaaatggttctaccccaacgaaactagagcacatatcatcaagacaagatcatgacagtaaattaggtcagagaggcaggcaggggtcaaatcatgtagacagtttgctcatagaaatcatgctatgtaaatcatgcaagttatgatgctttgtattgtacctttttaagcagaggagtgatatgatctggctttcaggtagggacattatatagtagcatggatgaagggaaactaggaaaaatggcaggactctaagcagaatatcatatggtggcctggactatagtgacaactgtgaagatgggaagtaaacacatgaattctggatgtttggagctgaagttgccaggacttgtggagaggttggataatggggaaagggagaagaatcagtgagaatgccttttttttttggctcaggaatcttgttgaatatgatcttttttttctcttcttttttttttttttgagacagagttttgctctgtgcagagtgtaatggcatgatctcagctcactgcaacctctgactccctggttcaagtgattctcctgcctcagcctcctgagtagctgcaattacaggcacatgccaccatgcccagctaatttttgtatttttagtagtgacggggtttcaccatgttggccagggtggtctcaatctcctgacctcgtgatccacccgcctcatcctaccaaagtgcagggattacaggcatgagccaccacacccggccaaatatgatgctttttattgaagtcaagaagcctggaggaagaacatgttttgagggagtacccttttaactatgttgttagtaatctcttgcagacatccatgtggtagtatgatatagggagctggatgcatgagtctgagttccagggagatgacagggctggagatggtacttaacgccccaggactgtatggtatttgttttgccatggcagaactagggggaataacagggcccacccagcacagagccctgcagccctttcacatttgtagattgagtaggggagaagccagtaaaaagaactgggaaagagagaccagtgaggtggaagaaaccccaaaagggcaggatgtcccagaggataagtgggaagaatatgcagaggggctgtgggacatgctatgagaagcctgggaccagagaatggagggctgcctgtggcctcccggggaaaggcaggagccctgcaaaacacatgtctctacaaacggcgcaggaagatgctttgctgggaagggcagcccagtgtgaacctctttctgaacaattccaactccgttctagtggcatcatctgttcgccatgcaatgggaaggggcattagctgacagagtggccttaaccaagcaaattgttttgaagaaatgtataggaatcttcacatgcaaaatgatcatcctcatgagatgctagaaggatggaagattcatgtatcttttatatgtatttttttgaagaagggtctcactgagttgcccaagctagagtgcagtggcgcagactcagcctcctgagtagctgggtctacaggcacagaccaccatgcctggttatttttttttttcttttggtagagaaagggtctcactatgttgcccaggctgcttgaactcctggcctcaagggatcatcccacctcagcccctcaaagtgctgggattatggatgtgaaccattgctcccaactctatctttttttctttttaagaaggagagtgtttattaatttgtgcagcagtaatagaagaaaaagaaaaaaaaaaagaagaagccaaagtttatgctacttaggaaaatgaccatagactctcctggcatggcttaagaggttattctgtattgggaagggccctttgggtacctactgtctccctagctacagatctccagttagtttcagaacttactctagcccagggtgcatggggattaatcccagatcccctctttctttgggaatgggagtagaatgttctctttgactaagaattccataagattcctcccaggctggcaaacgagtcaggccaaaggttgcttcaacttccctccctcctttatcttctgttctctctcagtggtaactgtactctcactcatccaactcatgtatgggtctcctcagcacatcacagagagcagacctgtacctgaccttgaagtgcaggagacagtctcatggctgctcccctggggcagcatggagaatctgtttttttccccagacctccagtcttagggaggatgtcttcaggacaacgaggatttcacagaacatttacagactctgtgaaatgagttttttatccgtagtctaaagattttacctttcctttttatagcccacacatcttgctgacttcactcaagtgcaaaccattcagtattcaaacagtgaagacaaggacagaaaaggaatgctacaactaaaaatagcaggtgcacccgaggtaaggaactgttacgttcatcattaagggaaaatggttaaatagggatgttttagaattgttgacttttttatgaaaaggatgaagtttttatggatcatcagaatcacaactttcttatatatagaaagggttacattagaaacaataatgattaaatgtccccaagaataggacaggagacagatttaaaaatcatccaagaacgttattgtaaagataatgatgattaaagattatcatcaggccaggcgcggtggcccacacctgtaatcccagcactttgggaggccaaggcaggcggatcacttgaggccagggttcacatggtgaaaccctgtctctattaaaaatacaaagataagccaggcatggtggtgcacacctgtaatcccagctacttgcgaggctgaggcacaagaatctcttgaacccaggaggcagaggttgcagtgagctgagatgacacaactgcactccagcctgggtgacagagcaagaccgtgtctcaaaaaaaaaaaaaaaaaaaaaaaaaaagattgtcatcaagtaccaaggaaattaacttcttggaattatatgtacagtcatgttttgcttaacaacaggtacgttcagagaaatgcctaattccctgatttctttgttgtgcaaacatcacagactgttcttacacaaacctaagatggttgtagcctactgtacacctaggctatacaatatagcctgttgccctaagctacaaacctgtgtagcatgctactatactgaatactttaggcaattgtaacacaatggtatttgtatctctaaatatatgtaaacatagaaaaggcacagtaaaaatacagtatagaagataaaaaatgttacacctgcatagagcccttaccatgagtggagcttgcaggattggaagctgctgtgggtgagtcagtgagtgaaggatgaatgtgaagatctacgacattactgtgcactgctgtagactataaacactgtacacaccatatacttaaatttatttttaaaacctttttcagtagtaaacattagcttacagtaacttttatattttataaactgatttttttcggcttttttgactcttgtaataacaattaattttaaatatattgtacagctgtacaaaaaattttctttttttacatacttattctgtaagcttttttctagttttaaaatgattttctgtgttttttactttttcagcttttttgttaaaaagtaagacacaaacatacacgctagcctaggcctacacagggtcaagagtatccatatcaccatcttctacctccacatcttgtcccactgggaggtcttcaggggccgtaacacacatgaaactgtcatctcctatgagaacagtgccactttctggaatactttctagaagccctgcctgaggctgttttacatttaactttttttttttaaataagtagaagtacattctaattaaaaaaaaaatagtaaatacataaaccagtaacatagtcattatccagtattatgtgctgtacataatcgtatgtgctatacttttataagactggcagcacagtagattttttttacaccagcttcaccataaacatgagcattacaacttcaggatggctacggcatacctagcaataggaattcttagctctattatataaatcttatggaaccaccattgtatatgcggaccatcattgaccaaaatgttgttatgtggtgcattgactatatatactgtaaactgagttaatttccacactgtgttgtccatgatattctctgggtagaaattattatgtgattataatagttattattatatgattataataattataacagcagcagtacctgatactgggcacatgctacctgtggttctttacgcagaagccaagagaagctgtgtcattgtcacaaccaaggaagtagatactttgatatactttggttaaccccattctgtagctgaggaaactgaggcatgagaggttggccacatcaagtaattgacaagagatggggttcatacccaaacagtctggatccaaagcctgtgttcttaatcaacaggcaacagtgatttaaaacaagtggcatgagaaagagccatttggcaaatactacctaatgtggtcctttctgcaagatggacaaaatacactcgtgtatgaaaggatctggacagtctggtggcacacacggttgtgctggtgtgtaaagcatgttttttgaagctcatctgtttccatcagcacaccaggattctttggtctgttaacggccagttctctgggtagctttatttgcagcactcctcacttaggctgatgcctcgtcactcttctgccctgtgattctgtgagtttggtgacatctgagggctctaggaactcttgttgattctggagattaagcaaatattaccaaacaatatcaaattttatattggaaagagaatgatttctaagcccttgggcgaacatgctatatgtgctaaaaataatgaaattttattaattttcttttacattagaaattatgatggatggttgataaaaaatttactccacattagtttctgatagaagtcatactttaacttactgattgtctaaattcttcccttaactggagtatgccagaggggccagacactctgaaggaaaatacttttttcatctcttttgattctagaaagtgagccccagtttaagtgatttttctgttttcatctgggtttgcatttgtcacatattctaggaataatgtccttaaatatcagatttcctttctcaaatctcatgacaaatcttgtttcattcccactcttctctgttttcaagtgtatagagatgtctgatgtcatagcacagctgtcctttgcttactgggaagaacaatgaagtctgttttcttgatcttttctccgttagcctctgacagtgacggcaccatccctaaccattgcggagaatatggctgacctaatagatgggtactgccggctggtgaatggaacctcgcagtcatttatcatcagacctcagaaaggtgaggtgctgtttctgagcattcccaattgcgcttctaccaaatatttagctgtgcttgcccctaacagcctgttatcctcttttaggtaactgtaaaaatgaagaccaaatgaataattcagctcagtataatctgaggacttatttttctagggatggtgatccgtttcacaccttccacaagccaagagctgggtttgaatagagcctaaaaaaaacattgtctgtgttttgagctacctacttagaggattttctaaattgccattactatttttaaatacattagtatttttaaaattttgggtttaaataaaattctgggtttaaaaaaaggaatccgttataactcactataaataaagtgtcctttctactttttcttatatatctcaaaagcttagagcattcaaagaagaaagtacagtctaagtcatgatgttaaaaaatcaaagattagaatgaataaatatcctagaaacgtcactataaaagcggtgtggagtttttgcaagcatataatgaggaatgcttttgaggatttggatttctgaaagaatcaaatgaaaatattcccagcaggataatagcatacatagtgtgaagcagggaaagactgagtttgggaattatgggacttaagttcaaatcatgagtcctctgtgacaccatctataaattacttttctgagcctcagttctgtcatctggtcaaacacgaagaacagtaactgtcttctatggtattaggaggataaaggacttatttataggcttggaactatgcctggcacacttgatgctcctagattttagttgtattgttgttcctgttgttgctactagttgagtctgatcttgacactgtatcagcctagactttgagatacctcatctgtaaaagaatgatacctattttgtagggttgttagacacctcccaaggagtaactgtaaagcagctcacgctgtggaagtggggactctgaatgtgggttttgccaataccccttctagcactcacctcagtgactaggatgattatagaggaaaaaaagtcctgaagtgctgtgtggagtgcattcaagtcagcagaattgtattaaacagcgatgaggatagagaaaaggccaaaggtcaagtgaagcagatagaaacgcagaggatccagccttgcccagcagggaagtgctctgtttacaaagcagtttgaggaaggcatggtgtttgcatgggaggtacatgtgagtgttgtgtgttttatagagaggagtcattggaccctttatttatgtatctcaaaagaggtaactgatggtgctgtgccctgaaaacagcagctgaagccatgagccttcgctaagtaaacataaatctgtgtgattccaggacatggcttttctaaaggaaaagtgttttcccacggtgatcacaccaataagcctattcatatatttttcctaagttttctttgtataaaatagagtaatgaagttgctttcagaaatctctacagttactctcagttaaagcctttgcagctataggtcttgatttttcactttgtgctttattttttatttttatttttgacgttttcttcttccagtgtcgcactttatactttaaacaggagtatatgccttacaaatattatttaaatgttttcagataatttctttacataaagatagtaatttaggaaaaatgttaaatgtaatagattgcccatttcctttttagtgaataatttttcatcttttatcttcagtttaccaaaaggtccttgacatacacatttaaaaataacattcggatgtcaggcattaaatgagccttccatgtttaaaacgtaaacatcttcctgtgttgatttcactattagctagcgttttttgctctctagggagaaacatttggatatcaaacatgaaatgcgatgctttttaagctctttgttcatatgaaaagagcattaatgaaaatgcttgtcatgaaaagctagatagggcattggttgtttccaattttatattgtctttataaaatgaattattaaacttggtaattttcttattctcaatcatagcatgtttatgtattatataactatttcatcatagatccctaaggtgaagatacattgcctagttaaaataatattaaagtcaaacatctttagtggattatagtcaaaaatacatgtgaacacagcacatgtacattttttaattgagattttttaagagttcaaatgttaaacatgtttctgcaactctaatgtaccgttttcctggaaacatgctttaaataataattatatatgcccatctgtcttctctagatcataaactacttatacatgtatacatgtatatgcataacatagcatgacagtaataagtgatcagtacattctacatgtgaattgggtgtgcccagatgcattttgttagttctttgatctaccatagttactttggatttataaagtgcttttaaaagggatgttaccttgtcatagtggctcatgtctgtaattccagctacacaggagaatccctgaggccaggaatctgagaccatcctgggccacatagcaagactgtatctaaaaaaaataaattaattttaaaaaataaaaataaaaggtgattttcctggggagaacatagtaagagccacaagccaaattgtcctggactgcattccaccacagtctgcataaccttggccctttctgtagggcattatctaacctacaccttacctgaaagaaagtatacaatcaattttgcagtgttagtaaaattctgtagtaacattttttcagaggaaagtgtatagtgtaatatagagttgtaattacataattgtaagtaggttttctgtgtatagaatgatggtgaatactgtgcatttcaagggagggagtgaatgcttctaagcatggcataaattccagaagacataaaaatagaactgttacatttaattacataattaaaacacttatgtgctgctgaagcgacacaattacataattaaaacgtttcgtttagtacaaggtaacatttttaaagctatgatgacaggggaaaatattatgacacatataataaataattaaaatttctcatttttcaagtgttcttccagctcattcagtaaaagacaacctagtataaaaaagaggaatgtacacacaaatgtccagtgaatatatggatacagtgatatatttcattttatgtttattacattgattaaagaaacctgataaccaccactggcaagacttctggagaatgccagaatgactcatgattgtgtcattgtaaattggtacattttcagaagacagtttaggagtactctgcccatttgtctgcctcctggaaatcagtcatacaaaccactgacctgaggaggatattcactattgcagtgtttataatagcaaaaaatgagcaaaaattaataaatgagggagtatgcatacatgatgtaatactatgcagctgtttaaaaaaatagctctattaatgtattaaaaacctacatgtaaatgtgtgtgtgtgtgtgtatctccaaacttgtgtatttataagcattaaaaagtctggtaagttaagtcaccaatttcagttaatgaacacttctaagaagaatggaagtacatttgaacaaaaacattaactcccagaattagacattttaggtagtgagtccttagggttttcttaaatgctgcttctactgatggtgtctgttgccatttttctgtattccattactctgtttataaaaatattctctcagaatccttctgttgtttatctccttctttacagctgcctttctacccatgcccagctacttagaaagtctcctgttaggcaaaaatataataatggattcctttttctttcaggaaatagaaatttcaacagaatacaaacagaaatcacactaatgtgtcatttgaaaggctatattattaacaatttgggtgtgagtaaggtggtggtgctggtggtgggaggtggtcatgttcatgggataataaacgtaactatcaggacttttcagttactctaaatttggtcttcctggtgtgacttggttattttgcttgaaatagatgttcaaaatgtcaacaagtgatggcttgcagtttggcttgaattcctatgatgtgcagtgagttgtatatatgcagtgttaagcctcacaactatctctgcaaatcagaagaattaaacagtttttcagaaagagtaacacggggtcctaggttgatttatttctttctttaccaaacagtggtcggacagtctcccgagtgccagatactctgctagatattagggatgcctttgggcagcttaagtcttaccgtaaccttaggcaggttaaatagtctgtagagaagtatatgtggcaaatgctctgtggatgcagcagaaacatagaggatgccgctcaatgcaaactgaggtattccaggaagggctctctgccggaaatagaacttgaattgagctttgaaatattgaggaatgtttctacctgaatgaaggaagagcacatttcaaggcatgtgtggtatgttcaggggaatacaatgtgcagtagtatagaatcagggaatagtgacgagtaatactgaaaaggcagattggccagaccaaacactgcatgctttcaacatgtagttgttgagctccttccattttccaggcacagttctaggatagaggatgtagcagcaaacaaaacagacagggttgtgcatgcatggaaatttcatgtaggtgaggacatacgtgcgataaacagagtaaattaatagagaaaataaatactgtagcatataatatatcaaatgatgttgagctgtatcgagaaaaataagacagggaagaaagtaagggatacaattttaagtaaggttgtcagggaaggtcccactgagagagtcgcacctgaaggggtggaaaacagaacctacaaggatatctggctattccctattgaaggctggggagtgctaggaagcatgcctggaacagcagagacccaggtcactagaatgcctaagggggtgatcccagggccagtggctggtcaggatgtaaaggcattgtaagggctttggcttgtactcaagtgatttgggaagccattggagggtgtgaagagaggagtaatgtgatctggtttatgttctagaataagtactctggctgctgtgctgagaatagaccatggtaggttggcctgggtacagataaagtagagggaccaatcaggaggctattaccatgatgtaggcaagtgatgtttgggtcaggggttctggaatgacagtgacaagtaagaggactttggatagagttggacagtaaagccttgcatttgctgcactgggtatggattggggagcagcaaggccctgtgatgactgctggttccacctgaacaatgggaagtatgcaggtgcacccaccaggactcagttttgaatatcagcaagtcccagcaaccttcagacatccagagggaggtgtcatgtagacaagttcaggtcaggggagaggtccaagctagaggtatgcatttggagctgcaaagtgtgggtggtatttgacgctttgaaactgtatgaggttaccaaggaagtgaggttaagagatacaggtgtgagcactgggttctctaatcttcatcaggccagggagataaggaagaaccaataaagaagacgaagaggtgccatgagagggcagaagaaaaccaagagaatatagtacaaggttcgggaggcccagggtgggaagctctcagaaggacagagtgattagctgtgttaagtgctaactgtaaatgaacaattgggcttagcaaggcagatgtcattggagatgttcaaaaagtattttccgtgtatgggggtgggggggaactgattagaatgaattcaagggcaaaagtaaggagaggaaccgtggacagcaagtgtgactacacgagtggtgttaccaaggagctgcctagaagggcaccagagtggtgagtggtagatgggtgcctcctcagcctcccataccaccccacagacacgatacaaagatgacagccagagcagtgtttgtgtgctgagagaagtgaagcagtgctttgtaaattaagctggggtgtttaaatctcatcctgaaagtttttgagagacactaaaatgttaagcataataacttgcttgattgatgaattggtaatttgggaagattattctgaaataatttagctcagatggattagaagacaggaccaattagggggctgttacattaattcagattaaagaggttaaaccagggagggctccatgtttcctggtttgcgaaatgaaggctgagggaaagaaagcgtttccctcaccattgaacgaagtcctcagcttcactgtggtcaggccggcatgagccagtcactgtgtcctgctcagcaaaaagggagctcaccctgaactgtggtagatagctgcctggctcaccttccagccagctgtgtgcacggctcctttagatgacagctccaggacttgccttctctcatacattcattccgttggcagccatgcacacctgtagaattgttttccttctgtttctctgtgcttcctgcacaggtttttctgttgttactagtgagtagttttatcaaagtgcagaatgcctggtcctttgacaaggagtgttgactaatcataagaaacccttcatcttttagtctcctgcaaacgaagtctttcaccaacttagcatcttagttctttattatgattaggcagtaccctttaaacaattgtatctaatactcagtttatgtttgttataaatattgaaaataaaaccatgagaacctaaggtagacagtgtagcaactttctttaaagggtcattgctggaataccagtataggcctcatccttcctccctgattctaggcaccatcttttcaaaaggagtgaaaagagccttatgcatctcttttctttttccccgcagaaggtgaacgggctttgccatcaataccaaagtaagtactgctttttttgtactgttattttgttttgttggaaagtttaaggaaatttctatgctttattattcattttcctaaaaaaattaaattcaatatacatgatcaaggaactaggaaacaattctagaaagaaatcaagtcagttttaaattttattaagtatttaggcttaatcaaaaggttttaatttttcctttaagttctatgggggagctaaagaataatcataatgttgagagcctgttgttaaacatttgcttcatatgttattgctaatctttacaagaacctgaaaatatgtggcattctggctattttacaagtatgaaaattaaagagaaataatttatgttaattttcttgtttatttcctaattttatagtgggcatgttgatctacaaaactaaaagaatcgaatagtaataccaaaagaacttatataattttatattctcagccaatttgctaggaactggggactaagatatgaatgttaaaatctaaacaatcagatacataggtaaacacacagttatagctgtgtggtaagtgctttcagagatatttacactttccaagacactgaagaagaacagtgagcctaagaggccactggaatagagagggtgaggcctgggctttgttctgtccctctccttcttctccatagccagtcccttactatttcctccagttccatgttctaaatggatccatctgcttcactgccttcccactgtgtctcccccgtgtttagctatctgggctacccaagtacacttctgtgttggggttccccaagatctaggagtcacaggactcagctatgatgtattacagcaaatggatacaaagcagaatcagcaaaggatgaaggtgcatggggtgaagtccagggaaaaccagatgcaagcttccaagggtcccttcccaatggaggccacaggacactctgaattccccagcaatggattgtgacgacctgtgtgaaatgttgcctactgagaaagctcattagagacttggtgcctagggtttttattgagggttctttttacatgcactctgtgcctggcatgcatccaaataccagactcccagaaggaaagcaagagttcagcataaaccacattttttgtacaaacattttaggcatagtgtaccatacctgtcaggggatggtggcaactctgcgaaaatccaagttcccagatagcaggcaagggacaatcatgtaaggtcagtcacaggcctgctacattaactcttttctgtgtacttctactaaatcagtctctgtccagttttgctccttagcctgtccgtgctctgtgctacagcttgaggaagctttcctaattaaatatcttacatgacctactcttgctcttaggatactttgcaatattcttaacctagcttgcaggagcccgtgtgattgtttcctgctcacttctctaaccttggtttttgtcactcctcatactattcttcaagtacatttacctttttttcaattccaggagcaaacatcctgtcttttgcctgaaggcctttgccaatattctgtctttgcatgatccactcttcttccaacccccttttcgttgctaagcctaactcatcttctaggtcgcattctacatcacttcctgtagaaacctcattgacccacccccaagccaggagagcatccccatcatgttttcctgtaatagtttctagttattaattaccagagtcctaaacatgggcttttaacttgtctaccctccccagccaacctggcaagttgctgacagccagggtcatatgcagtactgtgggcctcacacaggcaaggtctgcatgtggctagtgcacctctagctttggacagtgcactctacagcatcagcagtgtctgatagaggttcatttggggtcatatcagggcaggaactgatgtttatttagagtacctttagttgtgggaagttaagggataattttggattaaaatcaaagctgggcaatgtggcatgttcctgtggttctgaggctgaggcaggaggatcactgaagcccgggggtttgaggctgtggtgtactatgatcatgcctgtgaatagcaaccacactcgagtctgggtgacttcgtgagactccaccccatttcttaaaacacagacacacacacacatagaggaatcatgaacataggtatgaaagtgagtgaggaaggtagtacattgcaagtgttaacagataaaggaaactaaataaatgaagcaaactttacaagagtggaatttccacaaaccttatagcagcaggacaccattattgctgttgatcagataagagctgaaatccaagctatcgtgagaaagttgcttagcaacagcatacataattgtggcgcagacaagggaaaaccccagtgttttggcagcacaacagggaaggaaatgatgtaatttattgatttaaaatgtgtgtcctctgactgcccaataaatatagttcaaagataagttgtgataaatcatgtagcgcaatggaagagaaagtaatgagttgttagaaaacaactttgattaaatttttatactaaagatataaaatttcaaatatttggagaattctgtaaaaggaacacaagtctatggctgtttgctgtgattattatagagattatacagtttcacattaaatagttgtagtgcttcgaaacgatgtacaagttgagcatttctaatctggaacttcaaagttcaaaatgctccaaaattggaaactttttgaggaccaacatgttgcagcaagtggaaacttccacacctgacctcatgtgacctcatgtgtaacaggttgcagtcaaatatttgtttcatgaacaaagttatttaaaatattgtatgaaattacttttgggttacatgtataaggtgtatatgaaacataaacagatttcacgtttagacttgggtcctatcccctagattcctcattttgtatatgcagacattccaaaatccaaaaaatctgacattggaaacactcttgttccaagcattgtggataagagatattcaacctatactgttttaaatgtcaatatttcatctggaaaaggttttctcttataaaaagatcaggtaactttgacatctaaagactgtgtggctccttttttccctgtgttttgtgctttccaaaagttttttaccaattttttaaacggcaccaagacttttggccaaaattttattttttgtgggtaaatatgtaaaactagtgttaaaccatgtcatgaagcaagtagcaagatacattgagattacttttttaagtatgtaggtaatagtacatattaatgtattgcttgataattttttatgtgccataaatttgagaaagaccagtcatactgtagtatttcatattatgttttagagagcaaaatccacttccaggtgtatgttttttttctcataactttaggggcaatcctttagtgtgtagcatttaaatttatatttttatatttttatttaacccattcataccagattaaattgtattgcattgttttaaattattgtcaagagtatctttctcagaacagttcaacattccttcagttgtgtattttaatttgtgatctttaaagcattaaagcagcctggctattttaatagtagaatccaatttttaaagaaatcacgtatctaaaattttgtcttcctcatccaaggcagttccccacttgatgaggccgagttgcggggtcctggggaaattgcagggcttacagctttgctcttgtctgtcacaggttggccaacagcgaaaagcaaggcatgcggacacacgccgtctctgtgtcaggtaaggggctctaggtagcagacctcgaaaagcactctcatggggtaagacgatcatagatgtctatttttagtataattgcttcgttctagaatagcttatgaaaataagcattctggctatccaaatttgcataattttaccatcattaaatagttttaagtatggctcatagttttttttttttttttttaagatgggacatagataaaataccagatcactcagcaagttgtatagaattccaaattatttttgggttttaatatcatgttaatcttatccagaatgaagttgccattataatttatcttgcaattcagtagaatatactttgcatatttattttaagaagttcaggaaatgtgagacattttaaaacaatttttgtctttcacaatatggtgtttgagtattgctttttaaaaaatatagttaagattctggcatgagcattgtcttaactatttgctggtgcaattaagtgtgttgtactttccttggtatgtttcaaaatagatatgccttttttcccatttaaaaatgtgggaaataaaggaaagggggaggatgagaaagcatcttctgtgggcccatttgatatcttaaaatacatataccatctgtatatgcacatatatacatacgtaaccatatacacacatatgtaatttgttcttatatatgtgcatacatatatgttacatttctgaaataatagtttccttttaactttagcatctcacttagaaaagacccaattcctgtttattttgaatcagttttttttgagacagagtctcactctgtcgcccaggctggagtgcagtggcgcgatctcagctcactgcaacctctgcttcccaggttcaaggagttcccctgcctcagcctcccgagtagctgggattacaggtgcctaccaccacaccctgctcacttttgtatttttaatagagacagggttttgccatattggccaggctggtctcaaactcctgacctcagatgatccgcctgcctcggcctcccaaagtgccaggaattataggcgtgagccactgggcctggcttccttgtttgtttgtttttttaatggtgcacaaatgtcccataagcccttactcaagaagtatttttgcttgtatttgtacacttggcagagatactcaataaaggtgaatgatgtgttatactgtcaaagtactactgcttgagaaatcattgctcacttcctaactaagtagagagaaggttggaatgctagagctggtcttatggaagcttcggggttgccagcatgttctcaggtaaacagttaatcatccttataagcttaatcgtgacttcttggagtagccctagtttccagtagtgacactggggcagtaaacagcactcagcatttgcatttgttcagtctgtagtgggtacagagaattggcaaacttgccaggccctcacggagtttgtaatctagttggagagagaaagaccaccacacatgctacagtcacaggagtctggaggagggagcaactgctgggcatcaaaggatgttctgcaggatgttctgtagagtaggtgagatttgagcagggctttgaataactcgcaggccctttggtccgtcttcttgccaaactgtaaagcagcttttgggatgagccccggggactgcccttttggtgcttgccacacactgtctccacagtctccccaggcttgatcaagagagaagggaaatgtcccattatgttaataaggactattcctggcatctgtctttgggtaacaaagtaatgaaatgtaataaaataggccccagcagtgccttcaaatcttgttcctcctgttttactaatctcttttaatcaatactctccattcaaggtttaaacctcagatgtgtcttttagcagctggtcatcaccaaacttggattttacttcttccagccaacccccactttatgatctcagtgttttcttcttatttcagaaccccattaagaggaataaagttagctggcattttatgagtactgtgttccaggctcaggtttaagttctatgttcttgtacatgtatcatctcatttagtccttacaacaaagggcctataagatagttttcttgttgtaaagctgaggagactatgttccagagaggctaaataatttgtccaaggttacatagctgctaaaatctggagtcattattcaaactctaatgtctggctttaacacccccctgaattacttgtgatcgtgctttcattttttcttcctaggtattccgtaactaggagttcatacttcagtaccttctccatgctcttagattgctaccatgttgatttaaataggcagttctctggtcagaaacttttagtaatcatttagtatccatcagatgaagtttgggctcctcagcttagccctccaagacctttcattatctgcccaccacccacttctccagtcttccctcacctcctcatctacattgttttttagccaaaaaaaagttggtggctgtggctctcccatcctccttatctctgttgttctgcttgagctgttccatccagacttgctcttttcatcattacatataaaaatagtttcactttcagagttagtgatacttcaatatatgactatcacttaggtgatttacaaatccaagcaaagaataagtggtgtccagtggatatttaatgacatggcattaattgttcggagtcctgtttgtccttagtcattcccctactgcttgcttacttaggtggaaccagagaaacaagtgtggtatatttcttttcttttcttgcctgccggccctccctcccttcttcctcccatccttttttccttctgtcatcctgacattcaatggtgtgatatgtttctatcttccacaaaaccataaaacctaaaaactgataagcctagctggccaggaaccagtacattgcacttagccccagagctggtaattcacatttctagggacatctttgttaagccgatacctagaaaaacggtaatcttactaaatcccagggttatttcttacctgccaacctggaaacaccgtactatgtgggatgtagtgctgacacaccaaggtagaggccctactgctcctggatccttgtgaaattctgcatgtgcttctccacagtaagcgtgttcagtgtctaggatagtggggtgaggctgcagtcaactgtatgccagctgcaattacttgtttttctgtcatacgatacttcatttaacccctaacaagccctgcgggattgaagagacctcagttttacatttctgttttacattaatccggccaacagatagttcttgagtgcctgcagcgtgctgagcactattctagatactggagtctgctagaaaacaaagccacgtccctccctttatagagtttacattcttggtgaaagagtcaaaccatagatagtgaattaaaataaagcagatgaattgagagcaacaggaaagttatttaaaattgtgtttctgtatgacagtaaacctgcacatgtattaactcgtgtgggattgtaaagcccttcataattgttaaatattatttaatcccacagtggccttgcaaggtatttattatctctccatttcacagatatgaagaattaaattcagaaaggtaaacaaacttattcagtgtcacacagcttgaaaatgatggcactaggatcggaactcaggtcattattaccctctaggctctattgcctgtcatgagcaatttgagagagtttgctcccctgtactgatgaactgttacactcccaagtgtcaatgaagatggagagtcttcatgggatttgtctggctctcccatttttcttcacaaccaaagagttcttacctgacccaagtctgggttcatatgtcagtacctcatagaaagctttcctgagtactttaagaagatctggactcttcctcctcagagctctatagtgcactgtacatttctctcttatgcatagtcctaaaataaatgtcattgtgttttagaaaccatcttgtccacaaaaccatgaacccattgcatgtaaagacatgttctgtttatctctttattgtctgggatataagttttgtaattgtttttaaataaatccatgaattcctgagtaaggtatggaggtgtgctgggtcttagaggaatgcattctgggtagcgggaaccgacagcagaaaggcaggaatatttggaccgaccagtgtcactggggctctcaagggattacctgtaagcttgtcactgtaaattgttcttgattttttcctaggaatcattataaatggttctagattccttcctaggagatgttgggcaggggtagagaggataaccaacagaaaaagcgaggatctagataactttaggacagtttgtcgctctttgtgggtctctcttgttggcaaataaagcaatatccttacattccggagagaagataccaggtactttttcatattttgttgcaaaataaaggtagttattggatcaccttcagtaagattgcagtgacagttgatgttgaatatatgaacagtgtatctttgaaattcacacagtatttctctacaaaaataagtgtaagattaacagagatttataaaaatatctaacagaacaacatgtgtccctgcctgtattgttctgagaacctgtagaagtcttttttttaagcctaattattaagttataaggaaacttgtgcttgttgtggagctcgggtacaacttggaacatatctgaaagtcaggtgctgcagtctatcataagggacctgtaagtatgctgaaagaggaggtgtggcctctgtggggagggagtgcttaaccaatggttgtgtgggttaaaattaccctagaaatcaggtatttccaaatcaatgagtaaagctgtattttaaatattttgaaggtataaacttgggggttttgtttggtggattattgtgtttgggtttttttttctttttcttttctaaaataacgaagcccttgatcaagcagtaaaaccttaattatgaccagaagtacaagataacacatgatagtaataccattgcattatgcacatggctcttgttacatgtttggactacacatgtggcactagagataatacaagttttctcatttgtatctctgtcatgtacaccaatgcagtgatctttttcaaatgcttggtttgattgtctctaagcccttcatgctaaagggcaattatactactttgtgatagtttttttccccccactttgtcacccaggctggaatgcagtggtgtgatcttggctcactgcaacctccgcctcccaggttcaagcctcctgcctctgcctctgcctcccgagtaggtgggactacagttgtgcaccaccacgcctagctagtttttgtatttttagtagagatggggtttcacaacgttggccaggctgatctcgaagtcttgacctcaggtgatccacccacctcggccttccaaagtgctggaattaaaattagtcgtgagccaccacgcctggccctttgtgatactttttcagtatttgttgcaatttaaataaatttttaattttctaacattattttggttcagttgtttatcatgcaacataatttcctttattcaagattacttttaggtttttcaggttagtgactggaaattattctgaactattaaaacatttaatgaaataaatgttatttgtattttgtattaagctgcttcattacaaattctaaaacagctcacttgtatatgcaaaggtggtttgtaaactgtaaagttctataaaatataaggtggtatagtctataataattactgcattttatctctttctgtgtggtctctgatacactagatttgttacctattcatgactatgccacttataaatacaggtagttatttacatatgcatgtgtcttagagatcatgcctggcccatccacaggcatcattttgtttaaacctcatgagagtcttcgtaatattttcactttacacataaagaaataaagacactcggagctgaagtggtttggccaagttcacatagctagtaagtaatagcctgatggaaatcttgatcttggactagaaggtttgttctctttacattagaccatattgactcatttctttcttttttctggagacatggtctccctctgtcacccaggctggattgcagtggcttgatctcagctcactgcagctcaacctcctgggctcaagtgatcctcctgccttagcttcccaagtagctgggactacaggtgtgcgccaccatgcccagcaaatttttgtattttttttgtagagacggggtctccctatgttgcccaggctggtctcaaactcctgggctcaagcgacctgcctgcctctgcctccgaaagtgctgggattacaggtgtgagccactgcacctagcctatgttgactcatttctaaagcttgataatataaatgtgtggaaggaaataatactttgaaagagtttgcgtgtgattccattaaggttttttcccctcatttattaggaataggatagtgctgactcagttccaactctcagaagtgtgccctgtattcaagtttgaaaaaggttcttctgtctagttttacactctagtttcaattttgataatgctgtgggtttccaaggtagtctctatctgttgctgaaagcttgatttaaatgctagcttttaggaattaaaaggggaaagaaaagaaaaaaaaaaaccttgccctaatttgagagcattgtcacctattatataagtagttcatttttttccctaccaaatctacgggacactgaaaaaattaaaaagtaaaactaaatttaggccaggcacagtgcctcacgcctgtagtcctagcactttggaaggccaaggcaggcagattacttgagcccaagagtttgagaccagcctgggcaacatggtgaaaccctgtctctacaaaaactgtagccaggcgtggaggcgtgtgcccatagtcccagctactcagaaggctgaggtaggaggatctcttgaccctgggatttggaggttgcagtgagctgagatcaccccactgtactccattctgggtgacaaagagaggaccctgtccccccccccaaaaaaaaaaacaaccaaattttaaaagataaattcatttttgtaaattatatgctttgtgacataatttaatcaaattaatgctactaataatttttatgtgcacaaagtagtaggtattgaatgttattgatctgttcctagtacctggctcactggaaattattctggtagtcagtctggtattaggagagactccaaaccactgagaagcgtacagttgtcactgacttcatatggatagactggctgatcgtgttgtgcatgaataaggaagtgaacaatcaaaatagcccagctgtgctgccttctttccgatagccctccctctcccaccattacatcattcgaactccctttgccactgttgagatcggggtgttcttcgtagtcataccgtttcttctctgggttctaaagcagttgaaaagaatacttggaggtcatataggttttgaaatatcagcatcgtatgttgtaaagaagtatcctgaaaaaggacccggaaccactccttcacccttgagctgaactcgtctcagctgcaggcagtgcagacagtgcagacagaaactcacagacctccctggcaaggggtagcctgaggcactttcaaatttttaaaaaggccaaatgaaaagctgagcaataatgagtacaacaaaaatttaaagtggatttttgtttttataaactcttcccagcccacagaaatccagctcagtcttataaattttgtttccagaagagagtattcccatcttctcccaagcagcccccacgctataaaggggaaaagactatatgagagtattagaaacaaaaatgtatttttgtctttataaaataaatgcttcacagttggcagtattgggtatacttggcttatgaaccatcttgatcctctggcgaaacttattaacaataattaataaacttctcaatctttttaaaaaaatatattattaaaacacaaaaagcccaagtatcatcatcttaccaaatataaaataaatattgctaacatcaaaaggcccagttatttttttctttgcagaaaataattttaaagggaatgcttgaaagtttaaaatataaattctagagtttgacctcaagtcttcccccaccccgtttgtagcttatagctatacaataattgtggattaaaatcaaactgcatgagtcaagacaaaatatttttgatgcctttacaaagaggagaccatggaaatgaataaatattaagtacctactatgcttttgaattttgagtttttaaaactttttatggaaaatttcaagcatatacagaaaagagagaatagaattgtatcatgatttttcgtatcatcatcacccagattcagcaactaaaaacttctggccaattttatttcacctctgcctctgtccacttacatacacacataatccctattggttattctaaagcaaatcgaaggcatatttcacctgtaactattcctaaaagatgagactttttttacaaaacattatcagctatccagtcagtgttcaaatatccctgattgtcccattttcatatgtggtttcgtctaaacaagaatcagacaagaagtactttgtgaatttgcttgagtatctcctgtatgtgtcagctagaccttgttggttgattgttactagttgcaattactctgttgaagaaattgtgtcccttgtcctattctcatattctggattaggctgattacatctctgtgatgctgtcttgtttaacctattcttttctggcccgtttatttcccatcagctgcttgttagaacctaaagaagtttgatccagtttgggcttgattccccccctccccacaacaagaatacttcttaggtgatgtacatctggttgttctttgtgatgttaagactaatcaatgggtttaggtcccatcactctctgatccatacatgagaacgttcccatgagcatttcacctaatagttttagcagctgttgacattaatgcttagatttcatcagaggccacaaaatggcaccctgtgaatcctgtcatttcttctccctttgtttagctggaatgcttctagagacagcgttccctcaccagctgcttcattaccctcgggagcaggcttctcctgggaagacaggaactgcctttttcttttcctttatttaccagtttttaaaatagtaaattataccttgctagtcagatgtcattctttgagattttctttttaaaatatcagtatgaatttgtgtgtttttcacattgttggaataggaggttcccccatgaccaccccaggttggatgattactgggaaacctgtttgctggaacacagagttcggtagtgttcagctttgtcagcaccacaccctcatgcccaaggagaagaatagaattgagaggtatggtcaaaggaaaatatcgccttacttatgtaactagaaataaaaaggaaaatgctgatccagttggactaatctcattatgctctttatccctattcatacctgttcctccagaagccccagactcccttgttgctggcataccctctgcataccctctgttttgtctttattgctcagtttcccccaacttctaaaacactacacctctgtcttctgggacttctctatatattcctctttgtcaccttcctctaactaaaactctggagggcactgataccccttggtgcctctgtaaccctactgatggtgtctgagaaccatggtagcactaggactggagatgaggtaagggtgccctgattctcattgccccttccagactactctccctcaaaaacatgagctttgaatctcacatatcagaacaaggctgtcctatgttcctcaaagttctgagcacccagttcactgtcagtgctccagcatcccccatcgtagtttgggaggatttcaatattcatggtaggcaattcctccagcatgtcttctttttttttttttcttttttttttttttccatcgcccaggctggagtgcagtggtgggatttcggctcactgcaacctctgcctcccagtttcaagctattctcctgcctcagcctcccgagtagctgggattacaggtgtgcgccaccacactcagctaattttttttatttttagtagcgacggggtttcaccatgttgaccaggctggtctcaaactcctgacctcaagtgatctgccctccttggcctcccaaagtgctgggattacaggtgtgacccactgtgcccagccccagcacctcttctctccattcttccagtggtgctgtctgctatttctctttcctgtgagacctacactttatctacaactataactctcctataatttcaattttaagaaaaccctctctgactgccacctccaatttttctagcttgtccttgatcccatccccattctgctgtctacatcacatttttttgtcttctctggtttcttaacaagcctaaaacccctgatcaataattgtatccttccctggcctacatccccatcatctctgccctactcgtttgtttggttttaactcacttggccaagttaaagccagctcgttctgtcccatgtctgctgtagcacaactgaaccgtaaagcgaatagcacaaccacattgctttggtcttgctttcaattccatctcacagccactttgaacctttccttaaacctccagcatttgccagccataagtgctgcctgccttgatctcacaatagatgacttgtcctcacccagttagatctactactttttttgagacagagcccctctctgtcacccaggctggagtgcagtggtgcgatctcggcttactgcaatctccgcttcccgggttcaagcagttcttgtgccttagcctcctgagtagctggaactacagatgcctggctaatttttgtattttcgatagagacagtatttctccatgttagctggtctcaaactcctggcctcaagtggtccatgtgcctcagcctcccaaagtgctgggattacaggcatgagccaccaggcccagcccaattaagtctaatttgttaccagtctaccctctatcacttgttacctggtcaggaattttccctgctctactactgttagttttttttcccaacgtgcagcaagccaatcattgtggcaacaggttttgccaaaggggaaagatctcattcccaaggctgccgtgtgaggagatgagagaacaaatgtcaaatatgcctctccaaagatgaagttttagggatatttatgggatagaggagcagggcagttgaaggcatgggaaaaagtgattgggtataaggaaaagtgagttaataagtgatctgcccacacatagtcaggcttcctgactcttcatagaacgcgtgttcagaaaatggtagcattaccctgatctgagggaagagttttcagctctctgatgtcatatggtcatctctcctgcattggcataagcccatttgaaggattggtggcctcaagctgcttgagcgggacaagagctgccccctacttcctgaaaaacaacttaaagcacccattactgcagtgacctacaggaagctaatgggagtttagttatggattgtctggctatttgacttgctagtgggagtttttagatctaagcgactaaaagcaactgatatcatttggatatttgtccctgcccaaatctcatgttgaaatgtaatccccagttttggaggtggggcctggtggatggtgcttgaatcatgaggcagatcccttatgaatggcgtgggccgttcctttggtgatgagtgagctctggctcttagttcacattagaacctggtcctttgaagtatgtggcttttccccaccccaccccttgctcttgcttttgctgtgtgatgtgcctgctccctcttcaccttctgccatgattgtaagcttcctgaggcctccccagaagccaaaaagatgtcagcaccatgctttccatgaagctggcagaactgtgaaccaattaaaacgtcttttctttataaattacccagtctccggtatttcttgatagcaatacaataatggcctaatacagcaaacaaggcaggttaagtttggcaggcttaatcaggttagctctggtttcattagcacatcacccactgtggtttccccgccttagtagcccccttctgacatcactggtccgcttatgatagaagaactctttatgtgagttattgcgattcagtgttgctccttattgaaattgccctgcttttgcttccagaataccatattcttcctacttcactcattattcagcacttcgcgcctgaggatcccaggactcagttcttctgacactttgtgtcagccacagtcacacccttggggatctcattgtgtttcatgacttaattatgctgctgactctcagattgttatcttagtttttcagacttctttcttgaactccagacccgtggccactatgttctcgccatgtggaatctgatgtctcataagcatttcagacttaatatactcaaaaggaactgatattcacgccaagcctgcttctctccccttctccactcactaaatggcactactttccttctggctggtcagattatccttggggttatttttgatgctattctttgttttcttctcccatatccaatctattaacaaatccaaattgctcctgcaaataaactctgtacttatattaattttgcctaagttttttcctttagggtttacactgggaatatatttagaagaccaagtcatagattgaagttgtcctatataggtactctgattagcagcaattacaagtggatttgtaaaggaaaaaagaacagacagttcttaaattgtttaccaaaaattggcattaaaataatgtaactattggccaggtatggtggctcacacctttaatgccagctctttgagaggccgaggcgggcggatcacctgaggtcagaaattccagaccagcctggccaacatggtgaaacctgtctctattaaaaatataaaaattaaccaggtgtggtggcggatgcctgtaatcccagccactggggaggcttaggcacgagaatcacttgaacctgggagccggaggttatagtaagcaagatcacgccactgcactccagcctggatggacacagcaagactctctcaatgagaataataataataataaactattgattgtccattgttctttatatcacagattccaggaatgtgaagataatattttagtggtttaggtgcaggggcgaagatacccttaaaaatggtaatttcctttataggtgtaaatttctctgacagaggatttcaaaataagcagctaaatgtcagaaagttgtattttggagactgatttattttgataggtgtccttttcaacttagcttgttttttaattagattactgacttcaagttggagccctttaatgaactgggcaaataaagcatttgcagttttcagggcctagtatttaaatatttgaaaagcaggcatagctggaaggcccagcataaaaatcaagggcctggtatggtggctcacacctatagtcccagcacttcagggaggccgaggcaggcagatttcttgagcccaggagttagagaccagcatgggcaacatagcaaaaccccgtcttaaaaaaaatcaaggaccccactttttgtttttgtttttttttaaggcagggtctcactccgttgtccagactggagtgcagtggcgtgatcttggctcactgcaacctccatctcccgggctcaaacagttctcacacctcaccctcccaagtagctatgactacaagcacacaccaccacgcctgactagcttttgtatttttgtaaagagagtattttgccatgtttcccaggctggtctcccaactccagagctcaggtgatctgcccacctctgcctcccctagtgctgggattacaggcatgagccaccatgcctggttcccacttttacattgaatcctggttcccccgaaagagggaaataccatggtgttacctgaaaggagttctgatccagaccccaagagagggttcttggatctggctgaagaaagaagttgaggcaaatccatagggtaaaatgaaagcaaaggaataaaagaatggctactccataggcagagcagcagtgtgggctgctggactaaggatacttacagttatttcttgattatattctaaacaaggggtggattattagtgagttttctgggaaagaggtgggcaattcccagaactgagggttcctcccctttttagaccatacagagtaacttcctgaccttgccatggcatttgtaaactgtcctggcattggtgggagtgtcttttagcatgctaatgcattataattagcatatagtaagcagtgaagatgactggaggtcacttttgtcaccatcttggttttggtgggttttggccagcatctttaccacaagctgttttatcagcaaggtctttattatgacttgtatcttctatcaacctcctgtctcatcctgtgacttagaattcctgacctcttgggaacgcagcccagtaggtctcagtcttattttaccgagcccctattcaagatggagttgttctgggtcggatgcctctgataataggaccacgctacacaatgttccacagtgttccatgctggagagacactcctgtgatgctgatgggtgacccaacaccaatcagcccattctgccatcttccataggagtcttacccgttggtggtgagtgtttccttagcctccaagtgttcaaactgcttttcttatctaaatgtgtagagaagtaagtagccctctgcagttataaccattcactgtgaccactgtcagccactccaaaactgcagcttttgctggtgacttgccaattgatcacacattgccacacatacaaagttcaagttctccctcacagtatggagtaatccctgtaccgcaaaagccaaagagaacaagtaactcagtacaaaagagagcagagaatgagaagagtgacatcgtctgtcatttttcaaaggcttcctgggagccttctaaaagggaataggtaggattgcagtaagctagttgagactgaggtaaatctgaaccagcgtaatcacatagaaagttggactggtgagaaaggaaaagctgctcagagcagcctgaggtatgtgaggtctgcaaaatttatcagtcccagagaggcaggagtatggggcttcagtcatgccctcctcacccctatcctgcacccgggcccggagcaattgttgaaaggcatttttttcttgactagtggccttacccattatcttcacattcctagaatttgtgaaacaatgtaggaactctctcttttcctttaaaaggaaacaatattctgaatgactcttgacatcatttagaataaaagccagtgcccttaccaggagctaagaggtcttagacactctgggacctcactgagtgcatctcagtgccacctcccccttcccactcccaactcttcatccacctcacctgacctccctgctgctcctcagcacgtgttcacactgacctctgcagagccaaggcctgtgtgtgtgctgcctggcctcccctgatgtgtgcatggccctttccctctcctcctggaagtctttgcagatgactccctccataatcaccatatttaaaatggtagccccacttgaaaatattccttctgctggtttttccctagcacttacatgttgacatgccataaaatttacttattttatcttccttctcccttactagaacgtaagctcaataatttgaaagtttgggtttctattttgttcactgttctaactccagcacctacatggtatgcctagtttatggcaggtgttcaataattaaaatgattatcttgaatacaataaaagtcctaatcctttttgtttttgtttttatgatgtgtgataatattcttggtattactcaaaaagagttgtacttttttaaaaaattcactttttaagttagtataaagaatattcagtccagtttagaaatgaacagtagaaaagtaagaagagctagcacttgtggagtggtcactctgttctgggtgcccagagaatcccatggaatcctttcccaacctccttaatggaggtagcttctgttataaccccattttacaataagaaaactaagcaacagaagttgagcagtgtatccaaggtcagaatgaataattgagccagtatttgaatccaaactgtctggccccagagctagtgttccatatatcttttatttttctgtaactttacgcttggagaatagttgtaagaatagtaacgtgatgtctcatatgttctttcctccatttcactatatttatattttggctcacttgctttatcactctatgggttttttgttgttgttgttgttgttagttttttccttgaaccatgtgaaaacaagttacagacatggtgctgcttataaacatttcagtgtgtgtttaagaccaaagatatcatcttatgtgatcagagtataattatcaaaatcaggaaatttaatactgaagaaatgctcttatccgcagtctaaattatttcataccagtaatgttccgtatcgctgttgcttcctgatctttcccttccccagcctccagtccagaattcatcctgcatcacacagtgcatccagttgtcaggcccatcttggcgagacagggtctccctctgtcgccaggctggagttcagaggctctgcttctgtggtccaggctctacctcctggctccagcagtcctcccaactcagcctcctcaatagctgggcccacgggtacgtgactccacacctggctaatttttgaatttttttgtagagacagggtcttgctatgttacacaggctggcaggcccatcttcttaactgagagaccagtttatgctttcctctagggccatcatatacaaagtccagaaatttagtgtgtgtaaaggtagcttttaagtcaagcaataagatgaaattgtcagtaaatgttactgggatcggccgggcgcggtggcttatgcctgtaatcacaacactttgggaggccagtgtgcgcagatcacctgaggtcaggaatttgagaccaacctagccaacatggtgaaaccctgactctactaaaaaaaaaaaaaatacaaaaattagctgggcttggtagcaggcgcctgtaatcccagctacgcgggaggctgaagcaggagaatcgcttgaacccggaggcagaggttgcagtgagccaagatcgtgccattgcactccagcttgggggagaagagcgagactttgtctcaaaaaaaaaaaaaaaaaatgttaataggatcaaagcataccgtttgaaaaatattactgaagtgtacatttctgttctcatttctgttgctaatatattgacaatgtcaataagattgttaccatcttgatgggcaaacagtcctgacccttgttcttgggtccatacttctgatctttctttatgataccccgtgagtatgcagttaaatgttgatgttacctgtgtctgtcatttgttaatgactgctgcatcttaaagggctacatccctgcatccctggctttgacttcactttcacacttgtccactattgccattaccatactgcagttgctgcttattttctcattttgctatatgcttctggagagctgagatgtgttttatcgatccagctttttgactctaaaatgagctttgagtacatgaatgagtgagcaaatgaatccgtaatgctagtagaggttttgcaacctgtgttttcaaagatcctcatcgccagtttttatgttaaggtaatttatgtaaagtatataactcaagagctgtgagtgtgtctttgctaatgatttggggaaagttgttcgtaaaactctttcacaaatgaagatctgctatttttctgctatggttgaatgttaaatgttcacaagagtcttgaattatttattggtctttgttttttcctgtgactgttgtcatttggaaaaatatctgaatattcaactggctggctctacagagctgggagattcttacgtcttgtttctgtatcaagtgctaatctacaggaaattaaatttaaaaatattagtatgttttttaaaactcaagtcaatcatagtaagaaataaggcatgccaatagtcaaaataaaagcattgcaattttgtatctgtttttatagataagcctttaaatgtaacaaaagttgtcttttgtattgaaataatttgtttctatttttctctttcccctcttgcctctttataaaggagtcagtcactgccaacataaagttaagaaagctaggcgctttctccctttggtcttctgttcccatgatcctccttctacgggtactgcactcatatttgcacaggctctcctattaaccagagcactccagagaaactaactctaacctgatgcttatagattatcctgaacagatcatagctttattgaatattagtgtatgtgctgttcattgttcagaagcaataaggggattggggtgggggcaaggttttatgtcactgtttttgggttactctcttgaatacaagattttttgtttgcctgtttgctggtttttaaatgcatgacagggcaagaagtcgcttctcagtttcatttgtgttgtttgagtgttttcccacagaggtcagcaggatcacactttttgcatcatggatttcctaatatagcatgcaactgaatgaaggagaatggccaaagtgactccctagttgtctgcttttcatgctttggggacagatatttagggctgctgcatagtagaggcagctatgccatttggagcattttctaggaaagcaaagattatttataataattgaaacagtaatttctccagactattcaaaacaaaatttattctgtgcaaacttaaatgggaaccttcgttgtcagcagagcttcaagtactgcactccccacagtttatagtagtgggcctggcctatgtctaccttataatatttaaatcccactggcttattggaatgggcttgctgagggcttattctcttcttgtaactaaacatacagattaatgactagtttgtttgcatttttatctgaggggacacaagttccctttgaggaaggtagaaaccatttttaaaatttaattgtaagaggcagtcaaattaactttgcttagtgtggcagaatccagtttacactctgtaatactttagctgtgtaacttcatgtaatacattgacagctttaaacttagcattatgccctcaaattcaagtaaacatactaccactacagtctttctttatcttttgaattaaaccctggggggtaattgttttttatttttcttacactttggtttacttgtcattttaatagtgttttcccctctcttccctcttctccttcctatgtctccctccctctgttccctacttccctttctttgcatgccacccggatctgcagatgaaattagtggggacggtaatatttattttcacatttgtgttactgctatgagataattatttatgaaaataaatatagtttagtatttaatgaaaggcaaaatgtgcttttgatccaacagaaccaagtacaaaatggtatgcaaaatattttaaaaattgcttagggctttggcatggaaaggataactatcaatttcttaatcacattttagtggtaagtttgagttgtatgtattcctagtaaatttcctagatttcattattaaaactttgagagttcttaaaaaatgtcaaaagcaaaattagtaacacttgaaagctgtaaatggtagcggtccatacactctgtttcccaagtgtggtatctgtgtgataattcttagtttgggaatgagatagtagaaaggaaagaatgaaaaatgattttaaagactcacagaaactaacggaattagggaaatatcagcaataatgataattggtttttcaaatagttgatagcacttaaggtagaaatttaaaaattttaaatcacattctatgtcttacatttcccatctacttcatatactgcttgcatgaaactttatcctcctttatactaaaggagtaagattttataaactaaaattaagaaggaattgtatttttttcctcctgattaaatgaaagaatgcttttactgaagatttcacctatgttcatttttgtaataggatagagatattgataacgagtataacgagctaagcagtttcagtaaaaggtcttaaaagtgcgtgtttttcacaggatttgaggtcagagatttgagcttcatttttagattaattctgtgataataatcaattagcagctgcaattcatctagagctttctgcatgtgacactttactgacttgattcctaattctcacagcagtcattcagaatatcactgggtattgtcctcactgttttgcaggtgaggaaagtgataatcagaggattaagagagactctaaggctgctagaggcaagtggtcaggtcttaggctccagccttgccctttttccactgccccatccagtcagcagctgactagctgagggattacaagcaaattgcttcatctcttgggtcttcatctgggaaaggtctcaagtggttgttgtgaggattactctgtaagcatcaaaatttagataaatgtctgcaaacacttgtatgtattttcccacctatgaatttctcaatactatgaattagccagggcaagtgtacttaacccattttacaggtgaataagctgagccttaagggtagtcacttggtcttggtcagtaaggcccatggaccaaatatggcccacctgtttttgtatgctaccgtttcttgcctgtgaaatagggatggtgatcatagtacaacttcaaataattttgctgaggattaaatgacaatatatgtaattatttacaacagcatctagtatatggtaagctcccaataatatgattagtagtcaatgtcattattaaatatagaatgcagacctagcttcatttgtgcccaggcctttgaacttgtttccttttttctttgtattttccttatcttttgaattaacccttggggggtaatttttctgttttccttaaactatgttacactaacatgtggagggcccaggaagtttcagactgtactccaatttttagggcccttgaatatgtaaaaatacctatcatatcagtgtaatactatcttaacaatcctaaaaaccaggaaagaaaagcaaaatacagccaaatcaatgtcaagaattcttgggaaggctgggtgcagtggctcctgcctgtattctcagcattctgggattacacttgagtccaggagtttgagaccagcgtgggcaacatggcaaaacctcatctctacaaaaggtacaagaaattagcaggcatggcggcgcgtgcctgtagttccagctatttgggaggctgagttgggaggatcacttgagcccaggaggtgaaggctgcagtgagtcaagattgcaccactgtactccaccctaggcgacagagcaagaacctgtcttcaaaaaaaaaggaattcttagaaatatacaccagatattaccatacatatgaaactcatatatagagggttataaacttttgcagatcatttacctgcaacattgttgattttactccatgaattctctattcacattgcatcatagtacacacacctgcaacccaaatataagtaattcctagacagctttgatacatccccagagattttatgtacaattcatccagctaaaaaaaaaaaagaaagaaatttacaggttttctcttgtgattgtatgaattaattgaaatgtatgcaacatgatattttccacaatgtgtgctagcctgatatatattagcctatttattttactccttcacaattattttagaggttggtatctctactgaggattttataaaatgagacagtccttgaaggactgctgtcaaaccaaaaagattggctgagagtatcagcacacaggaatcctaaatcctcaactgccaggtccctttcagagagccctcagaagaagcaaaacaatcagaggagttactgttgcttgatgatctgttatgtgtagggcacatctcaactttctgtcatgtctcctgtaatcctcataacagtgctacaaggcagatgatgttattttacccacgagggcacagctgaagcattgccaggtgaagtgactttccaaagctcaagcagttttccccaaatgggcttgtgtattttgtcacgtgtattgcagctctaccattcacttctgtgctgcctcacacagattaaatcctttgcctcagtttcttaggggtatagcgttcctttactgattgttgcagtgcattcattcttttggtttagcatgtgtttcttgagggaccttctctgtgctagacactgttttagctgctgaggacacagtgttgagcaagatacgtgaaggttccactctggtggctgttccattctagagaggtgggcatacagttcacaggaaacaaaattatatcaggttgttataggtaatgaggaaaatgagtcagggaacatgattaagaacagtgggatgggggcaaattagtctgaggagaggtctctgaataggtggctaaaaccagaattggctctaggccagcataagctttggtgcatggtaaagccctcagttggaggtcactgccactggtgttagcagcagctttatgcccttcttcattaaggcagtagacacctgtcacctgatagacttgggcttctgaacaggcttttaatgaactttgcagccatatgaagctgtggtgacaagtgcaaaacatctgcttcgtaacaccatgagctacgtgcagggttgtagagacttttcagcagtttggataacagggcagctggggaagggaagcagaggtgcagagtttgagtggctctcccaaaatcctgctgcagcagggccaattcatgtgctttactcctaaaggcacgtgctttatatgaaaggaagcagtgagggtgctagggctgttgtgtggaaagacagctttagttgcattcattttctgaggagagtatcacaaagttgagcgtgttaaactatggaatcaaaagagaaatgattgcaaatggccatttgtgtggcttctgttgccttagctgttagagtagattcctcccctgcttagtcttttttgttgcaagtgtgttagcagcttccttccgtccccaaattttctttcacagggtgttttgataagccatcttacacagaagcagagctataggcctacagatgccaatttactgttcttagtatttgctgaaaacagattaagagggagaatacagaaataaaagaatgtatgatttggagtctattaaaacttttttaatcttttaagtattcttataaacgtataagaataatatagattatctgcctgtcatataggacttaggaatagtttacagataataactgtcttaaagagaattgatttattggtgttataatctgcttccccaacttttttttttactgtaatcacttttaatgatgattacataataagaagtgaattcttccacttgtagatttgatctcagtcattaccatagatgtggaatgattgatatcccagtgactgtaaaccatatatattctctatttgctttgaattctgtacctttaatatctgaatgcagtaataaggcgtcacagaagaaagaacttgtagcttttcgtttcattggtgttaaacaaggatgctaggtcaaagtatcaaaatagagctccttggaaatgatgcatcacaaagtcctgtccctgctttactgactcacaagaatggcccagcagttaaaatccttatacatggagcagctgaagattttcgtttttctagaaagagaaaaaagacaaggctgaagtgattttttcagtataggtgttaccacatgagtgactgttttcttcagatgggtatttttaaatttcccattaatatagtggtggacttttaagttggtgtattacccaaaaagagtaggtagatacattggaacttcttgacgtgatctcaaaaaacctcattgtaatatgctgcttattctcctttttttctttgtagatctgcccttttgacattaatgcctaaaatatctgagtttaaaagttaggaaacaaattcctgttgcatttctcaaccctgagcaaatggaatgaattagcacagttaatctcaaaaattaggtaccatttattttctaaaggttccgttcagattatgctgtcaagtctaattgttaataaaatcagataccgtgttttatagataccagtcttatttggagaaagcccagtagacaactgtagttttaaacatgtatttggtgtagttgaggaagagctttgcggttggtagattggttaatttgaagcatatacatagttgtttcatgtcgttctgttttttacaagggctttctgtgttagccctgtttgctctccgataaacaagtctgtgtattataacgtattggacaatgatgtcacttttatttccataaatgactcatgtgtgagcaaaatttgagtaatagtgttttaagaatatttcagcgtagtagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaagtaagtaaacttctgattttgttcttgctcagacttgacagatgcctccttgcatttaaaagttattgatacttactgtctttttagagccatttttaatacttccttggatgctgaacagaaatattcttttcaacctttaccattctatattacttacatatgcccactctaaggtcagaagcctaaaactcaaatatctgtaataatttttagttacaggatttttgtaatcttgttttctgactctatcataatagaacctttattgattagggtattttctgtctgtagaaaattagtattattggttaagtatatatgtgaatgtgtgtgtatatacacacacaatatatatatccatatatgtataatacacatacatacacacacgtatacccatactttcacacacatatattcaaaaatttgcattttccccctttaaattgtttattctttgttgccattgactaaccaatacaaatagctcataaccatcgtcagtttgtacacctcagggatgggaggtgtggggagagaaacagaactcttaaaggaccttcatacagcctggaaatgtcaagattctgcttctctctgtgatgtgcagcttgttgattaaggaaaatcttgaagccccaggtctcatgttggagtgtatagtctccagatcttgaattagataaactcttgaaatttcatttgcaaaaagaaatttatttcttaatttcattttcttatttttttaatgttccagacagtactgacttgagtataaaaaaaaaaattaaacctgccttttaaagagtcttcagaagtcttagaaattaactcaaaatctgaatgtcctgatttcagtagagctatatatatttgtaaaataaatgttataggtgccttattctatagtataaatattcttgtaaatattcttgtttggattttctgtatacattgaggaagcattaccggaatgaagagaaacaacccagtgttgcctttcaagtgtgcattgtgccctgtgggcccatgtcccctttcaggagcttcttgactagagagttactcgaaagaggccagagctgaaacttgtgtgtacattttgattgccagtatcagtttggaaaaatgtttaaacttaggtttaactttttggcatggtggcgcacatctgtaatctcagcactttgggagacagaggcaggagaattgtttgagtctaagagtacgttaccaacctaggtgacataacaagatcctgtctctaccaaaaacaaaataaattaggcaggcgtggtagcatgcacctgttgtttcagctactcaggaggctgaggtgtgaggattgtttgagcctgtgaggtcgaggctgcagtgagccctgattgcacaactgcactttggcctgggcaacagagtgagaccctgtctcagaaaaacaaaaaaagaaaaaaaaaacaccaaaacacttgtttacttttttaattagccatatagacacttgtacattcctgcagataatccagtttttatttgtatatttattatttatagttgagcagtaaatgtccaacatggctttcatccatacctgacaaaaataagttacaggaacttgatgagataggaacttaaaagcattgtttaactaacattgagttaacttgaagatatttagtttttacttgtatttagttctttaaaattcatatttgtgcttaaaatattttaaaaattaagtattgttgaaatattctcttcaagtttgtgttgttaacctaattgctgttagttatttctaagcaaggtcttcaatttttttctctcttaattgcaatacagaaagctatggaatagatgaaggtaacaggattcctttaaattaactgcatttgcttgcaattgcaacctgtggagtgatatgggatgtttcagtttttggttaacttatttttaaactatttgtcattggtttacttatactgttaaatcaatggaactactagctaaagtgattttaaagaggaaaataactgtctaaattttgggttgaatgttctgtgttgtttataatttgataaaccagggagaacatgtaaaaatatttggctcttggtgtatttcattggtgattacactactggaatatatatgcaataacctatggagatgagtttcttacctgaaataaatcaaaataccaagtagtaaatgggttataattgaatctattacattcttaatgggcattttctttccatgtgcctcaaaaacctactgaataatcgattttgtatattacaataacagtatattaatttgaggcacatggtctcaaaagtatatttatgatttataatgttgatacatccaaccttgattctgagtcatctaactttgaaattagttttaagaaactacctctttaaactcttttagctccatgagtaatgtagagataggattatcataaagtggaaaactcttaaactttcaaaacataaagtttacttatgacataattttatgttgcttccatatttacaaactgtagttatttgtaaaataattgctttaataactgtgcttttatagccttcatatattaatacctaaactaatagttcttaatagttaagcatataatttaatagttggggcaattatttagaaaactatcaaatagatataaaataaatcggaaatttaaaaactcctaggaacaacatgaaaaatatctacctttagtagaactcattgtttcagtagttcttctaataccataactaattacatgaattcctgttaaaatattgtttaagagaattccactgtgtttaaagcattttcatagattgatgtgccacagatgaaattttacttatggatgatcaagaaatacgtcaagtgttatttctacatttggaatattttacttaagtattgatgtgtgaattatgttttacagccagggattatgagattcaaagagaaagaatagaacttggacgatgtattggagaaggccaatttggagatgtacatcaaggcatttatatgagtccagtaagtcttttaagactaccaaacaactagactaattttgactatttaagtttaaattgcttttgtttgtcttcatgagtccttagttcttctaggtattaatatttacgggtgtcttttataaagctcttcataaatgtcagcttatacttggcgtattcagaaaccaaaaaatggcaacattagctcctacaaggctgggcctgtcttttattcattttaatctttcagcctttgtcatcagtaacagtttttataggtgactgttctttggatggaattagcaaatcagatgagagtcagaaacagccagtatacctatttacctgcatttttgagaaagaaatgttaatttgccccagtttaccctccaaaaaagatgaataaattttaaaaatgattgctttaataatagcttaatgaagtatcatttgcttactatgaagttcactcttttgaagtgtacaattcagtgcttttcagtgtattcacaaagttgtgcagctatcaccactgtcaattggaacgttttcttcacctcaaaaagaaactttatacccattagcagcagttacttcccattccacccttccccagcctttggcagccactcatccactttctgtatctatagatttgtatattctggacattttgtataaatgaaacatataatatatggattttttattatcagcttctgcttagcataatatttttaaggttcatccatgttgcggtatgtgttagtacttcattcctttttattgccaaataatactcttttgtatagatatagaccaccttttgtttatcctttcatcagttgatgaatatttgggttgtttccactttttgactattaaaatgtttctgtgaacattcatatatgagtttttctgtggatatatatatatatgttttgttttgttttgttttttggtgagacggagtcttgctctgtcgccaggctggagtgcagtggtgtcttctcagctcactgcaacctccgccttccaggttcaagtgattcttctgcctcagcctcctgagcagctgggactacaggcgcgctccaccacgcccagctaatttttgtttttttagtagagacggggtttcaccatgttggccaggatggtctcgatctcttgaccttgtgatccgcctgcctcggcctcccaaagtgctgggattacaggtgtgagccatcgtgcccggccctggatttatgtttttagttctcttttgtatatgcctattagtggaattgcttcatcatatggtaactattgtttgtgtgtgtgtgtgtgtgtgggtgagagagagagtcttgctctgtcagtcaggctggagtgcagtgacgcaatcatggctcaccgtggcctcgactttctgaactcaagttatcctccctcgtaactaggactacaggcaagtgccaccacacatagctaatttaattttttttgtagagacagcgtctctctacattttccaagctagtctcaaacttctggactcaggtgatcctcctgtcttgacctcccaaagtgctgggattgcaggcatgagccactgagccagccaactttttctttctttctttcttttttttttttttttttttttttaggacagggtcttactctgtcaccaagggagtacagtggtacaatcatggctctctgcagcctcaacctcccaggctcaagtggtcctcccacctcagcctaccaagtagctgggactacaagtgtgtgccatcattcccagctaattattttattttttttagagacagggtcccatgatgttgcccaggctggaatgtttaactttttgatgaactgccaaaatgatttccaacacagctgtaccattttatattactagcagcagcgtataagactgcagatctccacatcttcaccaacatttgttattgcatgtctttttaaattagattggtgattttttaaatgacactttagactaatagtacaatcatgtgccgtgtgtaaagatggggatactttctgacaaatgcatcgttaggcgatttcatgatcgtgcaaacgttacacggtatacttacgcaaacttagatggtctagcctactacacatctaggctatataatatagcctgttgctcctaggctacaaacgtgtatggcatgttactgtattgaatactgtgggcagttgtagcacatggtatttgcatatctaaatatagaaaaagtactgtaaaaatacagtataaagtataaaataacggtacactcatatagggcacttaccatgaatggagtttgcaggactaggagttactctgggtgagtaaatgtgaaggcctggattatgactacactactataggctataaacactgtacgctttggctacgttaaatttatcttaaaaacttttcttaatactaaattaaccttagcttattgtaacctttttacatcatgaaccttttaagcttttttctatttaaatttttttaattttttaaacttttttcttaactaagacacaaacacatacattaggctaggcctacacagtgttgagatcatccacatcactgtcttcgacctccacaccttgtcccactggaaggtcctcagaggcagtaatgtgcatggagatgtcatctcctagggcaacaatgcctccttctggatacctgcgaaaggccctgcttgaggctgttttacagttaactagtttttgttttgttttgttttgttttataagtagaaggggctggtgctgtggcttatgactgtaatctcagcactttggagactgaggcaggaagatcactcgaacccaggagttcaataccagcctgggcaacttagtaagaccctgtctcaaacaaaattttaaaaattaacctggcctggtggtgcacacctgtagtctcagctacttgggaggctgaggaaagatcatttgagcccaggaggtcaaggctgcaataagtcttgttcacaccactgcactccagcctggacaacagagtgagactctgcctctaaaaaataaataagtaggagtacactctaagataacaattaaaagtgtagtatattagaaaaaaagaaaaacaaagtatagtaaatacacaaaacctgtaacatagtcgtttattatcattatcatgtattaatcactatacataattgtatgtactatacttttatatgactggcagtacggtaaatttgtttacaccagcatcaccatgatcacataagaaatttgatttctgtcatgtcactaggcagtaggaatttttcagcttctttataatcttatgagaccactatagtatatgtggtccatcattgaccaaaatgttactttgtggcacatgacatgcttgctcaagaaactgtctttgaactagaatagtagcaggtgaacagagatggctctaataaagttacaataacagagaaaattgactcttattttatacccctgcttggaaactgcaaatgaccatttttttcttcagtaactccatgtttatgcatttttaatgtcctttacacgtgtactagtgatgctctgagcattacttttataacccaaaagttataaaagggttttttttaatcaaagataacagataattgccaccagtaaactaaccaaattagttcacttttggaagcctttactcttgtgcttatatcaaattgtataatttgttgtatattttttgctgttttttactcctttttcaattttttttaactatgggtgtattgtctatattccacagtctcttaactctgccctttgaggcaaagtagagtagaaggagcaatggatgcaaatttagtgaaaaagaaacaaacagacaaatttagatctggctctgcctcagtttgagattgggggagataaggtgactacattactggaatgtaactaaattatctctgagcttcctataatctccaaaattcctgataggtaagcattctaaagttcccagagtaccatgacttaaacacaggtaatagcagggttagtggactttatttcattcacttttaaaatacgtaatccattttagttgtgaaaatacaagataattttttaaaatagccataatctaaatttacttttttctttttttttttttgagacggagtatcgctctgttgcccaggccagagtgcagtggcgccatgtcagctcactgcaagctccgcctcccgggttcacgccattctcctgcctcagcctcccgagtagctgggactacaagcgcccaccaccacgcccggctaattttttgtatttttagtagagatgggatttcaacgggttagccaggatggtgtcgatctcctgacctcgtgatccacctgcctctgcctcccaaagtgctgggattacaggcgtgagccaccgcgccccgccttttttttttttttttgagacagagtttccctcttgttgcccatgctggagtgcaatggtgcaatctcagttcaccacaacctcccgggttcaagcgattctcctgcctcagcctcccaagtagctgggattacaggcaggtgccaccacacccggctaattttgtatttttagtagagatggggtttcttcacgttgttcaggctggtcttgaacccctgacttcaggtgatccgcccatctcggcctcctgaagtgctgggattacaggtgtgagccgctgcgcccggcccataatctaatgtttactaaatgtttgttgaatgaattccagtccccaaggattcacattttgttaaatatctttttctttttttttttttttgagatggagccttgctctgttgctcaggctggagtgcagtgatgtgatctccaatcactgcaacctctgcctcccgggttcaggcgattctcctgcctcagcctcccaactagctgggattacaggcacacaccatcacacccggctagtttttgtatttttagtagagacagggtttcaccatgttgctaggctggtctaaactcctgacctccagggacccacctgccccggcctcccagtgtgctgggattacagatgtgagccaccatgcccggcctgttgaatttctttcttgtgtatattgtatatgtttgttttgtttttaatgtgggagtctaattttatagtgcaaagcagtctgttcatttctcttaagtttctattataaatcctttttctagaacatgttctttagtattctgtaaaatcaaataatattttatcaagcattcttgatgattggtcaaaatgtaacgtggcataaatttcatgggcaaggaccaaccattggatactttatttaaggttcagttaattctttgagcaattttgtaatcattttctgctctgtgacagctactgtttctaggtggtggggggatataacttaattctacccaaggcacaagttgacaggcaaaaaagacgtacgctaaatcccaagagggtctgagaaaaacaatgcatggaaaatgggaggtcaagatgctgttccacatgggatgctcagaaagaacttctgacaagacgtgttagcagagctttgaagtaagacagggagtggagcttgagcattctcatggggaagcctgttctaggcagaaggaacagccagtgcaaaggccatgaggcggggcaggacagtacaccaccaggaggacggtgtggccgcggagtagagggataggaaacaaagggaaggcaaaaggaaaccttttggagactaggagagccaccaggggacatgtgtggggccatgtgaaccttgaggtaagaattttgaccttcattctgagagtcagtaaacatgaagtttatctgattggcacacatttttttctttattaggcaagattatcaggcttgttttttctttccttcaagcacctgctgatcactggcacattctctcattattattcgcagccttaaaatccgttattaaatctaattttctcttaattcatcctagaatagcttttttctacatttatttgttaagatattttaaacgtctactagctgttattaattcagagcctaatcttgcatcccttgtctaggcatagtggccacaaggtggtattttcattgaacaatgaaaaacttctcttttccctaaatattgcctgtattttacgaagattttaaaaatctattttgagtaattaccaattagtaactttttagtttttagaaaaaaccctttgcacacgttctggtcttacttactttgaactgacccattctccagcagtccgatctctgtaactggcccttctaacagttcagcattccctagacctctgctgtccactttaggggccactagccgcatgtcctattcgccaaaccgaaggctgagcctcataatctgctcatgttggcattttgtatatttgccagctatggaatcttacacttagcattcatttgaaaccctaggtctttaaagagcagtattttgtttgcatttccttagactgtcttaataaagcaccatgtttactgagtatttgattagttgacaggattaatgatggttttaaggtcttatcaaagattttgttgctctgatcgtctataaaatggacattttcggtcagttttacagtataccagccatacagttttctcgtatacctgttacttgcagccagcctcatatttagctagaaaaagaattcatggtcatggtcctaaagaagtacacagtctaattaaggaagacaagactgactcattcaaagcaaagtggttatattttagcacagatacggttaatgattctaaggttgtaaactcaaacatttagtagatagggtattctgtgctcttgttcacattctgtgtgagccaactactctgtcctccaaggaccacgtcaccattaccacctgaaccccttccttgaggcatctggcacatgggcatgcctcctctggaggtgaagaaagggaatgcagtccctgagtcgatgatacagttctcttaccattcagatttctcttgtttgaaaatgttttatttcctggaaacacatagtatacaactagtgtgaagtctaaaataaataaaggtatttaaggtattttgaaagtatgcgacagctaacttgttaagcaaaacacaatttaaggtatttttaaaatatgacacatctaacttattaatgaacatcttcatttaaaagaaatatattaatagcattaattaattctgcagatctttactgagcatatagtatgcatcagtgctatactaatggggattttttgacaaaacaggcaagttacttgctgtcttgaaacttacattttagtgatggagaatagacagtagttatgtaaatgacaatattatctctgtgttatgtataattataatatataaaatgatataatgtgaaagacaatagtaagtgtgcataatgactttttggctttcagagcaacacattttcttggtttgtctcctgccttcctggtcaccccttctcagtctcctttgacattttccactcttgtccctgacctcttcatgttggagagcttcaaagcacagtccttggacctctctcatctcccttggtgatttcgtccagtcacatgggctaggctacttctggatttctatgtccagttcagatttctttcttgaacgccagtcacagtatcctgctggtcacttcacctgtgtgacttggctatcttactgacatctcaagcttattacatcccaggccgagcttctgatcttccccttccatcttgtcagtttttctggtcaaaaacctgaacttgactctctcacacctgcatcatgagccacctttgccctagcttcagagtataaccagaatctcagcccttctctccacctccactgctaccatgtttgtccaagccaccatcacctgtcacctgtcacctggggtactgtggtagccacccgcagaactccctgtgtctctaaccttgcctctctgcagccatttctcagtaccacagcagaatgctccttcaaaattttgggtcaggccatggtactccaatgtccaaaccctaccttggctctccatttcacttgagtaaaagtcgcatctttctattggccttgaaggccctgtgtggtctggcccctccgttcctctctgactctgtcatcttcaccctcctaccttccaccctctgtgccagcctcactggcttgctcatgttccttgagcacgctatacactgttccctgctgtttcttagccagctccctctcctccctcctttagtttttttgctcttgtctcatctgctcagtgaggtccccctcatacagcagcctccatccctgtctccatatcctgatctgctctctcccttttctgtaacacggttaccttctaacatactatgtaattaattctttatttattatctgtgttcctcactggagtgtaagtgtgacaggtacagggactgctgcctctgctgttcatcagtgtatcccaagcacttagaatagtaccagccacatggtgtatctctaacacatgtttgtagatgaatgaataaatgatttgctgtaatgtttcacgtgcatgaccatttttctcaggggattttatactgagtgtttttaagtatccctctcattcttgagattttgccgttctgattctgtctggtccataacccacatagttgcaaaacagacaggttttcatgaatcaattaatatagcaaacctttttgcatgtgtgtgtgattctataatttccctaacacaggagaatccagctttggcggttgcaattaaaacatgtaaaaactgtacttcggacagcgtgagagagaaatttcttcaagaagcctgtaagtgtctagaaatttctgtggaactccatttgactttctatctgtgaaatccaaactgtctctgaagaaataagaaaaatagtgttttgacttttaggagacaactatgtttattattttgccttgcaaattaatgtctaaatttgtacaagcacctatctacagatttttccaggtaaaccatcatgttttatgtgtaaaggtagattgatgtgcatttactttatactttggtacttaggccattacacatctttgcactggaattggtgcagatatataagtgatcctaatgttgatgctgcccagaccccaggaatgcagaggtgagcatgacacacacagtccctgccctgatggagctcatagactagtgaaggaatagggctctatgaccattccccttgtcctgctacaaaatcagaacaaatcacccaggctgggcacggtagctcacgcttgtaatcctagcactttgggaggccaaggcaggcagatcacctgaggtcaggagtttgagaccagtctggccaacatggtgaaacagtcttctactaaaaatacaaaaaattagccgtgcatagtggcacgcacctgtagtcccagctactcaggagactgaggcaggagaatagcttgaaccccagagagggaggttgcagtaagccgagatagcaacactgcacttcagcctgggcaatagagcaatctctgcctcaaaaaaaaaaaagaaagaaagaaaaagaacaaatcacccaaaaggaggccaggtgtggtggctcacacgtgtaatcccagtactttgggaggccgaggtgagaggattgcttgagaccagcctgggcaacatggtgaaaccccgtctctatgaaaaaatttaaaaattaaaaaaattagctgggcatggtggcgcatgcctgtagtccctgctacttaggaagctgagatgggaggatcacttgagcctgggaggcccatgtagcagtgagctaagatcgtgccattgcactccagcctaagtgactgaatgagaccctgtctccaaaaaacaaaagaaaagaaaacttcacgcaagaagagacctcaggaaaggactcttctgacggcttcccaggtgactttagctagaaacacttatctttttttttttgaggcagtgtctgtctcgggtctcgctgtgtcacctcctggactcaagggatcctcccatctcggggctgcaaatacctggtactacagatgggcgccaccacatccagctaattttttgtatttttgtttggttggttggtttttttgtttttgtttttgttttgtggagagacaggtttttgctgtttcccaggctattctaaagttctaggctctgcctgcatcagcctcccagggagctgggattacaggcgtgagccactgtgcccagcccttagaaataattttctccacctccattcctctgactcttggtttgtgcctcctctgaagaagcttccttgagtgagctctgcatgaataggtcttctttcccaaatgtaagctcttaaagagcaaggatcttgtccacatcaagctcttccttacctgccctcaagcggtgatgttcctcttcctcctttcctatggtttgcctcttctcatgcttcaggccccagcttaaacattacctccaatagagaacctttttctgaccaccatatttaaagtctccccttactattttttgtcacacaagactagttctttttcttcctaatgattcctaattaaagctacattgtttacaagtgattattgcctgtctcttcctctcttcctctaggccttaagctccctggggataaggaccatgtttgtttcgctcaccactccatactcagtgtcctgcacagtacttgacacctagagaacacctggtagatgtttgtcattctggtgtccttcattatatgtgcatcaaatgaatgccttctgttttccattgtaataaataccacccaacagtccaataaattaataattcatagagtaagccatgtggtgactacattaattaagtcttagtacatccttaatcctattcctgaaactttgacttaagtacaagagaaggcctggccaatgacttctgtcttgactagttcatttctgcatagcacctaggccaagaaaacagaccacatcagtcatcatcacccaacaccatatctgccttacctttgctggtattcttgtgcattttatattttcaaaaatgaaaattttaaaaattggttatcttttcctaaaattctgaacagttactatgttgtgattttgtaggactttggaattgtcattacaaaaatcagttatatagttttataggagtagtcaagtcggactaattgttttcttctctgagaggttactcagcagttatttcagggaaatgtgatagatgtagtgtatctaaacttctgtagggctttaccaggctatatataagagaaaaaatatggcctcgatcaggaattgttaaactttttctttaaagggccatatagtacatattttaggttctgcagactatgcagcccctgtcccaagtattcagctctgtcattgtacatccacagacaggacagaaaagaatgagcaagaatatgttccagtaaaactttatttacaaaagcagatggcagcccctgggccttagctttctgccccagatgggtaaataacaagggaaactattctatgtgttgatttttagttcagtttgggtagagtttcctagtggccacaagactctcttagccttgtgctgttttgtgtttctaataattacttctgaggaaatatgaaaggcttgataattatatgtgagaataacataaaaccaaaagttataataaatagttacttacagtaaattgaaagtacggttgtgaatatgctgggtgcctgagtgtttatccaaaaatatcatggtataagcaatgaactgaatgtgacaaggtgagatttaattatatgttttggattatgtgctgggtgtttacattatatgggtttttgttggtgatgtttgttgaaaaaaactaccaggtcctgttcttggaatatgagggaaaacttgtaaaacacataagtgagctagacagaacacccactaatattgttttgcccatttcaaagtctttcacagttttttctcacaatgggcgataccagctattctgtaacatgttggcagtattacatgttgatcgtatttttaaaattacttctgttattctaatttccttgcttggcatcagaattatttttccccatttttatagtctgtgaaatcaggtgtttttggacccactggaccaggtcacctttaaaatcacttccagttttgagatcctatagttctgtgaagtctgtcctgtgtcttactaatcctagtatactgtacaagtaaccttcttagccctgatactagaaattataaatgcatacaccttaacatacatgttcacacacagatatgtatgtctatatgcagtgccctcttggtcatcttggctcaattaggcggtcaaactcatgttactgccataggccacatttagcatcagactctcctgagagtagtagtacaggaccataaacaaagtatgccaaaaaaggcagcagctggcatttctctcatgtgaaagtcctcacggctgtcctggaaactttttttttttttttttttttgagacagagtctcagtctgtcgcccaggctggatggagtgcagtgacgcaatcccggctcactgcagcatctgcctcccaggctcaagtgagtctgctgcctcagcctcctgagtagctgggactacaggcacacaccaccacgcccagctaattctgtatttttagtaaagatggggtttcaccatgttggccaggctggtctcaaactcctgacctcaggtgatcggcccacctcggcctcccaaagtgctgggattacaggcgtgagccaccatgcccagtagaaagtcttttatagggccctgaaagcaaccagttaaatttaagaggacaggaccacagtggtggatgcaggaaccatttatgtctaagatagaaatcctttgtgagtgccccatgggttgtggcttccagggccttgcaaggaacacacccagttaccatagtctccacactcagggcagcttctagctatagctttccaccaggtatttttaatcccatttcacctcctcccccagcaattcaccagtcaggagtgatttttactgtaaagatggttgcttagtaaatgaattacacactcctacttaccagatttctagaggaaaacctaggaagctaccccaaggtcacatatgtccataggaaaaaagaaatggttgtcgtcgtctttcttctccttcacttcctcctcctcccttcctccccctcttcctccttccttcctcctccttccttcctccccctcctcctacttccttcctccccctcctcccttcctccccctcctcctccctcctcctcctccccttccttctccccttcctccccctcctcttcctcctcccccttcctctccccttcctcctcttcctcttcagcctccccttccttctcctcctcctcttccccctccccttcctcctcctcccgttccccctcctcttcttccccctcctcgtccccctcctcttcctcctcctcttcctcctcctcttccccctcctcttccccctcctcttcctcctcctcctcctcttccccccccctttcttctcctcctcctccccttccttctttcttcctcttcccccctgccacatatgcagaaggaaagaaggatttttcttagaggttaccttacacctcaatagtaggacatacctttttgtgccaatttatgcccatttgtgagctgaactgacctgtggaattgagttttaaagttcccctattgccagccttatgtcttaattgaattcatcttcagagaagctgaaagagttttcaaaagaataactaggccgggtgcggtggctcacgcctgtaatcccagcactttgggaggccaaggcgggtagatcatgaggtcaagagatcgagaccatcctggccaacatggtgaaatcccatctctactaaaaatacaaaaaattagccgggcgtggtggtgggcgcctgtagtcccagctactcgggaggctgaggcaggagaatcacttgaacccaggaggtggaggttgcaatgagtcgagattgtaccactgcactccagcctggtgacagaatgagactccgtctaaaaaaaaaaaaaaaaaagaaagaataactatggagaacttttttcctagtaacaatgcgtcagtttgaccatcctcatattgtgaagctgattggagtcatcacagagaatcctgtctggataatcatggagctgtgcacacttggagaggtactgtgatccccaaatcttaccttctggactcagcgtttgatatcttttgcttaagaaaggaaaatataaacagtttatatcttggattttcaggagagttctgatttaggatgtatgtcattatggttttggttcagagaatatgggtataaatatcttcatcattaaattcccaaagcatccccttatgcagtactggcagcaatatcttccccagccaagtactttatcaggattggtagccgcagatggccaaatgtttggttttattttttctctctggtgccattgcctaaaaaactagcccagtgatctgaggatgaagcaatcttaatggagtttgggtaaattaatgctaaatttaggtaagtctaaacatttcctttatctttttgggaattcactttgtagcatctcattttttgagagacaaagtctccctctgttgcccaggctggagtgtagtagcataaccacagctcactgcagcctcgacctcctgggctcaagcgatctcccacctcaacttcccgagttgctgggactacaggtgcatgccaccatgcctgactaattttttaattctttatagagacggggtttcactatgttgcctaggctggtcttgagctccttggctcaagtgatccgcctgcctcggcctcgcaaagtgttctgattacctggctagtaataccttttaaaccaacttatttaaatcacagtttcttttttcttttttcttttttttttttttgagacagagtctcgctctgtcgcccaagctggagtgcaatggcgcgatctcagcccattacaacctccgcctcccaggttcaagcactactcttgcctcagcctcctgagtatctgggactacaggcacgtgctgccaggcccagctaattttcgcatttttaatggagacagggtttcaccatgttggccaggctggtctcgaacccctgacctccagtgatctgcctgccttggccttccaaagtgctgggattacaggtgtgagccatcgtgcatggccgtactttcttttaaaaatgtgagtaattgagtgaatagctctctcactttctccagaatacagaaacaaatcagtgcatcaccaacacttggaaactcattaaacaagttcttgtgccccatcccaggcctgctgaatcaaacactgggccgggggagcattgtgtgatttcatcagctgaacatctcttcctcctccaccaaatcaaatggagtgcttatgtataatttcttgttcacggtacttttctgcttttgcttttggagagtttgctaattcttccggctcaaaaaatatggctaaatatttctctcatcaattatttagaattagggtattaattgtgtctgcctttctttgccatgtcagcatttacctctattaatggtgtcagtggtagcatgaacaagtaagtacattgtgataaatacccaacatgactgttctgtgcttctgcatccaaaacttcatggggaaggaaataagaggggagattccttcttgtccctgctttctccgcattacattatcctcataccttcgcagagccacagtaaggtttgaagtggagataactgactgtgtattagccttgtttggatagtaactagatcttttttcttccagttgttattattatttagcaataatttgtactgtgcttttgttcattccattgaagcttatctttctatattttttaagaaatttgtcgttagtcaaaaatattttaatttcatgataggatttcaaataaaaaataatctgaatccagagtttaaatgtttcatttattatgctttattagaagagacttgaagccattctaatattattaaaaatgcattgaaaacagcattattgttgaatgtagcttttttgcttttgatttcgattcactgccactaattcttttttttttttttttcttttggtcattgttccaaaagctgaggtcatttttgcaagtaaggaaatacagtttggatctagcatctttgatcctgtatgcctatcagcttagtacagctcttgcatatctagagagcaaaagatttgtacacaggtaagatacagtcataaagctgttaagttcccttctgaaaagtagtgatcaagaaacagggacccatttggaccgtctttggacccttttggatccagggtcccctttggtacagttttgtaccaattctacaaaattgtattctgtataccattggaatctattgtacacagttaatagcaagtcatgctgcattatgtcctatcagagtgagatgccatggcttgttaatacacatttacaggatttttacacacgtggagtttaaaacattgtgatactttcaggtcacttattccctacacaaacactatagagaacctgtacttggcagcagagcagtgaacatgtggaagtggtctctaaaacaaatattgtcctggaactctccaggacaacacaaccttatgagtgacatctgttggcattctgtggaatttctgtttatagcctgagtctctgtttgaatgcaagtaaagacccttaaaatttgtttgccaagtatcatattagaattggtgtttttgttatccggcattaatacaaacttcatccaaaaaaaaaaaaaagaaataggccgggcgcggtggctcatagctgtagtcccagcactttgggaggccgaagcgggcagatcacaagatcaggagatcgagaacatcctggctaacatggtgaaacaccatctctactaaaaatacaaaaaattagctgggcatggtggcgggcgcctgtagtcccagctactcgggaggctgaggcaggagaatggtgtgaacccaggaggcggagcttgcagtaagccgagatcgtgccactgccctccagcctgggcaacagagcgagactctgtctcaaaaaaaaaaaaaaagaaaagaaaaactaagcatctaaaaaaataagctgcatcagcaaaatcatttacaagttttcagaaggcaacttttatttaatgatatctctttagtaatggcagtgttataggccccagttgtatatcactgtcagttaatgccgttggtagtatggttttatgaacagtaataaggattttcattattttagaatgtactttgccatcattcagaataatcattgtattaatgggtaaatatctggcaaaaagaatatatatgaagtaaattttgtgtgtgtgtatatatgagatttattatatatatcctataataaatatcatataatctgctcgcattgtatataagctgtctttcaaagtgcctattggtatgtctttatatatgagcttgtatgtttgtttttcttattttaagtcttattgtctcaaattcttctttatcagggacattgctgctcggaatgttctggtgtcctcaaatgattgtgtaaaattaggagactttggattatcccgatatatggaagatagtacttactacaaaggtaagaaatcagagtagtacctaagaaataggcttggaatctttaacgtatttctaaaaacagtatgttctaatatgctcacctgatctttgacagagatataaaatcaactaaatggaggaagcgacagccttctcagcaatggtgctggagcagttggacatccttaggcaaaaaatagacctcagtttaaacctctgaattccatttcagattaactcagaatggattatagactgcattacaaaataataaatttttagaaaaaaacacgagtaaatatttagcatctagggctaggccagggatccttagacttgacaccagaaacaaggattcataaaaggaaaaagttgataaactgaacctgataaaaattataaatttttgttctgccaaagaccctgttaaaaggatgaaaagagaagctacagagtagaagattcgtgccagccacacgtatctgacaaagctattatctagaatataaaaggaactcttaaaacttagtaaaaatgacacaaagaatgcacttagaaatgggcaaaaaaataggaagagacatttcattgaagaggatatatggattgcacataagcatgtgaagatgcagatgttccacatctgtgtccattaggaaaatgcaaattaagaacacaatgggattacagtacatacctgtcagttgttaaaataaagaatatgctggcaaagatgcagagaaactaaattgctgctgggaatgtaaaatggtagaggcattctggaagaaagtttggcaaattctttaaaaattaagcatacaagtgttatatgacccaggagttgcacgtctggacatttcttctgaagaaacgaaaacttgtacacaaaaccatactcaaatgttcattgcagttgtatttgtaatagccagaaattcaaatcagctccaatgtctttcaatcagtagacacaccatcatcttacaccagatgcggctggttgtattgattgcctcagtgaaggggatctgactgaaaaatatgcaggctgctaactccagcaccttggatctattagtttggtgggatttttgtttgtttgcttgttttgagacaaggtctcacattgtcactcaggctggagtgcagtggcgcaaacatggctcattacagtctcgacctcctgagctcaagcattccacccaccttagcctcccaaattgctggtactacgggcgtgcgccaccatgcctggctaattttttgtagagatggagttttgccgtgttgcctaggctggtctttgatcaaactcctgggctgaagctattctcctgcctccgcctcacaaagtgctgggatttcaggcatgaaccatcatgtccagcctccattagtttttttaactgaaatctagctcatgtcagttgtgtttaattttgccaatcttggaatcacattgaattggttcttcaaattgttactgaactaatattttactgaataatgttttcatattcctagaactttagctaaggtttagataaatccatattgtgctattaatactactaattatgactaccattttacaaaggccagtttctttcttagggtatttgatttttatatggcaacaaaatgagcccagatttttacaagcaaagctagtctgttattttaatcttataactattctctttccatatgtcttctgtatattattgcctgtcactattttattttttaaattcatttttaatttttatttattattattattttttttttgagacagagtctcactctgtcgcccaggctggagtgcagtggcgctatctgggctcactgcaagctccacctcccaagttcacgccattctcctgccgcagcctcctgagtagctgggactacaggtgcccaccaccacgcccggctaattttttgtatttttagtagagatggagtttcactgtgtgtgttagccaggatggtctcaatctcctgacctcatgatccgcccacctcagcctcccaaagtgctgggattacaggcgtcagccactgcgcctggcctaattttttaaattaaaacattttttaagacagggtctcgttctgtcgtccaggctggagtgcagtggcatgagcacaagtcactgcagcctcaacctcctgggctcaagtcatcctcctgcctcagcctcctgagtagctgggaccacaggcacacaccaccatgcccagctaattttttgatttttttgtagagatgagatctcactttgttgcctagattggtcttgaactcatgggctcaagcgatcttcccaccttggcctcccaaagtgctgggattacaggcatgagccactgtgcccagctacctgtcactatttttaaatgatcctttgatatatgaaaagaaaatcaattgtttattcattttaattgtttagtcatttaactttaaaaagacgaagtcaacttttcattatttctaaatacattttatatccagcttcaatcttaactgtcccaagtcctagaattccaataaagagctaaattccaagtagtatgatgtccaaattttcatatcatttgaacaacattttaaacaggcagttgacaaattcacacagatatcttctcagaaaggttaataagtgtacattccattaggctatagaaataagtacaaactccaaaaggttagagattcttcaaaatgctcctctttctaggaattctgatagtcttcagaggcaactcattgcttacagaagaaagtccagacccttgacatgctggcagagcccagccgctcatgctccatgctcttctgaatcagggtgctgttcctgtgccctgcttccttgaccaaccccttctcctcttatatcctctccctgcagccttccctggtcatcctctcagtcattagttcctctctactttcaggacacttggcatgtattcactatctgtgttacaccttgtaccaaatttgagtatacttctgtctgccttttagaatgagcattccttgaaaaaaaggactcgggattgttcatcttgagaactcagcagttgaggaaatgtttactaaggttttgagtggtttgcctttgtggcacaaagaaaacgtttaggcctgaaaagggagctgatttcaggcttccctagagaagtccttcttatcccattgccacttcctgctcttcacatgcctgattatttgtgtagtctgcgctgatgcattcacctagtggctaacatgtttgtaattcccaaaatcaatactcaaggtgctttcatagtcatttgaggacatgcacaaagcaacaaaaaaattgagtattccctaatacccacatatgcagctgaggttcagcaaggccgcagtctctccctcctgtcgcagccagaggagggaagacagggtcagggctgggaggggacggcacagggcagagccagcagctcaggctctggtggttggagaggtttgaatcccaactctggcacctgttagtggggcagccttgggcaagtcacttaacacatctgagcctccttttctaaaggaaatggaacctatcagaatgagttgttttatgagtgaagattgtaatctatgtgagatacgaatatatgtgtacatatttctcctgagagcaggggttctgtgtttgcaacaactttatataacataactaccaccagtgaggatcgactatatattatttattattagcaggacatgtgtatagcgagcattctaacctacagataaggatctcttctgtaaattgtgaaatcttatataccagagctgcacctaatacctgcacctaaacccctggtaaaccgaggtttgctctccctccctgttctttgcctctctatagagggaaggacattggtattttatttatctaccatctaaccattcctcacccctaagtgacctcgaaacaccaaggaaatgaaaagtagttctcccaaataaatggaagcctcaagggttcaaatagttaaagctttttcctttgatactgaaaatctcagctagctctgttagattcttaagcagataacaaggaaaatttattttctaaaattaatcttctagcttccaaaggaaaattgcctattaaatggatggctccagagtcaatcaattttcgacgttttacctcagctagtgacgtatggatgtttggtgagtactcttaaaagttttgtattctttaaaaattatatttcatatgttatacaaaaaaaaattatctctttttggaatatgtaggttgatttgccttccctaacctgatcatctcctcatcagacttcttttgattcatttgacagtaaatagcctgacatctactgtgcatcagcttctgggcacagcttctgtaagggtccacagttctaattgcccagctccttccatcactcttcctttttgttcccctttgctgtctcttctttcctcacagggggatattttgcttatttccttctttcttttctctctctccctttgccatctcattcgttcctttcatatgaatgacattaaacagtaaacacttggcccctccaacccggaagtatctaaaattctaccttgtctctttattctggagtccagcctccttcctgacctatctcaagacttggaagtttgatcctttgtcttctgtagcttctgcttttttgataatctcatttgttcctcctcacctgctgcaaggtcatcattctcctgctctatggttattgcagttccttctagctggtgtagaagtgtggctctcatttattctttgctacttatttaaactactttatccaaatttttaaattactcactatttttaacatgaatggcacttccctccactctactctccatttttcttggtgttattccttctacccagaataccttatcctgataccttcttcttccagttgaaatcctacctaaccctcaaggtccaccttaaatgtccttgaaggcttcttcctttctttacctttcctacactttctctctttgtcataccactcatgttgatcctgtgaatagacttgtggacatgttatctctgctacattagaaactactttggaggagatgccctgttaagattatgtaccttttttctcctataaataaaaataacttgatccagtatgtgttcttatttttttcttctgtttacttactgttgattcttaattatcatttaatgcccccatagataactaggtaaaggaaagaactttcaaatagaacaggatatggcatgacatgattagaaaaagctctgaagtccagttgatgtgtgttcaaatcccaaggccttgattattatctgtgtgatccacagagcaagtaacttatcctttcagagaaatttcatgtttcaaaacttctaagatgcctatttttttacatgttaacatttctggaactggagtgtatcttaaaatcagtggcattttacagttggtaataattggaagcattattttaatgtagttgtccttgctttccactcaagtagagtttgttttgttaatattgttgttactgtaatgtctgaatgactttaaaagaactcttttggtaagaataaaataaaaattctaagagggaagaaagaattgtatcatactttagttttcaacattctcctcccttttttggtcttataaactaataaagtttcctagaatcagtagatgtgatttttgtcaaatgtggtaaaatgcagtgtttaaagaaacataaggttactgtgaggattaagggtaatatatgagactgggcacggtggctcatgcctgtaatgctagtactttgggaggccaaggagggaggatcacttcaatccaggagttcaagaccagcctggacaacttagcaagaccccatctctacaaaaaatacaaaaattagctggtttgggtggcgcatgccgatagtttcagctactcaggaggctgaggtgggaggatcacttgagcctgggtagtggaggctgcaatgagctgtgatggaggctttgtctcaaaaatatatatatttgtaaaatttctaagaagtgtgccaggaacacattaagttctcaagaaattatatccagtgttgctactactgataatattgttgtaacttctggtgagaaaagcagcactaaggcattttttttgtcagatactctttactttgaaattcttggattcttggctaagttcagaatctaattcacatcaagatgataatatgctttgcttcttttgaggcagatttcattctaggttctaaagatgcaaaaataaagtcacagttcctttcttcaagtcatcaattgtacattgttttgtgatagaagtagacttgaaatgacaaaaacttttcccagaggaaaagcattataaagaactacattacaaatgtacctacaaagaagagagcttgtgaggaaggtaaagggatgtttttggcgtgttccacaggtagcaagaagcccagaatagccaggcgcagagcagtgatgataaggcactaggagaaaacatccatcctttacgccaccagttctttccatttcctttacattgcattatatgttcattgccagttttaggtttcttgtttgttttaaaggtgaatttttaaattttttttttttttgaattttagattcagagggtccatgtgcaggtttgttacatggatatattgcacagtcctgaggtttgggcttcagttgaacctatcacccaaatagtgaacatagtacccaatgggtactttttcaaccattacccacctccttccctccctgctgttttattccctgctgtctgttgttcccatcttcatgtccatatgtatccagggtttagatcccacttacaagtgagaacatgcagtgtttggctttctgtttctgcattaatgcactttggataaatggctttcagttgtttccacggtgctgccaaggacatgatttcattcttttatgcctgcatagtattccgtggcatatatgtactacattttctttatcccatcttaaaggtgaatttttaaggattattcagaagatactaagaaagtattggatttcccaagggtagagtgcaagtaaactttttgaggtcacactgtggcatttatagacaagacgacttgaagcccaaagaagttccacatctttcctgggggaaaacagtgaccagtccatgaataaaccagataatggtgcctttatgcactctagacaagaagaggccaaccttgttaagggaagcattttaaggaatctgagttttccaaaagcgtaagacttatcctaggattttctttattggacctcaggtcagctgctctaattataaatagatgagaccaaagtggggcggattaaaattcagcattttttgaactactgcattaagccacgaagtaccactgtagctagtgggtgattttctaatagaggatttctagagaaaaaataaacctctgagaaaaattacagcatttttcttgataataatttaacatttcattatttacatcatgttaaatcgttaggttattttatactagagttaatataatgctgctttggtagataatttgcccattacctcccagctggtactcgagtgcctagaagaacaatgttcctggaacctgggagttacattcttcatactgagctcactgttgtgttttcattcccacttgacaggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcaggtaggagttggcgggagagagggcctgggggtgggggcagattatgctgcttctcctccttgcagtaatagcattttaaggtcattatatcagtatgtctaaggccgaactatttttcgttcaaatgcaattacttttaaaattgatttgcatttctttgtaccttgctagagtcttaagtaaattatatctttaaaattttaataaagctccaattatggtcaaatctctctcccctagcttctgacttagcatggcttacaagacccgtaataacttagtcccggctttcctcactaatctcatctaacacaaccctccatctctgtctccctcacactttgtgatccagcaatacctacttataattctcctaacacagctcactgcgttttcacatgctgtcttcactcccagaaatccctttcctgacctttgccacctataaacttttattcagttttcagaacccagctcagatgttacctgcttcaggaaggcttcctaatcaaccctgccccgaaagagagaattactcctttgccaccttttgaatacttctgtttttatatttaaaacatccattgcttgttcaggtgccattttgtggctactactttgtgccaggtactgttaaacccctggaggaagcacgcagggacattagtgtgctgaatccctcagagaagcatgtgcatactctaccctgttgcctggcctggagaggttcttgttcgcttgtgcatgtccccagctacactcagagctcttgacgggcatcattgtgtcttactgatttctgtagccccaatgccaagcttagaacctggcaccatataagtgctcaataaacatttgttgaattgaattgaattggagtctagaatgagacttaatactgtaataaacaagatactgtaatataacacataggcatgagaagctttattatataaacaataccatggttcagtgtgtgctgtgtcacctgttttcacacttggggacttcctccattttatgtgagtttttatgggtttgtttttcatgctgtattttagtctttttcctaaaaatcatcaactgcagggtccaggcctttcaccatctagcccagccttctcaccacatgttcaagctgttcaacctgctagacaggattccttttaaggagagtatttcaaagaagaattaagacctataggtagaagcacaaaggattcatccagtctgaaaatgtttgctaagcacctttgttattctaagctaggttctgtgggtccaacagtgaacaagacccaatccctgcccccagagagtttaaagtctggtggaggagaccgaggtatcactggttattacaatacagtgagccccacattggaaagaccagccacgctcttggtctccgtccccataactctcacacaccggcctggttctacttttcaaggccccatagaacaaccctactctgcctttcacacgataggccttcagggtaattctaaacagcttccttacctcctcttagtttcttcaagccaaaaatcttcagttccttaattaattctcatataacttaactgcctattctctcacctttacagctggcttttggacatgctttattgcatgttgttttgctcctatttgttcctccttgatctttcctcaggatttgacagattctgtccttggcattgttcctctctgataccagttctatcaccccacctccctggcatctctttctacctcattgacttgccatctctccacctttaccatgaatattaaccaaatttctgttttcagcctcttattttctcccattttctctcattactcttcccaggatgtctgacccattcacatggctttgctgcttacctctgtctgtctatagttctggtcctgcccttttctcaagtcccaaacctacattttaaattgctggctgggcatcatgtttatccagaaagcaagctgttacattctcttctatgccagcccttcctcctcacttcctccaggttggaatagtgcctttatcttcggcaccatcttggagtcatgcttcactccttgtgcctgccccccaccctccatcccacgctcttttcccatctgtctggcatgaccagcttagtcaatcttcctgaaatgtcactggaaaaataactcccctggtcaaaacaactttcagtggggttttgtcaccttttatgtttgggtaaaggcttccacagtaacatttaggcctcatttcattatggcctgagattgtcttctcatccctttcacacacagtagctaaactaaccctcctgtcagcccagaatgcctccttcttcatttggggagatcttacccatctttctcggcttctttcacgcactgggtcttctgtgacttcacagctgactagccttcaccctctgagtctccaaagctctttgttcttcttgtcaggcttaccctatgctgctatagatggctgcaacccgtgttcaattcagttcgataaacactgttgagcacctacagtagctgagcctggtgctagtcactggggcaaagatgactaaaacacttttcctgccctcgaggagctcacagtctagtatgtctcatcccctactagactgaagctccttgaggacagggatggtcatactcacctcggtgttgcccaaacctccaggccagtagcctagctagctagatacaggaagagtcacccaggcactgaattcaaggcttagaacatatgagtgattcttaatactaaggaatgctccactgaggtaaattatctccaaaaagtatccaatacatatttttagaactacatataattactttaaataggtacctgtagtataatttatggatatcttcttatatactactagcacaggtagttgagcattcattcattctgcattgttctgttttagaaatggtgtttaactttgcgttttgaacatatacaattaggctaccaaataggccaccattttatattataaaatgtcactatataatataattgcttacttggacatttgcatataacagtgtatcacaataactaaataggttattaatttttttcaaaatttttattatttccaagattttaacaaagaaataataagtttggatagccctttggtcgttaaaattatggtagttaaaaatgtttcccaaatcccattcttcttcttgacctcgaaagaattctccttccctaccttgaaagaatatttgcaagtagactcaaattactgtgggattcccctcatctttaactggagtgtatgcgtgtgtattttattttgttgaggcggggtctcctctgttgcccaggctagagtgcggtggcaccatctctgctgcctgcaacctccacctcccatgctcaagtgattctcccaccttagcctcctgagtagctgggactacaggcatgcacaccacaccaccacacccagctaattttttgtatttttggtagagatggggttttgccatgttgcccaggctggtctcaaactcctgagctcaagcaatccacccaccttggcctttcaaagtactgagattacaggcatgagccaccatgcccagccttgtatatttgtttttgactatattagttgagaagtgatttttggtatggaacatgttgggcaaactcataggaaaatcaccttggtcctactttgatgaggtgatgtctgtgactcaaggaacctgtccttcctacatcctgtttacttattcataggtatgaattcattgagaagtagaatgagattaacctgccagtggcctattatcaagtataaaaaattcctcaataggaatactttcaattgatcaacagtgaaattttcttataatgcgtactctagcatttttgtgctttatgactgtcaggttataagagcgcaccaaatattttttgagtgaaaaatcatttagccgggcgcagtggctcaagcctgtaatcccagcagtttgggaggccgaggcaggtggatcacctgaggtcaggagctcgagacaaacctggccaacatggtgaaaccccgtctctactaaaaatacaaaaattagcccggcgtggtggcaggcacctgtaatcccaggtattcaagaggctgaggcaagagagtcgcttgaacctggggaggcagaggttgcagtgagccggtattgcgccattgcactccagcccgggagacaagagtgagactttgtctcaaaaaaaaaaggggggggggggtttaatttaattcctggttacttcagttaattctttgttaggtactatgacagggaaaccataataaacagctttattatttgcctttttgcaggtatgttcaaaaataatatgtcccaacagtactcttcttgactaaggtgttggtaccactattttaaaaaagaacatcagctttatctcatattagaaaaatattttaggttaatgttaaaattcttaaatatattttaggcaaattagggcagtaaacacaattatcactttaaaattttgtgttatgatttttgtatattttaaaactttttattgatgtttaataaacacaccaagaagtgacagcttactggatttccaccagttggatacagtctgtcaccagcaaccaaaatgaaaatactaccagcaccccagaaatcttccacatgcccctttctaatcactgttcaccctccaagggtaacctctatcttgaccatagattggttctgcctgtttttgaacatgatgtaaatggtatcagtcagtacttactttatatatataatttattttactcaacagtttgtgggattaatccatgttattcgtgtagttatactcaattctcattgttatatagtgttccatttgtgaatatcctatagtttattccactgttggtggaaatttgtatacttctaatttggggctatcaagaatattgctctgtgaagtagagaggatatagtaagtgttgtgtaaacagatttacctgaggctttatgttctaaagaacaccagtctcaagtatcaccttggaaagcagtccatgattttgaactggtcttctatcattgagctctttaggaatatttttagaaccagtaccatgtgcattgatagcaagtctccatcctctgcagttagctcttctagttataacattgaaataactagtagttatagagcaatgtctgttggcaggcattgtgccatgaacttttatacactatttcatcttaatcctcacagtcctggggcatactacgtataggtagtatcttcatcgttagtttacgatgatgaggagactgaaactgtgtggttaggcacctgatagaaggacacagagctggaattcaagctaggtccacctgagtccagagcttgagctataagctgtcatgctctactgactgccttgatgtttattggctagaagtcattaagtgtgcctgccatcttatgatttggactggtgagcaggttgttaatattggttagttaaaaaggaaaaagaaaggaaaaaaatactattacagagaattcctgcagcttgttttcttacattgtttgagtatcaaccaaagtccttaaaaggaatggcagcatcactagcagatgcacagaggccctacccacgggctttgagggggacatggcttccttttgtactttcaaagtattttcttactggttttacttgtttcattggcatattttgagtgtgttgtattttgcttctgtggaacacaataatttcacatacagtggggagccgatttggaagttttgaacaagtcacccagagttgacttcaagcaaatcagagccaagccatgacacggtgtcatccagagagcctgctgggaaccgcttgtatatagagctttcactccagctggggggtgttgggagtttttgtttggagtttttgtttttgattttgtgcgtgcgtgtttttttggttttcagtttttagttatttgtcttaaccatgtgctgtcatgttttgcttcttaactttatcaaacaaaaccagcctttgggagagtgtttggtcagggttatagcttagctcagcatgggtgcagacagattttcttactttttttttcatatcgcttctcagtatcatacctaagtgaagctgcaaggcatctaaggaacacaaactatttcagttgatctgtgagactgccagttcaagctattatagcaacaccttgagagtaaatggacatgtgtgcgtgtatcaatttttcaaagaatgtttaaaagattatgtggccttgggcaagttactaagcctcccttgtaagagcaggatcacaaatactacccatattctcaagattaaataaataatctggccgggtgcagtggctcacgcttgtaatctcagcattttgggaggccaaggcaggtggatcacctgaggtcaggagttcaagaccagcctggccaacatggtaaaaccccgcctctactaaaaatacaaaaaaatagccgggcgtggtggcagatgcctgtgaatcccagctactcaggaggctaaggcaggagaatcgcatgaacccaggaggcagaggttgcagtgagccgagatcgtgccactgcactccagcctgggtaacaagagtgaaactctgtctcaaacaaacatataaataaataatccatgtccattgctcatggtaagcacacacactgtgttagctaatttagaagtaggtagtagtaacaacagagattttcctgaaaatccagaagggacctggtgatcttagagtacagaagagttaccagttatagttagacatccttaaaaatatatagttatttgtatttaattttaaggtaaccagtaacagaatcgtgcaaaattatgagctttggaatgacagatctcactttgaatcctggccccaccacttaatatccttggggaacatctttaacttttctttttctacttttttttttttttttgagacggagtctcacactgtcatctaggctggtgtgctgtggcgcagtcttctgctcactgcaaccaccacctccctgcttcaagcaattctcttgcctcaccctgccgagtagctgagattacaggcgcgcaccactgtgctgggctacttttttttgtatttttagtagagacagggtttcgccatgttggccaggctggtcctgaactcctcacctcaagtgatcaaccctcctgggcctcccaaagtgctgggattacaggtgtgagccaccgcgcccggccgtctttctctacttttctaaaaagtgtagtactctttctactcagtagctactttctagggttcttgtgagatttgaatgagtattaactattcttattattcagataataagaataccaagatacttgttatcaaaataccaagcacatctttttgatgttttatagatgtattatagagatatgaattttaaaatattaatctgtgaacagcatcttaaacatgtttaacctgttttggattcttcccttatcccacaacacgaactttaaattagaagttctaggtttgattaatgacatgaaattgcttgtactactgtgttttttttaagcgattttgtatttgcttccaaaattcctttcaaaggtggtgtctaaattcctccttagtcattataccagtatttttttttttttttgcattgctatcctattgggtctagatattatctagaagactaagctgtttcacaattatagctacgtacagttaaaatgttcacagcatgtgaacttcaggagttttttgtttgtgttctgttttggcccgcagtcttcccagtgataaaaaacaaactgcaaatctgaatttaataggaatttaatgtaaaacgtaaattgtttctactgaaaattattcttagctgcttcatatctaacaataattcttacccctttttggttctcacccacacgtccctatcatagttctgtctttgcacaatttgccaaagtgcacaatttggcactttgaaaccaataacttaacatccacctctctttctctgccttaacctttttctcaaacttgcattttagcaataccttttgtattatgttttcagtgcttgctctgggaattacagtatacatcttaacttttcatagtttagttagagttaatcattgtacttcatataaaatgtagaaactttgccagcaggaatgtccatttaccaccaccaccttggtccattatgctgaaattgtcatgtatgttacattcacatatgccattaaccccacaaaattagtttatgatttttatcttaaataccattttaaataaagtaagcaaactcactcttctatatttaacttcgtacagtgctccattcttcttgaagagcttatttccatttggtttcccatcagatgaataattttttttagcatttcttgtggtgcagatcagttggtggtgaattctattagttttatattatctaaaaatgagttgaacttaactttgttgataggaattttgggttgacagagttgtaattttttttttccccagcaccttaaagatgttcttttactgtcttctgccctgttatgtttaatgagaagtcactggccatacaattgttactttgtatgcagtgtgtgtttttctctggcagcttccatgattttctttctttgatttttcagcaatttaagtaggatgtgcttgggtgtggttttcttaatgtcagttgtgtttaggatttgctgagcctcttgaatctataaacatatcttttataaaatttagaaaaacttagatcattgtttcttcagatacatttttctgttctattttccctctcttctgagattccagtcgcacgtgtgttaagacttctgatggtgtccttcaggctgagtcccagaagctctcgttgtcaccttctcttccccttcctcttcctcctctccccattcctgaccttccccgcttcagattgaatcatttttactgacttaccttcaggtaccctaactccttttctgtcatccccatcctactgatcacttcatccaatggagattttatttcatatactgtattttttggtaatagaatttttgtttgcttcttttttttgtattctgtttctctgctgacatttcctatcgtttcatccattatgaataaattttcttttatacccttgaatataatagcttcttttaaatccttgctgatttcaacatctgagtcatctttagaatcagcctcctttaattttttttcctcttgagaatgggtcacatttttatgggttttttttttttttgtatatcaaggaatgttagattatatcctagacattgtggctgatgggtaggtagcagagcctctttccgctgtgagcagcagtgcaaatctctgttccattattttagccttagctgggctgcttggagtctgcactgtgtgtgcatgattctaggatcagcagagatgtgtgcagaatatatactcagaatttgaagcactccttctctgcctgtcttcattctgggatttctcccttcacttttttccgattacctttttgctagctataattgctccaaactcatttctctggttattcaagccagtaacactggcgcctgccttctcactaatggccactgaaaagtggggacccacccagtgccgttctcttccttctcatgacagctccctccagaatctggctgcctatggttgctctcccatgctgtcacagttgtttcttatatccagagtatacagttcctgtctgcaagagggttggtcaaataagagctactcacacgtagcagaaacagaaaaaggtgtcaacattttaaagtaacatttgcggtggctcatgcctgtaatctcagcaactcaggaggctgagatgggaggatcacatgagcccaggaggccaaggctgcagtgagccgtgatcgagccactgcactccagcctgggtgacagagcaaaaccccaattcaaaaaatagaaaaaaataaaggtacagtcttagtggatatcagggtttttttaaaaataattttgagatcgatacagcacaataaccaaacaaaagactttatttactgcagttggagaagcaatgagagaaatatgatttcaatatatccatgaagctggatttccagtccacctggagactaaaggccataatctccagcatcactgcttaagagaaaagagaaaaagagcagaggcataagcagtaatgctgtgatcatggcctttagctactaggtcagctacttccaggtatgccatccctagcttcatctcaaacctcagacttgttttctgcaaagacggtagggttttgtttggttttgttttgtttttaaaaggccaattccattcctttgtggtgaagcagcgttgactaattataagaaatcatgtttcaaaactggtattcccatgaacttgccaaaacaagccagttcccgcttgacttttttcccttcaaatttattgctgttctctctctgggtgttttctagattaacttaaataactgcaaacccagactgattttatatccaaagcaaattttatgatcaggatcataaaacagatccttagttttacatgattcctttaagtatcaaaatccaatcttttttaaaaagtttttcttcccatatttaataaagcaaaaagtatttattacatttaaaaggagaaatgttttgtatttgcaaagagaaaagttagtagtacagtcagtctcagggaaaatattacagaaatgaagacaaaaacacagttctttcctagtggtaaatgaggcaggtaaaatacagagctaattaacgtttacttagaagtttactaattttttattaatacatatgttgtttttccattctaacaatagttagggtagactgtgatttttacttgtaaatgacaaaacaggttcaagtaggcaggatctcctctggaattgcataactcaccagagaagcagcttgtttatctatctgttgcttcttctgggacagcttgaagaaaaacactcagaatcaattggccttttctacttctgaaaattgcctttgttggagctgtatttttgtgtcttagctgtccatactggaaatgaaggactactttcttgctcaccatcaagttgtatagggaatgttgcaggccaaaagaagaaaatcagagcaactgtttttatgtccttttactgtgaactgatcacttcaatgattttattttaaagtaagagaagtaaaaaataaaactaacactaaataaagtactcctttccccgcttcaggattctgttcctcagtggtgcacgtggatcaataaagtgtaattatcattgtgctaatgtttgttaaatgacaagtctcagctttcattgttccatctatttgcaagtttgagacttggaaaccaccattctgggaaaaaacatgagggctcatttgttgccagttcacattaggcagctaagagctttcagatggaatgtattgctactaaaaatatttatagtttgggaaaatatgcttcagtttgacctccttgatactctgcacattctagtttgttactgtggattcttcagcagctgtaaagagaaaagttcagtactgtctccttgtgccctcctactccatctatggactagtcttcccattgtaaaaacagatattttttatgagttatttatattcttggttcctctgagcagcaaattatggtttctcagaaacgttttgacaggctattttgggtatgagaatgaagtagtgagattgaaggaacttgcttcccagttgtcattatgttctttgaggaacaactcggatgtttaattaaatatcaaagtgtctataatatgcaagtgatacttagcttacaagagaaattagattcatgtctgacaactgtagggagtttacaagctaaattccacaacatggcaatatgtgattaagggctgaaatgaaacattcaggcagtaaattcagtgggtcagagaataggggaagtgtgtgtaggtagaaatatcagggcagatggagcctgagagagtcttcttgtggcaagggactccacagggtccttttagagatgcttggggaaaacagtaagtagccttaagatcagagtggcccatttcacaaaacaatctgtgtgaaataacattgcctgatgagaacccatttaaaactgagttcccgttgccttgaagaatatgtcccacttagccttctcttagcttgcctttattttaattatttgaaggagtagaagaaaagacacttgttttccccaattttttttcttgatttttatggactttttacctgtttaaaactaaaacttttacaaactctgactgagggtgtggtgtttattttaagggtgaggcaatagagagcagggcactgtaaaaccactaaccagggatgtgcttctctctcaggccagctaggccttctttgctcctggtctctgactggtctcctgctcccagtgaccattcgcaggtcctttcctgtttggccagttgagagaacaggggctgggcatggtggctcacatctgtaatcccaatactttgagaggctgaggtgggaggatcactccagcccaggagttcaagaccagcctgggtaacacagtgagatttttatttattatttaattgttacaaaaaataaaaaagaatcaaccaggcctggtgatgcacctgtagtcccagctactcggagggctgaggtgggaggattatttgagtccaggaatgatcgtgccactgaactccagcctaggctacagagttagaccctgtctcaaaaaaagaaaaaagaaattggccaggcacagtggatcacacctataatcccagcactttgggaggccagggcagggggatcacttgagcccaggagtttgagaccagcctgagcaataatagcgaaaccctgtctctttaaaaataaaaataaatttaaaaagaacaggaagcttggtaatgtgctcttcttcactagtcagtagacctgctccactgatagggctttattcatccatttacctgtcatttattaattcctattatgtttcagggtctgtgctaattctgagcatttgaaaatgggccttcaggtaacaacttttggcctaatgggagcaaaagtcaaacaaacagatatttacaatgccttttggcaagagttaagagcaagttaggcactagtttctttggaagagaataaggagagtaatgtaacttagcctaaagggaggagggagcttcagggaagatttttctggaggaactactatttgacacttgaaatacaagtaggagttggccagagaaagaagagaaaggtgttccaggcaagagacacaacataaagaggcatgggagagcataatgacttcggagaacttgccaggacataaaggaagaaggtgtataggtgaggaaaaagggaagtgaagcgagattaatcacttcacttttaaaagcaatggtagttcccgccatgtgtgcacatgccctagctctaaaaaaaaaaatacatatttttaactcctttagcagccttttgaggtatggatttactggtgttttatgatctagaaagttaagatataccttcccacattttcattggtaaattctcaggactgggtgaagctatattacctcataccaaagtatcaactcctattccttatagttgtaacatctttacatttgtcaagttcaaagacattgtatatcagtgactgttttagcaggcatattcttgatctgttggtttgattgatagccagtcttagtagttgtattgctaacacttcataggtgattagatggatttgtaaaaagacatggttgctcctttgtatctcaagctctacttggatattaactcatttgaaatacttgcacaggcatatggtgtaagcctgtagtcccagttactctggaacgcaggagttcaggaccagcctgagcaacttagtaccattccatctcttttaaaaaaaaaaaaataaagaaagaaaggtaggaggccaggcatggtggctcatgcctataatcccagcactttggaaggccaaggcgggcggatcacttgaggtcaggagtttgagagcagcctggccaacatggtaaaaccccatctctactaaaaatacaaaaaattagccaggcatggtggcacatgcacctgtggtcccagctacttgggaggctgaggcaggagaatcgcttgaacctgggaggtagaggttgcagtgagctgagatcgtgccactgcacttcagcctatgcaacagagcaagactccgccccaaaaacaagaaagaaagaaagaaaaagacttagagctctttgtgggaatggtagccattagttacacaggatattatctgatggggaatttctaatagttccttctattttttaaaagcttcttgcatttcagagctcgtcacataggttgtctaattttcatttagatattcgcaacaacccttcaagataggtagttagggaggtaccccattttgtggatgaggcttggagggacagagttgtccatggtcatctaacctgtctatggtagaatttaaacctgatgtcagtgtgactcaaactccttgagtttgattgagccttgctgttttcccatccggttttttttttaaccactaatgatccctgaatttactcagcttagttaaacatctaatagatcatgataatgcatgtattttatctatatgcagtatttgttcatttagcaaatatttaagtgtcagctatgtgccaggcactgtttcaaagtataacagaaggtgtttttttaagtcataaattaaaataaataaggaaaattgaaatataaaggtatttattttcacataagaaatggacagaaagcattgctgtgctttggtcatgtaatgctcgttacatttccaaaagcacacaaacattatgtgcttggtgtgagtctgtaactgtgacctgctgagatgctgtgactcttcctcccaaaccacccccagtgcctgggacagtgtcctctcccgcttagttctgcagctagaacgtaccaggccgagctcttctctagtgctcatcacaacatttgtgtcctgtttcagggtgtttgttgttgttgttgttgttgttgttgtttttgatttttttttttttttttttttttttttggtgagacaagtctcactctgtcacccaggctggagtgcagtggtgctatcttggctcactgcagcctccacctcccggactcaagcgatcccacctcagcatcccagaatgctgggattacaggcataagccaacttgcctggccctgtttcaaggttttgagttttcttttctgttagagcacctcaaagacctcgtcacgtgcatcttgcacagagcaagttagcaaagttaacaaatacttgctgaatgagcagccctcaagtaaatgccatcagaaatacccactgatgacaactaacgcttatagcagatgctctcatagccatgatctcccttaatcctcccagcagcggaggggagcgctcttctgattggaggggcagggcagagagagtggccctctcaggacccctctgctccttccccagacctggccccaaacttccctgcaccactcaccaggactcacctgggcctggcacatgggaccaggttcccaacagtgctggcacccagtgagcatcttgcctgtctgtcaaggctgctgcagaattcttaaatactgtgaagagttttgtggtgtttgctcagccatgatcatctaactggagcaagaaagaaaccaaaatcgtatcttgagaatggagtgggacttttgattaaaagcttttatgtaaaatgcttatgtgattttgggggtttttttttgaggtggagtctcattctgttgcccaggctggagtacagtggcgtgatctcagctcaccccaacctccgcctcctgggttcaagggattctcctgcctcagcctcccgagtagctggaactacaggcacgcgccaccacaccgggctaatttttgtatttttagtagaggtggggtttcactatgttggccaggctggtcttgaactcctgacctcgtgatctgcccaccttggactcccaaagtgctgggattacaggcgtgagccaccatgcccggtcctgatgtgatcatttcttgaggcagacattcccttttgttttggggatgaaaaacgtcttaacatctgtagtgatggtttgctgacttggggcagttatgaaatacattttgtctcttttcctgactcagaaggtgactgtgtaagttgagttgtgtgagaaacagcacattctagcctccagccaagcaggaatgtctttttaaacagttgagcaaattcccagattagaaagtctggtgcactgatgtcactctttcctgagtaatttttgggtggttgtttactgcacactatctaccaggagcctagaaactttgaatgagtgtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtggtaagtagcagtgttaccaacttatggggtttccagcttaaagcaagtagtattttcagaagcacttgtaaatactgttgtgtttttgcttattttcctgatcagataaagcactggttaagctgaacgataggaagattgtattgagcaatttagggagattattggccagattgctaattgatcacgtaagtgctggcgtgatcacattaggtgtgaaaagaatctgtcctcagacatgtatatgcttgataaagtgctgcgtgggatttctcagaggaattctgttctgctcaagataaactttggcatgcaaacatttcatcttggcccatccttcattttctgcaacctctttttcttaccagctgtctttttcttacctatggctgtgctttaaatggacttgcccatttggaccaaggctattctagaatcatttcgtggagagttagaaacctgatccttctttcccctgtgtataggatcctttattgttatcatctactgttagccaactggtgttccttagataactcagggtggggtctagtgtgtgctaactctgggttgtcagctcccctaagacaatgtgttgtctctctagcacaatcctggaggaagagaaggctcagcaagaagagcgcatgaggatggagtccagaagacaggccacagtgtcctgggactccggagggtctgatgaagcaccgcccaaggtagctacagtccccaccccaactttggggttactcttactaactttcaagatttacagttaggcagctgttttctatgaggagaaagtcaaatatcaggttattctaagagtaatagttataacaccaactaattgtttcctttttgctcgtcttctcgtattaccctcatgtgcactcactttcctcatttgtatttcaagtaggggctctttgaagccatgagcagttggacagatgtcatcttaaaatgcttttcctatgctgccctaacttggaggaggtttttcctttgttgattgtcagagatctccctaatgatcaagtctggattaaaataccagactaggtcacagatgctttgcattttgctttatttaaaaatgagtctgtctctacctgaccatattcctttgttttgtttgttgagaactctgcacattttttgcctttttctttcgtagctggtggctgggttgtttgttgggaaagagagcacattgcagttgcttttgtttccttaataagatcttccggcagcatccttagaccttacttgcccgcttatgttcttatcctttactggtgccctctcctgcctcggagaggtcagcccaggccttttacagttgctgggccatgccatggctgggggttttagccagagtaacacttgccctagattaataagtctttatataccattggcttttgacaggatgctattttcacacactgggttacttgccatgaatactccagttctgttctttttctcaaaagttaaaagataataggattttttgtagttagtagttattaactaccaccatttgatatttgactagttaaaaaatatattaagaaactttgacaattattttctttatgaaaagtgttcagaaacctgataagacaaagtactatttaaatataccaatttttttatcttgaaggctgaaaacttttactttcttggtcatcattttgagctctgtaacagtaaacgtacactgaaagtgaaaataagtgattaacacaattatgcagaagtttagagacagagggtgcctcagaccagccccctctacagagagaaggaccgaggcccagagaagaaacacatacctgtctgatggatgttacattgaacgaggcagtgagaacacctgtcgtttctctgtcattcccagcttaacaacaacaggaaatccttagttacccacagaaaaaactagcacgtaccccgcatcccagcatctgaggcccttcatgttctgtttacaagtttgcctatttttaaatttgtttactactgcagaatagtccagtactgagagtcgggagaatctcatcattaacttctcaggccttgaagtcaagtggattcattcacatgggggtctgctatttacattctgatgactgagcaagtcacctacctactccaaatctcacattccttatttacaaaatgactatttgtattccctacctcttgggtggggatgttaagaagataattcactgtacagcactttatttagtacacagaagtgcaaagtaacataagtatttggtaatgagcaccaaagaatgcaacacttccctaaaactcacaggattaaatcaactcttcatctacacatttttctatatcccaatctgttggatttttagtgagtttaatatgactaattttccaaattaggttcatgggcagtggtgatgaggcttcttggcttcttttttggtttcagagtacaaagactagattggcttaaatatttaaatatccttacacttttttttttaaaagatattttcaaaatatatattttgagattcttttctataagcagattgctgcactctacacaaaggtttatttgttaagtaaacagatgaggaaactatagcccactgtgtttttgttagttttattgaaacacagttttattggaacacactcatttatttgtatattatccacagctgctttcaccctacacaggcataaatgagcagttgtggcagagacagtatagcctacacaatttaaaatatttactctttgacctttaaagaaaagatttggcaacccccagattaaaagttttaatggcggccgggcatggtggctcacccctgtaatcccagcactttgggaggccgaggcgagcagatcacctgaggtcaggaattcgagaccagcctggccaacatggtgaaaccccgtctctactaatatacaaaaatcagccagccatggtggccggcacctgtaatcccagctactcaggaggctgaggcaagataattgcttgaactcaggaggcagagattgcagtgagccgagatcacgccactgcactctagtttgggcgataaagtgagactctctcaaaaaaaaaaaaaaaaaaaaaaaaaaaaaaaaaaaaacggttttaatggctagaaaatcatctaaagtagcatagatatacagatgcttgatgattattaacaaatactaatatgttaattgttgaactttcatgccaatcagaatcaagtcctgtatgcagtttttaccttctcagtgtccatcgttagaatcaaattctgcttctatggtcacagtatttagcacgtctaaaatgagtctgtgatttccaagatggtaggccagtatttcctcacttcctatactttgtgaagtgagaattcagtagattctggtgagttttcataattctgcttgtgatatattagaataagtaagtcttacttagattttttttttttttttttttttttttgagacagagccttgctctattgcccgggctggagtgcagtggcgcaatcttggctcattgcaacctctgcctcctgggttcaagcaattgtcctgcctcaggcccctgagtaactgggattacaggcacctgccaccatgcctggctaatttttgtatttttagtacagacagggtttcaccatgttggccaggctggtctcaaactcctgatctcaggtgatctgcccgcctcagcctcccaaagtgctggggtttcaggtgtgaaccaccacgcccggctgtcttacttagattttttttttttatttcttccttccttcctttctttcttttttttttaaataaagatggggtcttactatgttgcccaagctctcttgagctgctgggcttaaacaatccctttgcttcggcctccagagccacttagatttctgaaatttagataggatctcaggcttctgtagataaattttgtgttattaatactaatatagaaaaattttaatgtagcttaattagttttataagtgaaaagttttgtaagttttataggtgaaaagtctttctctttcccaatcaagattcaaaattaagttcacttacaggccgggtgtggtgactcacacctataattgcggtgctttgggagactgaggtagggggatcacttgagcccaggaattggagaccggcctgggcaacaggatgagactgtctttacagaaaaatttaaaaattagccaaatttagtggcgtgtgcctgtggtcctagctactcagtggactgaggcaggaggatcgtttgagcccaggaggtctaggctgcatggagagtcatgtttgcacctttgcattccagcctgggcaacagaacaaggccttgtctcaaaaaaataaatcaataatgaaattttaattttttttaaagcttacttagttaatagtaaaagcattataaccacaaagccaattattaagaatatgtatggatcacttcatcatacttaataccaattttttcatataataataatatttagagaactttccctgagacaagccctgcatgggagtgtcccattaaatgctcattttcatctgtgcctgttgctttcctgcagattcccattggatcaatagagtgcctcaggataaaagtatcctagaacagccattctcaaagtgtagtccttggacctctgtaggtccccgtgaccattccaaaggtccgtgacatcagaactcatctgataattatgttaagatattatttgcctgaggcaggtggatcacttgaggccaggagttcgagaccagcctggccaacatggcaaaaccccgtttcaactaaaaatacaaaaattagctaagcaagttggtgcctgcacttgtagtcccagctacccaggaggctgaggcacaagaatcacttgaacccaggaggcacaggttgcactgagctgagatcgcgccactgcactccagcctgggagacagagcaagactctgtctcaaaaaacaaaaggatgttatttgccttttccgctaatagagctgctgacaccttagcacaaatcagggcagtgggatgaaattgtactagtcatcactgtgttcttcacccctgtgctcacacaaaaagaaaaaaatgctgttttacagaagaatggccttgatgaagcagtgaaaaatatctgatgtgaagacatgggaagggcatgttagccctgctgctgcacacctagacacgatgtcttatcttgaggaaagcactatacagttgagttgcaaagctggactaaacactttttttcatggaagaccagctttacttgaaagaacagctggcagacatactgttcagagttgcatatttggtagacattttctcaaaagagaaagaggtgaggctgtgactttgaagaaaacaactgtttgttaccggtataaaattcgagttttcaagcaaaaattagaattttgaaaaacttattaccgtgatcttgacagctttctaaattcttagactgttatagtaagctcaggatggtattaacatgtgatattttaaaaatatatgttgtttactgaaatgtgttaacattgggaggatctctatagctcagtaaatcagtatcttccaaatgacctacacaggatgttaaaaatcacacatgagtagaagttccattgaaagtacaagataaatagtggatttttttctccttttttccccccttaattctatggattttaatgtaacagatgataccattgtaaattccacattgcaactcacctttaagaagctaccacttgcattttggtgtcaaatcaaaaaacaataccacagttgtgcccagaatctaccaaaatactcctcccttttccagttgtacagctgtatgagtttactttttttcccctcatatattgcaacaaaacagaacatcgtaagactgcagaaacagatatgagaacctgctgccttctgttaagcctaacattaaagcagatttacatcagtgtagatgtacatgtgtccttcttctcagtttggtttgtttggttttgaaaaagtaggttttttttttttagtatgtgatgagcttattcttaagtgaattaataaatactttttagtatctgttttaatttctaacagtatgagtgttggtagttacattccaaataaacaaaaactcttagagtcctcagtaatttttaagactgtaaaggggtcctgaaaatgattaaatgtttgagaataactgcctcagaacattgttcttcaaccctaatcaaacccagcacggcatttatataaaaaatgattttataatgtcccatttgctaatcctgaaataaaatacataggtaatagaatgacttagcaatttcaaaatatcaatggaggaatactagtgtttggagacctaactatacaggagaaataaaaggaaagtcattttttataacattatgcatgcatgtataaagcactcagatctgatgacattgggagacacggtggcatagccagatccttacacctgtttgtggactcaccatgaatacagcagtgacaaagcagacccccacagctataactgataggaatttcattggtcttggtgatgtcattttctagaatggtaagaaaatcttggtaaagtttaaatgaaacaaaataaaattgcccatcagtatacacagtagttgctgttctggaaagttcagtgcctcataaactatacaaaatatctatacaaactatacaaaatatataaagcagaattcattctgtgttcaagtgacagggattttattgttgctgttgttttacttacataaaattgagagaaacagcagaaagtcctgcgggggccgggcatggtggctcacgcctgtaaccccagcactttgggcagccaagatgagctgatcacttgaggccagtagttcgagaccagcctgggcaacatggcgaaaccctgtctgtactaaaaatacaaaaattagccaggtgtggtggtatgcacctataatcccagctatttgggaggctgaggcacgagaatcgcttaaactcaggaggcagaggttgcagcgagccgagatcacgccactgcactctagcctgggcgacagaacaagactccatctcaaaaaataaaaatataaaaattagctgggtgtgattgcacatgcctgtaatcccagctacttgggagtctgaggcatgagaatcactcaaactcgggaggcagaggttgcagtgagccgagatcgtgccactgcactccagcctaggcgacagagcgtgactgtctcaaaacaaaagaaagaagtcccgcgggatatgaaacaaatcctgctgttcaggcctgtccttctcattgccagaaatctcacatgctgacctctaccttaatgccaattgtgtgatcatggaaagcaccctcactaatacagttctgccttgatatctgcaagggatggagattcaaatccacagatgcataaattccttatataaaatagcacagaattgcatataacctacatacctcttccagtatacttatttttgttgttgttgttggcttgttctgttttttgagacagagtctcactctgttgcccaggctgcagtgccatggtgcgatctcggctcaccgcaacctctacctcccgggttcaagctattctcactcctcagcctcccaagtagctgggattacaggagtgtgccaccacgcctggctaatttttttgtatttttagtaaagacagggtttcaccatgttgaccaggctggtctcaaactcctgacctcaggtgatctgcccaccacggcctcccaaagtcttgaaccatcacgcccggcccatcttcccatctttcagtatactttaaattattttaaatatagatacagattttttttttttttttttttgagacaaggtctcgctctgttgcccaggctggagtgcagtgatatgatctcaggtcactgcaacctccacttcctgggcttaagtgattctccagcctctgcctcctgagtagctgggactataggtgcaagccaccattgcccagctgattttcatattttttgaaatatgaaaatcttctcatatttttttcaccgtgttgcctaggctggtctcaaactcctgagctcaaagcaatctgcctgcctcagccttccaaagtgctgagattacagacatgagccactgcacccggcttacatagttattatacttatctttttgtttgtattattttttattgttgttttttgtttttttcctgtatgttttcaatctgcaattggttgaatctatggatgctgggcctttggatatggagggctgactgtaccctaaatgcttctgaaggaacagtgccatccagttgaggacctctggtttagaataccagtgtcttcctttctctccttcctcattagggagaatttcagcaaaacttccctgttccatattttgcttcattaaaatccaagtttctgtcttggaggaggaagtgtcatgaccttgctaactcatcgtacttaccagcagttgacacttttggactcatatgaaagccattttcaaagatcttgacatatattaacatatttaatcttcacggcagctccaggaggtagctgctggttattgtactccttttatcattgacaatagggagacacagagagctgaagcaccctaactgtgaacactgacagtctggctcaaagcctgccctcttgaccaccatgctaacctctgatttgtagagaacagaagtagagctattttaccaatacatttgcactctccatggctgttggttagcaacatttgattttgtgttgtcctttgtgcaaatattttgtctatcataaaacatattttcaactttttaccttttatttttattttgaaatggaaccttgtgttatcatttgctacccagttaagtctttgcatcactgtgagatattttacattggttttgccattctctgatctatttgttttgtatgttcctttttatttggtgagtcagaagtatgcttgtcatagaatagcatcatggcacagtagattttggagtcatgcagttccaccattaccacctatatgcccctatttaaattgcccaatttatttgagactgtaaaataggggttataatattgcttcatagcaatgtggtgatcaaaattatcaaattgtatgtaaagtaggtagttcagtacacacagaatacacagtaaattgtaactttttttttttttttgcctgaatttatcaagagtacatcactgtgcaactgtcagctctgtttattgttctggtccctggctctgcctccttccattcttggactccaagagcatttgattcagaaaaccctttcccctgcaaccatcattaatgcgtatatattaacacatatctttaaaacaagtaccaaggtagccgaactcttttttttaacctcttttaattcagcacaaccactttgtagaacacactttggaaattgccaccctagcacacacagtagagaaaagcctagaatgctctctttatacccttttcctgtttggggtgtttttgggggaattcatgttgttatttagttaagtttagagtagactctttctggaacactgtttgaaacgtgacagggttaagccaaaaggaaggatttttcaccctcaggaatttaacagctcataatagcagggctagagcaagtgcaaaagtacctgcaaccgaaggtagggtgtgaaaaaggcctccttaggagagcagaggacatatgtttatgttaggctggcaaaatcacgagctgttgcgtgaaagaagtaacatctaaaagactgaaaggatcagaagtatactacagatggaaggaggagacattccaggcagaggggacagtataagcaaaactgagggggaaatgagacagattttagagaccaaaacatactccggacctaactagagcaaagcacgtgttcacccagcactgtgggagagagagacagacactaaggcgttttctttcctaagcttgttggaacttaaatctatttccttttattctgtacttaatttggctagacagtaatgggtttccaccttgttaaaccccccaagttttaaaagactttattgacttctttcagacttctgtttcagactaaattgttctttcactatgaactttgaattcatttatcccacaaacaaaatgagaatttaagacctggaagtgactttagagatcctgtagctcacccccatcttatgggtgaggaactagaagccagtcagtttcgtcacttgatcacagtcacgcaaccgggaagtagtcaaacaatagaacacaagtgccttctctccaggtcccagactactggacagagagcatttgggtccctcaggctcagaatattcagtatcccattttgttattaatgatactttaatagctttattaagatacaatttacataccatacaatttatccattgaaagtgtgcagttcggctgggcacagtggttcactcctgtagtcccagcactgtgggaggctgaggcaggcagatcacttaagaccaggagttcaagaccagcctggccaacatggcaaaaccccatctctactgtaaatacaaaaattagcctggtgaggtgccgctgcctgtaatcccagctacttgagaggctgaggcacgagaatcactcaaacccgggaggcagtggttgcagtgagccgggattataccttgcactccagcctatacggcagtctcaactcaaataaataaattgtacaattcgatgtttttttagtatattcagagttgtgcaaccatcgccacaaccagttttaggacttttgttttgtttttagtagagacggggtctcaccgtgtgatccacctcggcctcccaaagtgctgggattataggcgtgagccatagcgcccagcctataacatttttatcacccccaaaatgaaatccttcacccattagcagtcattccccatctcctcctccttccaacccctggcaaccacttatgtacttgctatctatattaatctttcctattctagatatttcattaaagaaatcatatgttctttgtgactggcttttttcacttagaatgtttcaaaaattcatccatgttgtagcatgtgtcagtattttattccctttaattacaaataatgtccctttcgtaggtatacagcattttgtttatccagttatatcagttgacggacatggactgttccccctttttatctattgtgaataatgctgttaagaacattcatgtacatgtttgtgtttacttaatttgtttttttcaaaggtacagtcttgctacgttgcccaggctggcctctaattcctcggctcaagcaactctctcactttagcctcctgagtagctgatctacatgtttttgtgtggatatatattttcatgtctctggactttacatatacctgaaagtagaattgctggatcatatactaattctttatttaatttttaaggaatagccatactgtcttccatagtgactacaccattttacattcccaacagactggcctgattggttttcaactcctggcctcaaaggatccgcccaccccagcctcccaaagtgctgggattacaggcatgagctaccatgccctgcccaagatatactcttaagttttcttctaagaatcttagtttttaacttttacatttagacctgtacctgtaattcattttgagttaatttttgtgcatgtgggaggaagaggtcagacttcagtttttcacatgtagctatccagttgccacagcatcatttgttgaaaagactgttctttccctattgaaatgtcttagcatctttttatcattcttttcaagtaagctctattaggaaaatgtctttttcgattcataaagtacaggtttgtcaaaatcaaaaggttcattcatatgatgctctcttgattttacagcccagcagaccgggttatcccagtccgaggtccagcgaaggattttatcccagcccacagcacatggtacaaaccaatcattaccaggtatgccagtcattacagatataaactgtgttattttattatttagcgcttttggggtagagcggtacattgtgcatatttttatttatgtacttatgagtatgatttggccgatagaaagctgagaaagtggttaccctaatcattgaatgatgttgtcttgacaccccacgcagaaggcgtttgtttttcactccatcttcgagtgggcaggaccagggcctgctgccattcttaggcacgttttcatccacttgctgtggtaaagggcaaggtgaagccagtgggcacacacactgcagagggagtactgaactggacagtttttatggaaggcaagaacaaaattcaaaattaacagaacccagatgaaataccatatggacaagtgtgaaaagtgttagatttatagatagatatcctgtgcaaattagaaaaaattatccttcaaagaaaaggacttgacacaaagtaaacaattcatttgtttttgagaaaaagttattaacttttactggggtataccttacaatgcacaggtctttgttccgagaggtgcataccccagtgcatcccatcctcacttcaggatatagagcgtgtctgtgaccccggcagttcctttgtgccccttcccatcaggcacctcctgccccaggagcaaccattcttctcacttctagtatcagaggtttctgcctgttctagaattttatataaatagatcatatagagtgtgctttttagggcttatctttttttactcgtaatgtctgtagaagtcagagtcctattgaaggtgtcagtacttaacctttcctacttccttcacagagttgttgaaagcgtggtttaaattaaggcctcttgggtcaaaatgggcaaaaaatcttaactattggtacttaactgtcagtaataagggagaatgtaagcactttcttattggaaaagatatgtcagtggtagtttagaacagcaaattttagcctctttatctagccgccagattctaatgtctaattctggagcccaagaatagcttattgttaacaagcagcctcagtaggttctgaggcagatgactcagacctgtgttttgggagacactgttctgagatggccacttgcctggcagagtcaagagtgaatcatttgagttttcgagggcacctgtctgttcattcagcaaggttgcactgaatgttcatctactctgcctggtactattctagggactgggaatatgaagacaaataaagtactcttttttctcatggaaggagctcacagggccctttgtcagtttggattactaccatttccataagtgaagaagccaaaaccctgacccagcacaagggtcagagcaatgggaagtacgtaggtggcctaaagaaagaaaccccacctctatgattgctgagagaccctgacctctggcagacaagcagatgggccccaggggaacagcccgagtctgtgcctggctggtatggaaagtgaactggccctgagtgggaattgaataccagcattgttttgagaaaacatgcagcacctgcttaatgagacaagctgttagcagagagacagttctctttgtgtcccagcaggcctggtctgcggcactgtcaagatttgaaactctagtacgtgtttgttagtggctgtctgtcaccagtgcagtggaagcccctgagagtggggacttgtctctaagggcttagaacggtgtgtaaaaatgagtaaatagagaattaagtaaaacattgatttttttcattgaactaatgtatgattaacctttcccaagcccaaattctcctctcttgtaaatgagaccaactatgagacatttcctgatgttacttcatttttagcctaaagtgatccttctacatggttactattatgtagaaaactgccttagaccattttaaacctccttgttgtgaaaattcctaaatgttttctggcaataatacatcccttttcaccagaaatcttgatagagcattttgcatttagtagcagtttttattattattttcattcaaataaactgtgagaactaactatatgtcttacttgaagattcattaatttcatattgtccatatgaaattttggtataaattaatgcctagagacctaataaatgcacaaaacctttgttgaaggatgtgttgatatttggaaatacggttttggctgtgctttatctcactaaaaaattaactgacaacacccaccatacaacactagcctaatgaggtgtggaaaccaatactgattctgttctctttctcttgattgagagaaggaaccatgtaaagaaacccatcttattttccctctgccttgaaatttttctctatgtccaactgaatgtcttctctctgccttagtcatcattgttagaacttaaaggtacgacttaccctaccatcagctcccaggtcattagaggacaaacatttgggggattttttgtgtatttttgttgttgttgttattcttgttgggggatagtggttgttgggcaggaaaggggatttctagagcaaagtatggcacagacatttttgtggcttcctgttgcttttgcatccaaggatggcctgccctcattattttagtaaatgtgaaattccaaagaaacagtttcttgttttctagtatatatttgcactagctctctaatgcagccataacaaatgtcctttcttgagattttagctgagagtccatttccttgccttatcagcttctacagggcacctacatgccttggctcatggtccccttactccatgttctgaaaccagaagtttttattttctttttttttttgagacggagtctctctctgtcacccaggctggagtgcaatggcccgatctcggctcactgcaagctccgcctcccgggttcattctcctgccttagcctcccaattagctgggactacaggctactcctgaccttgtgatccgcctgcctcggcctcccaaagtgctaggattacaggctagagccaccgtgcctggcccagagccagcagtactaactctctctgacccttcttcagtggtcccattgtccctccctcctcttatgcttccctcttgcacttttaaggacccttgtaattacactggactcactcagatatcccagataccctcccatcccaaggtccttgacttataaccacatctgcaaagtctcttttgccacgtaaggaaacatattcacatgttcaagggattagaacatgggtatctttggggggccataattctgcctaccacaatattctctgtaattttagtttcctttgtgtgtgaagcagaactgtgcagatgttatagttgaacattaccttgcctccttactcattcacaggtttctggctaccctggttcacatggaatcacagccatggctggcagcatctatccaggtcaggcatctcttttggaccaaacagattcatggaatcatagacctcaggagatagcaatgtggcagcccaatgtggaggtaaatcgggtgtcttgggcttcagtttgttaacttataaagcatggcaaagctgggcatggtggcttacacttgtaatcctagcacttttgggaggctgaagtaggaggattgcttgagccccagagtttgaaaccagactgggcaacatagcgagaccctgtctctacaaaaaatagaaaattagtcacgtatggtggtatgtgcctgtagtcccagctactcgggatgctggggtgagaggatcatttgagcctaggaagtcgagactgcagtgagccgagatcatgccactgcactccagcctgggcaacagagcaagagcttgtctcaaaaaaaaaaaaaaaggtaataaataaagcatggcctaaggtaccttttatttctaaatcctaagatttattgattttaatgactttttttttttttttttttttttttggagacagagtcttactctgtctcccaggctggagtgcagtggcacgatcttggcttactgcaacctccgcctcccacgttcaagcaattctcccgcctcagcctccagagcagcttggattacaagtgcgagccaccacgcccagttaatttttgtattttttagtagagacagagtttcaccatgttggccaggctggtctcgaacttctgacttcaagtgatccacccacctcaccctcccaaagtgctggggttgcaggcttgagccaccacacccggtcatattttaatgacttaattcaaagatcaggataccccatctactcaaatgctttcaggtttaatgaactttttttaactaaaagaacccagggagaaatactaaaatctttagtccatttatttgaaaggcaaagccctaagtggactatcgtcagcatgtacatgaggccaacgaagaaacaggaagacagagcattcagttctttggaccatgttaatttttactaaattttcttggtaaaaccaagaactactcctatagtttaaaaatttatttgacctaggtacagtaacacaacccatagttgcatctactcaggaggctgaggtgggtagataacttgagcctaggagtttgaggccagcctgggcaacatagcaagaccccatctcattaaaaagacaaaaaattacttatttgaatgaaagagcatctatagttgtctgctatttatgttcttttatttaatatttaatactctgtaatatgtattgtatttcagccttctattacttctagattgtttctacttttttactataagtaacaatgtattctttgcacatatcttgtgttatttctttaaaatagacccttacaagtgaatctgtgagctaaaggattgcatactttttaaagatgcttgatgcacattaaattgccccctacagaaaagttattcccacaagcacagtatgagagatcctgtttctcatacttgctgttttgcttatcttttcttgaaagacacataaaacaaggtaagagcataggaatagacttatgagactgaatatgctgttttcaacccttcttccaggactctacagtattggacctgcgagggattgggcaagtgttgccaacccatctgatggaagagcgtctaatccgacagcaacaggaaatggaagaagatcagcgctggctggaaaaagaggaaagatttctggtaattgtgtttctgaaaggcttctttgactttttaagccctgttagagtctactatattgcaaattattgcaaaatgttatctttcaaagcaggagagttagttttacaactacttcttaaaacttggaataggccaggcatggtggcctatttgggaggctgaggcaagcagatcacctgaggtcaggagttcgagaccagcctggccaacatggtgaaaccctgtctctactaaaaatacaaaaagtagccgggtgcatgcctgtaatcccagctacttgggaggctgaggcaggagaatcgcctgaacccaggaggtggaggttgcagtgagccgagatcatgccattgcattccagcctgggcgacgagtgaaactccatctcaaaaaaaaaaaaaaactacttgaaataatatggctggatgtggtggttaatgcctaaaatcccagtgctttgggaggccaaggcaggaggatcacttgagcccaggagttcaagaccagcctgggcaacacagcaagaccctgtctctacaaaaaataaaaaaaaaaattagccaggcattgtggctcacacctgtagtcccaaatatttgagaggctaagactgagtccaggagttctagattacggtaagctatgattgtgccactgccctctaatagatccagaatcctatatccaaaacccttaagggccatgtgtgtttcagaattcagtattttttaaatactaaaaagttagtgtagtatgctgaacattatacattatttaagactctaatagcatcccagagttaaaaccactagtgtttctgcagcagaatgcaaataatcacattaacagttaaatgaagattataagatgcttcatcggttcaggttttactaccatattagtttgtttcaaacataaaaaacacacttaacattttcagcactttttaggttttggaaatgaggatagaggaatgtggacctgtccatttattatcttcattttaacagaacaggaaatagagatctagagagaccctgggccacagagcaagactctgtctcctaaggaaaaaaaaaaaacttgcaataatgggttatttgcttttttaattatcttttagggataaatttctctaaaattttagtagtgtcattatgggctcagaaatatgagcatttgtttggtttttgcattaccacattgtttacccagaaacaactcctgcttccatgtcagcttacgtataaactattgcatcttgctactgcaggctgtataacaagacagctaagatttgccttcctggcatttatgactgatgtgaacctcctcccggatgtgtctggacatatgcatgggaaatgtcttctttcaggcaacccttattgaaaaccacttcagaagtcccttggggacagagaggaagtggtgggacagagcaatctctgtatgttacttgacacaaaggtccttttagactcctggtccctgttgccaagcagttctatgccctcagcctcagaactaaggactgtgagaacccattccccactctccttgaacccagaatagctatttcaatcttcctgtagttgcctcaatcgtattatggctgaaagaagccaggattcataattttgagccagtaactttacctggtctctcatgctttgtatcattaaacattcactgacactaactttgtgttaaatttaactaatttagaatttcgaaagcataggataaaactttccttctgaattaaagcaaatcttgagattgtaaggcagatgggaaaaaaaaattgttatttttggcctggcacggtggatcacacctgtaatccatcccagcactttgggaggccaaggtgggcagatcacttgaggccaggagttcgagaccagcctagcccacatggtgaaaccccgtctctactaaaaaaaaaaaaaaaaaaaaaaaatacaaaaattaggcaggtgcagtggctcatgcctataatcccagcacttcgggaggctgaggcgggctgatcacttgaggtcagaagttcgagaccagcctggccaatgtggcaaaaccccatctgtactaaaaatacaaaaattagccagatgtggtgatgcatgcctgtaatcccagctattcaggaggctgaggcagaagaattacttgaacccaggaggcggaggttgcagtgagccaagatggcgcagtgtactccagcctgggtgacagagtgaaactccgtctcaaaaaaacaaaaattagccaggcatggtggcacacacctgtagtcccagctattcaggaggttgaggcatgagaattgcttgaacccaggaggtggtggttgcagtgagccaagatggtaccactgcactccagcctgggtgacagagtcagactctgtctggaaaaaaagaaaaaatatgttattatttactaccactaatctgagtgaattaatttggatattatatctattctaagaacatatctactgttctctagtcctacattttaaacctattttttgtctagatagcctcttttaccagacagaattgatttgtgtttttaaaagtagatattataaattctccaaactagagttcttgtatttcagtcccacgtatgactgcatttggacaaagggtttgctaccaaatgttgtggtactgctgtgatgttgctctgacaaagaagaacataaggaagagcagaagaggaccctgtgtgtcactagggggacttgggggaggcagcagagtatagatagcatttgagccaaagcttaaaggagaaattggaatttttagggcagacaggctcaggaaatacattccaggaagagcgaagagtgcgggtaatgacatggagtcaaaaggctatattccagccaggcacagtgactataatctcagcttctcggcaggttgaggcagggagatcgcttaagtctaggagtttgagactagcctgggcttagcaagaccctgtggcaaaaaaaaaaaaaaaaaaaaaaaaaaaaacagtaaaccctaaagggaggaggatcaagtacccagaattcctacaatatattatctaaaatgtctaatctccaacaaaaaattacaagacatacaaaggaacagaaatatatatgaatgatagacaaaagaaaaaaagactgttctggctgggcacagtggctcatgcctgtaaccccagcactttgagaggcagaggtcaggagttcgagaccggcctggccaacatggtgaaaccccatctgtactgaaatacaaaactggcatgcctataatccaggctacttgggaggctgaggcaggagaatcgtttgaacccgggaggcggaggttgcagtaagccaagatcgtgccactgcactccagcctgggcaacagagcaagactccgtttaaaaacacacacacacacacacacacacacacacacacacacaaaccgtattctaagaacttcctgtagctagatgtgagcaaagcagagcatgtttgtggggaaatggaaaatacttctcactatgtggtgtttttttttttgtttgtttttgtttttaacttaataaccatgtaattggagcatcttcatttggtcctaaacctgtctgttgggtaacctctgagatagtttgcctggtgctaaacttggaggccatgatggcatcgaggcactttcccactcaagtacctttcctttttttttttttttttttttttttcccggaaacagggtctcacactgtcacccagggtaaagtgcagtggcacaatcacggctcactccagccttgacctcctgggctcaatctgtcctcccacctcagcctcccaagtagctgggactacagtcacgcaccaccacgcccagctaatttttgtatttttggtagagtttcatcatgttggccaggctggaacaagtacctttcttaatgcctgtgagatggtattgtatttttctctttgcttgttttccttacttagactgagcaccccatgagtgcagagaccatggaccatgtctttcctattccccattcagtccaccatgccgagcatatggaaagctgtcagtgttgactgattaaatgaaagtttcttttttctcttttatgagtttatttttttctttttgtaaatgagtgttttttaactcatgccttttctcatgctgctgtgtctgcctggaatgctcagggaatctgcctgaggaacacctttttgtctttaaagattatttttgtgtcatctcaaggacgacacattccctacaccagggtttctcagcctgggcattgttgacctctggggctgggtaattctttgttgtaggaggctgtcctatgaatagtaggagttcttagcaacatccctggcctctacccacaaggtgccagagaaccttactgagcgccaagcgtgaagcttgaattaacttattttattatgatgtgcactactgcgttctctcccccaaccccctgcactctcacacatgctcactctcactctctttctctaataaaacgtaagttccttaagggcaacaactgtgacttaactgcctttatcctgcttcatttttcttctaatgtttctcactgtatgacaatgtctcacttgttttcctgtctcctccactaaagtgtaagcatcacaaagatgggaactttctttattcagcactctcccccagctcccatcgtaccgtttgttcagcagtaataaggctcagccagcatttattaagcgaatgaatgaatgtaccaccgtacagtgttaagcatctaaacgttagaggcccagaggaaggaggagtcccggacaggaatcatagcattggtgtcactgtttttcatctaaatgaaaaataaaaacaagtcatacatgaaccctggggaagtagatattataattattttagaaatgaataaattaaaatttaatatacataaaagtcacaggggaccttttaaaattcagttccccaggactagagaactgcagtggatctggagaggccaaggacctagagagataacaagcaccccagttgattgttgagacgtggtcccaaggtcactctctgattacttaggcttggcaatgcttttcaagatttgaagcagatggcatctcagaaagatcaccttagggctgggcactgtggctcatgcctgtaatcccagtactttgggaggctgaggcggatggatcatctgaggtcaggagttcaagaccaacatggccaaaccccatctctactaaaaatacaaaaattagccaggcgtggtggcactctcctgtaatcccagctactcaggaggctgcagcagcagaattgcttgaacccaagaggcagacgttgcagtgagctgagattgttccactacactccagcctgggtgacagagtgagactctgtctcaaaaaaaaaaaaaaaataggaccaccttagcgttgcttgctgactgatggctcagaaggcaagataggaaatgcagagatccaataggaagttgagtggtcattcaaataaatgacagcagggtctaagctggaagaggcaaagtgggaaggagcagagaagacggacttaaaagggacaagatttggtgaattggtataggaggtcaagaggaaggaagaatccgggacaggaatcatagcattggtgtcaccaaaaataacattgtgctaccaaatgaaataaaattcagaatgaggagtccatgtcagggaaacatgatgatgccaggtttggacatttgggatatgcaaatgggaatgcagaggaggcagctggatatagggcatagagcccagaggaggtggtctgcgctggagatgcagatttttagacagccgcatggaaagcttggtgcactgggaataacgcctggtgcggtgtagtgtgagggccaccctgaccctctgtcagttggaaggtagtgtgtgtcggttgtagaagctctcgtgacactgtcaagtggtgatggtggcagctaggtctctggttatgagcacacgtgctttatggtccttaatttggtgaagagactctaacaatggtaattatatctcgttgtggtcctttttatgctgtgtatgtgtaaaaattactgttggtttccatggtatctgctatttacaagcttgtttctgggtcttggcctttggcatgagctaggcccagagctattggtctgtgtccttgcaaccaccaggccaggccgctgcacctacttttaggttaatcaggtcattgttgaagctgtgtgtcagaagtctttctctcctgttaggccaaggaaacttccaatacagggcttctcagactgcatggaagggccagtttgtatctttctttctaaaccgttgcagaccaatactcttgtaaaataaaatttcaaaatcattgactagaaaaagacataaaaatataagccagacttttttgacagcccaaaaattactgtttcaaattgctataaaaatgtctaaagatgcttaccaggccgggtgcggtggctcacacctgtaatcccagcattttgggaggccgaggcagacggatcacgaggtcaggagatcgagaccatcctggctaacatggtgaaaccccgtctctactaaaaaatacaaaaaattagctgggcgtagtggcaggtgcctgtagtcccagctactcaggaggctaaggcaggagaatggcgtgaacccaggaggcggagcttgcagtgagccgagatcgcgccactgcactccagcctgggcgacagagcgagactccatctcaaaaaaaaaaaaaaaagaaaagaaaagaaaaaaagatgcttagcttctgttttcatcttcataaactggttcattcctagacccacccaggcctactgctctggccctgccatttacttcagtaaggtcagctgtgcaccctattagataagttctgttcttgtttgaaaaattaacttgctttgtcagtagtattacccaaattttagatgtcagaagacatctgttttgacatctgttttcagagatcacatcatcacatcattttttatggttgctactgctagtcacatctcttactttttgagtacttcagtgggtcaggagtccctcctctggatctctgcattatctcaacaaccctgcacagaatgtgttttatgatagcagcccggatgctcttgcccaaggtcacatggccccacagcagatactctgtactatacctagtgctccttttttttttttttttttttttttttttttttttttttaattgagacaaagtctcactctgtggccctggctggagtgcagtggcacaatactagttcactgcatccctaacctcctgggctcaagtcatcctcctgcctcagcctccttccagagtagctgcgactacgggcatatgctaccaagcctggctaattttgttacttttttttatagagatagggtctcactttgttgtccatgctggtctcaaactcctgggctcaagcagttctcccaccatggcttcacaaaatgttgggattacaggcgtgagtcaccacgcctggccccacactcccttttcttgttcccagatcagatactgtcctttctgaaatagttctgtgcctgcaaatatactctgaaagctgtcctacaaagtgagtgccagagattgctggcaaccttagttagaacctcagttggttgaaagagctttctttcccattgggcattgcttaaaaatagagtaactttgcaacttgctttttttttttattactgcatgcacaataattttctaatgtgatactatgcttaaaacaggattttaattttaaatgagaaagccctatctatataaagcctactttgtgttttgagaaagaaatatgtgagcatttttccctcacatagcagatccagtcagtctgaatgaaagatgaatgccgagacggggaactaaagagcagtggcaagaggctgtctgtctgaagccaggctgctgtccctgcttctgctacgcagcaaggccaacagctctcctattttttccctcataccagattccagatttgaaagcaatacagtatagtgaaaggagaaaagactgagctataaaccttaaatttgaagttttctagagccatacccacatgaaagtagagactgtagctaagccgaactgttttttttttttggcttgtttgtttttgtttgttttgagacgaagtcttactcttgtcccccaggctggagtgaaatggcgcaatcttggcacactgcaacctccgcctcccgggtttaagcgattctcctgcttcagcctcccgactagctgggactgcaggtgcctgccaccatgcccggctaatttttgtatttttagtagagatggggtttcaccatgttggccaggctggtcttgaactcctgacctcaggtgatccacccacctcggcctcccatagtgctgggattacaggtgttagccactgcacctggctgagaatctattctttctgattggctgtctttggctgtattgctcttcagttcccaataggcactcatctttcattcaggaggtccgtgtatgctctatgaaaagaaaaagctcaagtatttatttcattcacagaacacaagtagattttatatggataagcctttctcattttaaaattaaaatcctgtctttaggaaaataccacattagggaattatgcattaaagaaagtcatttcatgaaatgtatatggaaataaaaatagattaattcatgtaaacacatgaaacaataccttattctataggcaaaaatatgagttgcattttttgtttaagtaaaacagtaaatatttcctgcctgtagaaggttcttattatctgttgactgattgaagcccacctccactgtttaagagctgtgttaccccaagcaactaaatctttctaagtcaagttcctcgtctataacatatctcttgtgccttggatattaattgaagcattccttcagcaaatatttactacacatctatgtgcacaatgctgccaggcacttctttcattctgataatgactgactgaggtattattctgcctattttacaggtgaggaactgggcctagagaggttatatgccttgtccaaagaggcatggacaatcagttcactagaaaaatgcacagggcattcatttcctccacctgtttgtccggtgttctagcaggtaacagagacgcagcggtgaggcagacagcttcatagcctctgtcttcatggaacttagcatctcatgataagaaacaaaaatggtcaactatttggggaaagggaggaggagaggagcaaattacaacaatatattatacagtattttctttatgaattggttgagagttttaaaatgataatacagtggtgttagggtacagtgagagaaatgctatcacatattgctacatagatgaaaatcaggacagccttgagcagtttggaaacttataccaagatttttcaaatgttcaaactctttgacttagtaattcctttcttagaaatctgctccagagacaggaagatcacttgagcacaggagtttaagaccagcctggataacatagtgagaccccccacccccaaccatctctaaaagaagaagaaaagaaatctgtcccagggaaataatcagggacttagtcaaagatttgtatacaaaggtgttcatctacagcctatttatgagggattttgaaaatgaccctaatatccaacaataaaagaactatttattttaactcttgtgtggcaccaacttagtactttgcaaatattaactcatttcatcctcctaacaatcctatgtgttggttacaattactgttccattttagaaatgaagaaattgaggcccaggtcacacagcttgtaaggactggatcctcattagaacccaggccacctggtgccacagctcccacccttcactaccattgtctattttatgatgataatcatgcagtggaacgttgtgcagccttaaacattgttttgtcagtttgccctatataaatgttatgtgaaggctgtagaatcatatgttgtggttccatgtttgtaaacatacatttacaccacagtattaactaatgataattacttttacattttaattactccataataactaatgataattacttccaaatggtaaggttgagtgatttgtaattttttcatctatttttgcagtatcttaatttttctacagtaagtgcatgtttcttttgttagattattgacaaatgaggtatacaatattttaaaataaccaaaatcatgtaactattaaatgaccacatcgtaagttgggcctggtgggtcttttgttttcttagactatagctctaactgggcgtggtggcgtgcatgtatagtcccagctactccagaaactgaggcggatgattgcttgaggccaggagttcgaggctgtaatgcactatgattgtgcctgtgaatagtcgctgcactctgacctgggcggcagatcaagaccctgtctcttaaaaatagaaactgttggcctggcgcggtggctcacgcctgtaatcccagcactttgggaggccgaggcgggcagatcatgaggtcaggtgatcgagaccatcctggctaacccagtgaaaccccatctctactgaaaatacaaaaaattagccgggcgtggtggcggacgcctgtagtcccagctactcagaaggctgaggcaggagaatggcatgaacccgggaggcagagcttgcagtgagctgaggtcatgccactgcactccagcctgggagacagagggagactccatctcaaaaaaataaataaataaaaaatgaaaataaaaacttgtcctttctgctacagtagagtcaaacctaatcacctccactctctgtttagagcccttcaacagaacccctaagcagaaccagctcccagctggtccctcaagtgaatgggcagaagaggaaaggatagtttcagagttttttaaagttacaagaatggtacaaagaattcccatgttccctttacctagagtctccagttgttaacatttgacctcatttgctttgcatatttgtacataccattttttctgaaccatttggaagtaaataccagatatcctgctttttaactcttaaatagttcaatgtgaatttcctaaaaataaggatgttctcttaaataaccatagctgagttaaccaatgtcaggaaattaacaataatacaatactgttagctaatcaatggactattcatattttaccagttgtccacagaatgccctttctagaaaaaagtcctggatcatgagttatatttagttatcacatctcttgagtttcctttaagcttgaacagttcctgggtcttcccgaaatctttcctgaccttgatatttacattgagtaatgttctgtgaattgtcaacctggagtctcgtcttctcaggtactttttctcaaagtccattgtgttttggaatattttttcttaagcatatctgggatgtttgggccccacaaagctgcctcttcattcaggcagtggcagaacctcagcattccatggaataggatctgtgagttctgctacatggaataggacctccccagtgagttccccttcagttgccagttggaatcaatgtattacgtgtgtttgcttggtttcctttctgtctattcatgtctatcttacctgtcagagaagattctatcctagaagtcaggaactacctacctctgaattttctcttgagctatatttcacacccagccacagctgtctatatctaatgggatagtcctctctggtaaaaaacacagcatactttctgccatagtcgccaactgcatgcctctaggtttgacttcccctgtatgggcattagttatatatatcacatctgcagtaagaattcattttttaaattattgttccttgatattatagtacatataaacacagtacaatgttttaagttatgctcttcagagttcagaaatatttattctgaacttttctggtttactcattgagagagttctaacagagcagagtcttgcttagtcacccaggctgtagtgcagtggtacaatggtagctcactacagcctcaaactcctgggctcaaaccatcgccccacctcagcctctccagtagctgggactcaggcacacaccaccattcccagctaattgttaaaatttttttctttgtagagatgagttctcactatgttgcccaggctggtcttgatatcctggcctcaaagggtcctcccacctcagcctcccagataaggtgaaattgcaggcacacaccaccacacccaacgctacatttgaggatttaggtcatttttcatctatatttaactattgcttttaaatgaatatttttacgtgaaagggaacatgtttttttatatagtagcatggaggttaattcagtcaacactgatgtgttgagtgcgcaccaaccaggaactgtgccaggcactagggatatggggctgatatacatgagctgttttgtaattctgttgaatgaacagataagtaagttgtgacttttgccctctttgcttactgtctgctactgctgtcagggctgtctattctgtttcaggatgcctctgattattagaatgtttttccataagtgatccaaaatctgccctaaattcagggacaacacacaagtttcaccttttcccatatggaatccctgaggactgttaacaacaatcagccagagcccccttttagtgattagccatcaggagctcctttacccacttcctggtaggagctgttctcagacctcagccagctacctccaggcactgtgcctgggagggaaggaaagggggaagggaggaagaaggcaaaggacagtgcagggcccctgccctggaaagtttgtttttacctctgagccatcagaggatcactcttaccttaatggtggccgtgtccttcaccaacttcctactacaccctggcacccacgactgaccccgctttgattagagatagttaagacagagacaaaaagcctagtaggaactgatacaatgaaaagggtttgggctacagcactggaattggaattggaaaagaagggagaggtgaagctcatttctccatcccccacccaacaagtgcttgcagatggtgtgctcagtggcaggctcaggtgtgggaaataggagatacacagacgaatcagacatcaagatgctccatctctaatgagggaagtaattatgcctgataggtgccaacatagaggtatctgtaaggcacaggctaagaagcgaccagctctgcttgaagagggaaatatgctgccaagaaagggtgtctggctcagccttgaagagtgaacagaagttttccgggaagaagtatgtggccagtgttcacgggcaaaggggaggcaggagccactgtggtagaaggcccgtaacccatactgcgggagcacggggttgttttcatgaggaaaagcctttctgccctgttccttcaccataaaggcacgtagcctacttcgtttattctgatattggtgaaatttccgtactattatttacgtaaaatctagatttctctgtttggtttctatattctagatgcagtgtgggaaaacagtcttgtaattgaactcatttgctactttggcaagacagctaaatccgtataagccatattctgtcagaaagccgcaagtaatgcctgatatttttatcctggggttgcgggtatctcagtgaagaagaaagccatctgtgctacttggaatagaggtaaagtgcaggttctccagcactgggtgggccagtgcaggtaccagtctgtaaggtgtgcgtgtgtggagaggaatgcagttcttcccaaggcagccaaccttcatttatcatcactggaatttttttgaaacgggggaactttcaactcttcttattcagaggacaattgtgttaaaaaggaaggaatttaatacagaatctgtcaaaaattttcaaatcaaaaatgaaattgttttgattttgttttaatttcttcagaaacctgatgtgagactctctcgaggcagtattgacagggaggatggaagtcttcagggtccggtaagcctgagttttcagcaggatttgatttccagttctcctgtgcgtggaccatcagtgtttatgtcacaatatatccaagtttactaatatttgtaatagggaacagaatattctataaagttaacattttaagattatgaaaatctatgatgtacagcctagaatttttattcagatacagaagttttctgcactattattgataaaggcttttttttttaacttttattttagtttcaggggtacatgtacagatgtgttatataaggaaatcgcatgttgcaagggtttgttatacaggtcatttggcacccaggtgataagcataatacctgataggtagtgttttgatcctcaccctcctctcaccctcctcccaccctccaccctcaagtgggccccggagtctgttgttcccttcattgtgtccgtgtgtactgagtgtttagctcccctttataagtgagaacatgtggtattggttttctgttcctgcattagttcacttaagataatgataatgacctctagctccacccatgttgctgcagaggaaatgatctcattctttttgtggctacatagtattccatagtgtatacataccacattttctttatccagtctatcattgatgggtattgaggttgattccatgaccttgttattgtgaacagtgctgtgatgaatataagcatgcatgtgtctttatggtagaaagatttatattcctttgggtgtgtacccaataaggggattgctgggtcaaatgctacttctgttttaagttctgagacatcgccaaattgctttccacagtgaccgaagtaatttacattcccaccagcagtgtcttaagtgttctatttctccacaaccttgcatctgttaattttttgactttttaataatagacattctgactggtgtgagatggcatctcattgtggttttgatttgcttttctctaatgattagtgatattgggcattttttcatatgcttgttggccatgtttatgtcatcttttgaaaagtgtctgttcatgtcctttgcccactttttaatggggctgtttggttttacttgttcatttgctttaagttccttatagatgctggatattagacctttgtcagatgcacagtttgcaaatattttctcccattctgtgagttgtttattctgctcttagttccttttgctgtaaagaagctctttagtttaattaggtcccatttgtaattttgtgtttgttgcagttgcttttggtgtcctcgtcatgaaatctttgcaagggcctatgtccagaatagtatttcctgggttttcttcaagggtttttatagttctaggttttacatttacgtctttaatccgtcttgagttgatttttgtatatggtgtaaggaagggtcccagttttattctttggcgtatggctagctggttgtctcagcaccatttattgaatagggagtcctttccccattgcttgtttttgccaacattgtcaaagatgagatggttgtaggtatgaagttttatttctaggctctgtattctgttctattggtctgtgtgtctgtttttgtaccagtaccatgatgttttggttactatagccttgtagtatagtttgaagtcatgtaatgtaaagtcctcagctttgttctttttgcttaggattgctttgactattcaggctcttttttggttccatatgaattttagaatagctttttctaattctgtaaagcatgttattggtagtttgataggtacaacattgaatctgtaaagctttgggcggtatgaccattgggcggtacgaccatactttgggcggtatgaccattataacaatatcagttcttcctatccatgagcatggaatgtttttccatttgttcgtgtcatctctgatttctttcagcagtgttttgtaattcttattgtagagatctttcacctccctggttagctatattcctgggtattttgtgtgtgtggctgttgtaaatgggattgcattcttgattcggcactcaactggatgttgttggtgtagagaaatgctactgatttttgtacattgattttgtaccctgaaactttgctgaagttgtttatcacaggagtccccatcttcctgggccgcagactggtattggtccatagtctgttaggaactgggccacacagcaggaggtgaatggcgggctagcccgcattaatgcctgagctcttcctcctgtcagatcagtggcagcattagattctcgtaggcatgtgaaccctattgtgaactgcgcatgtgagagatctagattgcacactccttatgagactctaatgcctgatgatctgagatgggacagtttcatcccaaaaccatcccccaccccatcccctgagtccgtggaaaaattgtcttccacgaaacctgtccctggtgccaaaatgattggggactgctcgtttatcagatctaggagcttttgggccaagactatggcgttttctgtgtataaaatcacatcatctacaaacacagaagtttgatctcttctcttcctatttggatgccttttatttctttgttttgcctgattgctctgcctaggacttccagcactaatgttgaatagatatggtaagagtgggcatcctggtcttgtttcagttcttcaggggagtgcttccagcctttgcccattcattcaatatgatattggctgtgggtttgtcatagatggctcttattattttgagttatgttccttcattacctagttttttgagggtttttaacatgaagtgaggttgaattttattggaagcttttttttttttcatctattgagataatcctgtagttttttttagttctgtttatgtgatgaatcacatttaattgattttcatatgttgaaccaaccttgcatcccaggggtgaagcctacttgtttgtggtggattagctttttgttgtgctgctgctggattcgttttgccagtattatgttgaggaattttgtatctatgttcatcagggatattggcctgaagttttctttttttgttgtttctgccaggtttgggactcagaatgattctggcctcatagaatgagttagagaggagtacctcctcctcaattttttggagtggttttagtaagagtgctaccagctcatctttgtacatctgttaaaattcaactgtgaagccatctggtcctgggcttttggtggttgataggctatctattactgattcaatttcagagctcattattggtctgttcagggattcgctttcttcctggctcagtcttgggaatgtgtatgtgtccaggaattcatccatatcttctagattttctagttcatgtgcatagagttgttcataatgttctatgatagttctatgtatttttctgtggggttggtggtaatgtcccctttgtcgttgctgattgtatttttttcgatcttctctctttttttaattagtctagctagtgatcagtcattcttatgtattctttcaaataaccaatttctggtttcatttatcttttgcatggtttttcatgtctcagttccatttagttcagctctgattttgggtatctcttgttttctgttagctttggggttgatttgctcttgtttttctagttactcaaggtgtgatgtcaggttattaatttgagatctttttaactttttgttgtagatgtttagcactataaactttcttcttaacactgccttagctgtgttcaagagattctagtgtgttgtatctttgtacttattagtttcaaagaatttcttgatttctgccttacccagaagtcattcaggagcaggttaatttccacgtaatcatatggttttgaacaatcttcttagtactgattctgtttttattgtgctgtggtcctagagtgtggttggtgtgatttcggtttttttttttttttaattagctatagaattgttttatagccaattgtgtggtttattttagagtatgtaccatgtgcagatgagaagcatttatattctgttgtttaataaaggccttttagtaataagccaaactctttgtgacctaaagaaatatgtacatcacttctcagccttttggctaagatcaagtgaagaaatatatacacatattagccgttgttaacacacgctgtcatttgctaaattttttgttgttgttgttttcgtttttgttttgagacagggtcttgctctgtcacccagagctggagtacagtggcgtgataacctccgcctcccagtttcaagcgattcttgtgcctcagcctcctgagtagctaggactacaggcacgtgccaccacgtccatctaatttttgaatttttagtaaagacagggtttcacaatgttggccaggctggtctcaaactcctgacttcaagtgatccacctggcccatttgctaaatttttatgctcttactacatggttgtaaaagtctccagaatcacagaaaatttgttcaagcaatatttttttcttctggatgtagcagggggagaatgcctgaaattctctttaaagaactagcttatgattattccaattatatttaacctatttatgcctagtgttccattattggaacgctaagcttgtgagagttatttatatcctactgcttaaggtcatcgccagtgtctgatttttccacaccaaaaaatttgcaacctccagcataaataggttaaagcctgctagaaataggacttattttcacaccaattcccagtccttcctaacgttttaggaccaactgcttttttttgagacggagtctcgctctgtggcccaggctggagtgcagtggcgcgatctcggctcacggcaagctccacctcccgggttcacaccattctcctgcctcagcctcccgagtagctgcgactacaggcgcccgccaccacgcccggctaattttttgtatttttagtagagacggtgtttcactgtgttagccgggatggtctcgatctcctgacttcgtgatccccccctgcccgcctccgcctcccaaagtgctgggattccaggcgtgagccaccgcgcccggccaactgcttgttacacattagtttcttcaacataaggaagcagccagtttggggttggttggctcttgtttttccagttcctcagggcgtgatgttaggttattaatttgagtaatttgagatcttttttttttttttgagacggagtctcgcgctgtcacctaggctggagtgcagtggcaggatctcggctcactgcatcttctgcttaccgggctcaagagattctcctgcctcagcctcccaagtagctgggattacagccacctgcctaatttttgtatttttagtagagacggggtttcaccatgttggccaggctcgtcttgaactcctgacctccagtgatccactcgccttggcctcccaaagtgctgggattacaggcgtgagcaaccgcgcccagctgaatttaagatcttcttaatcttactaatttgagcaaaccaacgccaaatttccatcagcagatgtctgtttaagttaaatgcagatttccttaaacatttgctgtgcctgtcaggtagcagacttacggagttaaagttttaccctaataagggtgaaactactgagttgacttctagtcacaggtgtgtatgcaactgtcaacacttaccttaaaatcttgcaaacattttttctatataaaatagcacccagtcgggcacagtggctgacattctttagttcacgagcaagaaggttgcattatcagccatttaacattcccatacactgagctccttccttgtattgaagagacaaatgcataaaaagcagttggtcctaaattgttaagaaggagtgagaatcggtgtgaaaataagtcctattcaagatactagctatttagaacgttgctaataggaaatttgttagataaggaaaattctttgtgttccagtgtgtggcccacagaaggtactcagaaaaaaatgtaaatttgttaatcaaacctggatagaaggattatgcagaactgctttattaataagaacttgtggccaggagcggtggatcacctgaggtcaggagttcgagaccagcctggccaacatggtaaaaccccgtctctactaaaaatacaaaaaagttagccgggcgtggtagcgggtacctgtaatcccagctactcagaaggctgaggcaggagaatcgcttgaacctgggaggcggaggttgcagtaagccgagattgtgccattggactccagcctgagccaaaagagcaaaactctgtcttagaaaaaaagaacttctaagacaatcagatgacacatgatgggcccaactaagatctcagtttgctttgtgccaggtggaggcaatagtaagagtgcttagtgctaactgaggtcctggcttagtactacaaggtactgtgtcgcatcactcttgacacatcgggtactgtcgtcatccacatttcacaaatgagtagaccaggactcagagaaaacttgcctaagtgcccccatttatgcaccggtagccagccttgctcaacagacttcactgccttcctggggactgttaacacgctatgaccatttgatttttttcccttttgtgctttcctaaagatgataatttggttttggccccattttgtgaaacactccagctttaacacttttagaaatgtgccacggcttcagggagaaccctttgactagaaagccgtgtagattataaatggatgtgaactagttagtaaacattaataactgcctagtggaaaattgatcccatcagtgtgcataaaaggtaaacttttatttagactttaatacacaggttgacagcatgttcattttgtgatgacaacccagttgtcttattaggtaagtgttattagcctcagtttacaaattgaaaaaccaaagcccctaacagctctgcagcttttccaaagtaaacagctggttccgcacagaaccatgcacgaggcctagctccacacactcatactgtcagacttctgaagcagagtctctccttttctgtacctgagtacccgagcaggttgtacgtgagcacacattggctagattactccaggatgttctgagaataggattttctagttcattaaactttcttgttacccgagtatcaaccagaaagttctttgtatttttaaaccttttaaaatgagcatggggccaggcgcggtggctcacgcctgtaatcacagtattttgggaggccgaggcgagcagatcacctgaggtcaggagttcaagaccagcctggcccacatagtgaaaccctgtctctactaaaaatacaaaaattacccaggcgtggtggtgcacacctataatcccagctacttgggaggctgaggcaggagaatcacttgaacctgggaggcagaggttgcagtgagccaagatcacaccactgcactccagcctgggcgacagagcaagagtccgtctcaaaaaaaaaaaaaaaaaaaaaaaaaaaaaaaaaaaaaaacatggggagcactcagctggccgtgagctggctgactggaaacaggcaccacataaatttaaaaattttttaaattaaaaaaaaaagggcatggattttattgcctgaagcagtgagtacagcacagccagtagacattgtctgttgttaaagtattggcccgtttccaccattccctgccctcacgcctctctatctgccctgaccaccttgctgttcctcacacattcggtttgccctactggactcctccctctcgaagctactcttctcccgggttgctacaaggcttccctttcagggatcactttcttagaaggcctgaccttcctacttaaaactgcagctttggtctggagtagtggctcacacctgtaatcccagcacttggggaggccaagatgggtggatcgcttgagctcaagagcttgaaaccagcctgggtaatatggcaaaaccttgtctctacaagaaatataaaaactagccaggtgtgatggcatgcacctgtggtcccagctcccagctactcaaaaggctgaggcaggagcatcacttgagcccaggaagtcgagtctacagtgaacaaagatcatgccacagcactgcagcccaggtgacagagtaataccctgtctcagaaaaataaaaataagggccaggcgcagtggctcacgcctgtaatcccaacactttgggaggcccaggtgggtggatcacttgaggtcgggagtttgagaccagcctggccaacatggtgaaaccccgtttttaccaaaaatacaaaaacatagccaggcatcgtggcgggcgtttgtaatcccagctactcaggaggctgaggcaggagaatcacttgaacctgggctgcagaggttgcagtgagccaagattgtgccactacactccagcctgggcgacagagtgagactcagtcactcacttaatcaatcaaccaataccaaaaaacgtgtagttcctctccttctatcccagccatctcctttctttgtgggacacagcttctcctaacagaacacagaatatactaatacatgttcattgtttattacctgtctccttccactgcattgttagctgtttgctccccaggcaggatctttgttttatacctagaacagtgctagaacaaagcggatgttcaataactgttcattgaacaaatgaatgatatgatagtgatatatgaagtagaaagcactacacaaaaataagttgatatggtatcattcttcataccttcaagctctgagactttttgcaagtctttaaaatcagaggtgttaaatgacatgttgaaaacaacttgattgtgtgagggaggaacaattttaattttgtgtgctattttttatagcacttgtattgtaaagaagtggatctcttttcaatagaaagtaaagtgtcttaggttatatctattagccagttcattattttaaagtaagcaagaaaagtctttcttttcaaaagtagaaaatagttccaaaaagatttttttccaggtagttagcctcagaaagactattttaagtgcagtttcaggtatgacaacttgaaggagaactggtgttaagtgaaactttatcctgtacctgggacagaagttctgggctgtggtttggcttctctggcttggcctagaactgatggaggtataacaacaggtcctgacacacacagtgctttgggggtgatgacaatgtaggcccatgggaatctacacacccagtgctaccaagcccctttccatcatttttctggttgtacctgtttttgtgataaggatagttgggaggccaggcaggagaggatgcagacactgggaagtcctgggattttaaaccctttagaggtcaactggagacatccatataagaaaatttcaaattttttttatttgtataaatttaaggtgtataagtgcagtttttttacatggatatattgcatagtggtgaagtctgggcttttagtataaccatcacacaaatagtgtacattatacccattaagtcattttttttttttttttttttgagatggagtctccctctgttgttgcccaggctgaagtgcagtgacgtgatctcggctcactgcaatttccgcccccaccaggttcaagcaattctcccgcctcaggcctcccaagtagctgggattacgggcacacaccaccacacctggctattttttttttttttttttttttttaaagtagagacggggtttcaccatgttagccaggatggtctcaacctcctgaccttgtgatccacccgcctcagcctcccaaagtgctgggattacaggcgtgagccactgcacctggcgccattaagtaatgtcttaacgctgttccccccgcccccaccgaccgcggcaactcttcgaagtccccagtgactattccacattcttacgtatgtgtatacgcattatttagctccaacttatgagaacatgcaggatttgattttctgtttgtaagttgtttcacctaagataatggcctacacattactgcatccatccccactgctgcaaaagacaggaatatatatattaattaattaattaattaattaattaattaatttttttgagacagagtcttgctctgttgcccaggctggagtgcagtagcacgatcttggctcactgcaacctctgcctcctgggttcaagctgtcctcctgcctcaacctcccaggtaactgggattacacccacgtaccaccacgcccagctaatttttgtgtttttagtagagacagggttttgccatgttggccaggctggtcttgaactcctgacctaaggttatcgcccattttgacctcccagagtgctgggattacaggcatgagccactgtgcccagccaattgtattcttttttgtggttaaatagtattccactgtatacatataccacatttttttaatccagacattcattgatggacacttaggttgattctgtatcttggatattgggagtagtgccatgataaacatagcagtgcaggtatctttttgatacaatgatttgttttcctttgggcgtatatgcagtcatgggattgctggatcgaatggtagttctattttgagttctttgataagtagttctattttgagtttttctagttcattttccatagaggttgtactaatttacattctcctcagctgtgtaagaacattttaaatgggttatgaccactgtgtttgtggttccagagtgtcccatgcttgcttctctcacagccctttccacacatgctattggcatcatttgcttatttgcctgatcccccaccccaactgagaccttatgcagaaccctgttttgttcattttgatacactagaatctagcctagaagttcaagggggtggatagacagggtgggtgagagaggtcattgcccaagtgtatataccagtgcattgactgaacttttcttttcccacagattggaaaccaacatatatatcagcctgtgggtaaaccaggtaaagaagaaaagaattgggcggaaagaagttagtttaatttgatgaaagcaggttttgaatgtatatagtgtcgtagctttggaataccctcatggttaatttttcctctacagaccacagcaagtacgatgtttaccacattcagctcattactagagtattgggaaaaagaatttgttggtataatgcatcagaaatacctccttagggttgcagtgagccgagatcacgccactgcactccagcctgggtgacagagcaacactcggtctcaaaaaaaaaaaaaaagaaagaaatgcctccttagaatgcaagattagtgtcttttgtaagaacagcagtaggcatttatttagcagtggtttctttctctttcctttttttttttttggatacagagtctcactctgtcacccaggctggagtgtagtggtgtgagctcactgcaacctccacctcccgggttcaagcaattctcctgcctcagcctcccgagtagctgggactatggtgcacaccaccatgcctggctaatttttttttcttttcttttcttttttttttttaattttactagagatggggtttcatcgtgttgcccaggctggtcttgaactcctgaggtcaggcatccgcccgcctcagcctcccaaagtgctagggattacaggcgtgagccactgtgctcagccttctttctcttttttttatttttttgagacggagttttgttcttgttgcctaggctagagtgcaatggcacgatctcaactcaccgcaacctccacctcctgggttcaagcgattctcctgcctcagcctcctgagtagctgggattacaggcatgtgccaccacacccggctaattttgtatttttagtagagatggggtttctccatgttggtcaggctgatctcgaattcctgacctcaggtgatctgcccgcttcagcctcccaaagtgctgagattataggcatgagccactgcccccagcctcttaatctttcttaacgcacatgacttaatgggaatcattctctctcaccagatcctgcagctccaccaaagaaaccgcctcgccctggagctcccggtcatctgggaagccttgccagcctcagcagccctgctgacagctacaacgagggtgtcaaggtgggcatctgagcctgtgcagcaccttctgcttgcaggatttgtggtgtcccctagttctcagttgatgtgttcatgtcatagagtggagttggtgctgaaaatagaacagtgcagagtggaactgcagtgagacccaggagtcaattggtctggttctgaacccctctgagagtcagggaaaagctttatgcaaacattttcttttccattttcctctcagtgtaatagattttaggaattcagtcagattctgattttctacatacatcttcctctgatcagacagaatgttttctttagaacaaagtgccaagattgtttctggttttaaaaattaattaaaccaggatgcttggggtaagtgaggactttttgtaggagtttataagtgtggcttcatggaagacttatttattttccatttaaagttagaattgggtttgtaaaagcaatgtatgctgagtagagccatcctcaaaccaaggggagtgtttgactcaggcacaaacaaccacaagcttctgagtttggcagtcagaagtcaggtgcagcctgccccgaggggtgccagctggaactgttggcgcctgtgactctcctgggtccccaccagccctcaccgagtgctggagccactagagcagcagccctcctccctgagagatctgacggaggaggctcttcttttctagcctgtgtcctgtaaggagatgggatctttttactttccacttaaaatgacaaattacctctcaaaatagacgctatttctcaattgtcatataccttttattcacattttaatatctctaaaattgggatggtgttttggtttaattggcagcatttttttttcttagtggttcattaaaaaatggtgcatcttgagctaggtgtggtggctcatgcctgtaatcccagcatttcgggaggccaagacgggcggatcacaaggtcaggagttcaagaccagcctggccaacatggtgaaaccccgtctctactaaaaatacaaagaaattagctgggcgtggtggtgcatgtctgcaatcccagctactcaggtggctgaggcaggagaatcacttgaacccaggaggtggaggttgcaatgagtcaagatcatgccattgcactccagcctgggcgacagagcaagattccgtctcgaggttaaaaaaaaaaaaaaggatgcatcttatagtggaagacatcttaaaatccgaaaaatgtcatatcaggttaagataaactttgctttaccaataaccaccatttattgactgtcatccctttaccaagttctgtggcagtcctttttcatgtattatcagttctcatgtgaacctcacaggactggtggtggtatcatttctcagttgaccaaggctcacagagattaagcagtttgttcaaggttacacagcctccacatagctgagctgtgcttggccgcaggcttggctgagcacatacttgactcaaaggcactcgcctccaaagctgaagcttcgttagatgtagatacattgttgtcttctcagagtcatcagaaagttagtccagggtaagaaaaaatgtcatctccaggcccagagggatagcctgcagcttagagggcacaggtttgccagtgttcattgaggaggtgaccagagggtgaatgggcagccactggcacaaactagcctgctctctgtggccaagcctgccctctgtggccatagtgaaagtaccaactgggctagggatgcctctgcccttagggttggtgcccagagttcatgccagtggcttttaagtgcctgggaatcaggaacttcctcagttcaccaggcctccaagccccaggatgcctcctgacagttctgttaaagacacactgagtcttctccaaggaaaattgaggaaggacacacccttcccaatattggcttctttcaataaatttctaaaaaggagccagacatggtggcgcacctctatgactatagtcccagctactcgggaggctgaggaaggaggatcacttcagcccagaagtttgaatctggcctgcgcaacatagtgagaccccatctctttaaaaaaagaaaaggggacagaatgagattaatgaattatttattttcataagccaaaagaacagactttcaaaatggcttgtattacaatgaaaaaccaactttacaggtagatcggtaccaccttagaattctgacatcattatgaaacatctttcacagctggaataacataatgaatacatacaattaggatagggtatgaagcaaattgaaatcttgaaaataatatgtgtacttaaaatatattaagtaaagattcccgccccccgcccccctgagacagagtctcactctgttgcccaggctggagtgcagtggtgcgatcttggctcactgcaagctccgcctcccgggttcacgccattctcctgcctcatcatcccaagtagctgggactacaggcacccgccaccaggcccatctaatttttttttttttttttttttttgggtatttttagtagagacggggtttcaccgtgttagccaggatggtcttgatctcctgaccttgtgatccgcccgcctcggcctcccaaagtgctgggattacaggcatgagccaccgcacccgacctaagtagatttttaaataacatgaaatatacacctctgtttcttcattgtctgcttggtagaggtcattgaatccatcctaaaagaacagtattgttctaatactgcaatgcagctaggcacagtggctcacgcctgtaattccaacactgagaggccaaggcaagtggattgcttgagaccaagagtaccagaccagcctggccaacatggcaaaaccctgtctctactaaaaatacaaacattagctgtgcatagtagtgtgaccctataattccagctgctcagggggctgaggcacaagaatcgctggaatccaggaggcggtggttgtggtgagctgagatcacactactgcactccagcctgggcgacagagcgagattctgcctaaaaaaaactaatactaaaatatttacttttatgtataactaaaataattcatccaaataacagccaaaatcagtctcaatttttcctaggtagcactgcattttggttcttaactgagtctttaagcatcaacctaagtggttggaattggctacatctatagagggtttatcaactgcctgccaaggagcttccaagttgtcaagctccagaaaatagaaaaccattaggatgtctttccaaacagctttcccttctggaatgtcactgtgaatggtccctagaagcattatgacagtgcccctctaccacaataattgggcaaagggtaaagtagaaaggaacagaagctttaaacaggtgacaacctccctagaattacagaattgtctatttcttcttgatgaaacaccctgtggccccctcctcaagaagccctgttgatgtagtttgaactggtacatcctatgaagttaaacagaagaccacactgtgactctcagtgcagaaaataaaatacaggaagtcatctcttggaaatggtgtggttatagtaggatagcgccctggcttgagctttagagaaaacacattaaataaaactgttcagtttcaagtagtagaacctaatcataagaatcagctcaaaaaaggggtttctgttctacttttgttttttgtttttaaaataagctcccaatgtgtgtgtgtgtgtgtgtgtgtgtgtgtgtgtgtgtgtgtgtgtgtgtgttgttgtttttttttttttttttttttttttttgagacacagtgtcgctctgtcacccaggctggagtacagtggcacaatctcagctcactgcaacctctgcctccgaggttcaaatgactctcctgcctcagcctcccgagtagctgggattacagggatgcactaccattaccctgctaatttttgtatttttagtagagacagggtttgaccatgttggccaggctgggcctaatatctttaaactcagccccaagtcaggaatctttatgatagcattatggctagatgatgaagtggatctcaaggatattgaggggccgggctcaggaattgaggctgctgcagtttctcctgaatctatgagaattcagatgggcacttttcagtaattaaaaccatatgtcctcctcctcctttctttttgaagagctctcattctgttgaccttgcactgctgctggattgttcctcgggctttgcatgttccctgcatttgttttgtaactgagcatggtgcatggcagacctctctatgcagtatgctggggcagtgagcaggtggcacagtagccacaccctggcaacagtgagtgagagctggtgggcaggcttggaaactagctcctttttgttctgctcatgtgtttttatgggggatttgtcttatgcctttattaatattgtttttcttttttccctttctctgataaattcctttaacttttcctcaccttccgttcgacaatagccatggagggtaagcacatcgtgtctttgtgtgtctgtccagctctctctatcacacccggctctctgcatgtaactttggactggaaagcaggaagcccaagtgggagggcacttcggcctgctttgtcacctctcatgactgacagatgccaaaagcagtgtttatatatgcaaaagaatgagacatgtacatctttgcagtaaatgaattattcttgtgcttttctatctcatacccagacttttggaacaaccaagaattaatctgttccagattacttaggcaaaagcacccaagggttcagaaatgggaacttatatttagactgagcactggcatcaggttcatgattaaactatatgtactacaagttggtcttttttaaaaagtgtatatatatatatatatatatatatatatatatatatataccattttatgctggtgtaattctaaccagttggaatttttaaatactgctgaagatttcccaaaggccctcatgttattccaccatcagtactcaagttatcttagtaacatttgttgatgtctcttctgtgcccaggccctaggtagacattgttacatctttggcctcatcttccctgatcacagttgcccgggtgagagagctgaggctttataagcgtaggcccaggtgctttccagcagtcagcacagagctggctgaaaccggggtcttgagcagagaggctcctagcgacaccactgctgctttgacttcagtcacgacctgcaaacagatgctatccccttaaagtgcattcatatgtcagctttttataattgtacaaagaacatgtttccattaggcggctgagggcagctaagctgagccataccgttttcactgcagaattcaaactaagtggaaatccttatagtcttcatgtagaatgtttgactctttagccaaataggtaattttgtctaaaattcagtaaattcccagatggattattatcttgtggtaaatgattttggggtgaggggacattgaatcaggtctctgaaagaatctggggtttttagtataatatgtatgattccatctcatttcctttaactgagctcaaagttagaaagaaaatactgcctaatttgtcacttggaggaattactttactgtcattctcaatctgaactatatcccgcacacacaagaaaatcaatgaccttctgcaatctgctttgatctcttgtaaagaccctctctagcttgattgtggtgatctcacgccatctgctggagagcagaaaaatgactggcttctgtgttgtcagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggtaaaatagagtcattttgtgtactggcaaaaatgttcttgtttcctgtaagctgtggtgccagttgatagatgtctctaggtccccccgccccaccaaagtcagaactgatgctttagaagctcttcacgaaagcaccatacagtgacaatgttagtgagaactgcagttattctgaattgccgttcctatcttgttttcttctgtcagtaaacactaggatgggagtgtcttgaagcagtacactcttttaataattaccactcacacataaagtctgcagtgaaagagaaagctgcaaaagtatgcttacagtatgatgccatttatgtaaacttgaaaaacatgcaaaataatcctgtgtaagacttagggagatgtggttacgttgttggagtgcaaagacaagtagaggaatgatcattatcaaattcagatcccgcacctgtaaggaggagccagctgaagaaaggtacattgggaggatttatctgtgttgtttttcttaagctaagggttgggtatgtgggtgttcattgaattttcttttaaaaagagtaaaaataaataaaaatatcatgccagtaaactaatgttttccaaattgtgttcagtggagtgggatcctagcaggcagtgacaggtgtcctgtgtaaaaggacactaggggctgagtgtggtggctcatgcccataatcccagaactttgggaggctgaggcaggcagatcacttgaggtcagaagttcaagaccagcttggccaacatggtgaaaccccatctctttaaaaaaaaaaaaaaagagagagagagagagaaagaaagaggacactaggtccaaggaaagtcagcaatggctccttttaaagagtacagactggcatgttggttgcacaggggtgtcctccagttcacagagtgtggtcgaaatttgctctaagccagtatttctgaaacatactcgaacatacttttttttcactatagtaaaatacacgtaacataaactaccatcttaaccatttttaagcatacatttcagaagcattaggtacattcacaatgttgtgccaccatcagcaccatccacttccataacccttcccttgcaaaactgaaactgtgcatttgaaacaaccctcctcttttcccctcccccagcccctggcaacctccatcctacttgctatctctatgaattgactaccctaggtaccgcttataagtggaatcatactgtatttgtctttttgtgatggatttatttcactcagcatagtatctcagagttcatccatgttgtagcatgtgtcagaattttcttcctttttagggcagagtgatattccactgtatgttcacaccacattttgtttatttactgaaccatcacagggtacttgggttgcttccacctttcagttatcatgaagaatgctgctaggaacatggatatacaaatatctttttgagaccctgctttcacttcttttgagtgtatactcagaattgctggatcactgataattctatttttaattttttgaggagccaccattctgtttttcacagcggctgcaccatcttacattccctccaacagcacacaagggttccagtttctccatattctcaccaaaacgtgttattttctggggggttattttgaagcttggggttttgtgtgtgtgttttaaaaaataattgtcatcctaatggatgtgaagtgtatctaagtgtgattttgatttgcatacaggtcttgaacatctgtttgctttttgagcgtttgtgtatcttttttggaaaaatgtcaagttttttttttcttttttggcctgttttttaaatcatactgtattttgttgttgagttatagaatcctacaattgttgttgttgggttttttgttttgttttgtttgagatggagtctcattctgtcacccaggctcccaggctggagtgcaatggcacgatcttggttcactgcaacccctgcctcccaggttcaagcaattctgctgcctcagcttcccgagtagctgggactacaggcatgcaccaccacacctggcttatttttgtatttttagtagagacggggtttcaccctgttggccaagctggtctcaaactcctgacctcaggtgatctgcctgcctcggcctcccaaagtcctgggattacaggcatgagccactgcgcctggcccctacaactgttttttagtatacctattagcaatctttgcaacagcttcttataaaccatcaatgtggaaaaagctgcttgaaagttgtaatgtttcatggaaagcacagttaatccattctggttcacttttttaaagtgtatccacataacagttttaaccaaagttcttaaggaggaacttgcatgaacccacagccaagtttaaacaactcaacagtaggtgaaaccattcagaattttgtacatactaagattttatatggtgattttatagacactatttttttaaccgttttactttggccaaatgacgttctttttgtatgttgatccaattataagtaactatcattttcttactggttttattcatattacatgtaatttgatgtcttagtcattacattatttggtcctcataagtatgacagtaatgaaaatttgaagtttaaaattatttgttttaaatcatagttagaccctttttgctgcaactcggaagtggcagggaggagtgtttctgctcagtgtgcctaatagatgaagcctgagattcagaacggggtccaaagcaaggctgcccccttgcatccggggcagtggtgtcatctctggccagcctcatgaggtgtttgaaagtacctgggtgagaacacatttggtgaacacacttggggaaaggtgctactatttatcctaacctgtgttggcagggttggcagttggagccaggagggtggtataatctgcttggaagcagtagatgagaaaaaaaaaaatcctgctttccaccctcagcatctgtgtgacttttcttacatgaacttctggtcttcaactcactccttagggtattagagcaatgaacagtcagatctaaatcttttgggagaaaaaggagcctcataacttacaagatagggctaagcactgagaaaaagaaatacagaaatttgccttgaaacttgtggaaaggaaataaaaaaatatataactgaaaagcataaaaatcctttgtgtgtgttctaatattggttgtgattcttgtctgttaggaagtcggcttggccctgaggacattattggccactgtggatgagaccattcccctcctaccagccagcacccaccgagaggtagggcacaatcttccccttgcagccctctgtgacagcactgggcagggacacattcagggatgcctgtggtgctgaaggccgctcctcagtctgtggccagcagagacatcaactgccctacaagcgatgaccttccctctaacactggccccaaccaggacggggctgttcattctagggcataggggtggtgtggagcagtggccactcaaattccagatcctgggtcttcctgctgctagtccactgcagagccactatgcaaggtcctcatctgagctacaagtggctctgagcagtggatgaggaaggcacatgggaaactgctgctggtgccatgaacctaaaaggtagaagaatgctgatatgaatggggcgggcattgtgcatggtctgcttcctcgaattctccttaaaaatagttgagcttgcaaatgatcctggttttccatttcaagtagtaatataaaaaatttcttttaggccaggcatggtagctcacgcccgtaatcccaacacattgggaggccaaggcaggaggatggcttgaggcctggatttcaagacaacatagtgagaccctatctctaccaaaaaattaataaataaaattattgtcttaaaaaattccaggccaggcgcagtggctcacgcctgtaatctgagcactttgggaggctgaggcggacagatcacgaggtcaagagatcgagaccatcctggccaacatgatgaaactccatctctactaaaaatacaaaaagtagctaggcatggtggcacgcgcctatagtcccagctacttgggaggctgagacaggagaatgacttgaacccgggaggtggaggttgcagtgagccgagatcgtgccattgcactccagcctgcaacagagtgagactccatctgaaaaaaaaaatcattttaaattaatgaatgtctttaagaagcttcttaagggctgagtgtggtggctcacctctgtaatcccaacactttgggcggccgagacaagaggatggcttaaagccagtttatgaccagcctgggcaacaaagcgagactctgtctctacaaaaaatttttaaaaattagctgtgtgcagtagctactcaggaggctgaagcaggatgatcgcttgagcccaggagtttcaggctacagtgagctaggatcaagccaccatactccatcctgggtgacagagcaaaccctgtttcaaaaaaaaaagttttaaggaataaaagttgacccaaaatactgtagcccagcaacaactatcatttttgctaccttttggcaattttgtttcaattatatgactaacaaatgaaaggaagcacctgcatttgttttagtgtctttgagcctagggtgtacattctgtggttgggattgacaaacgcatgtgggatgcgtccccactacagagtccaggatctgcaggcttcagccttgctccctgctgactccagctgcctgcttttctcatttctagggaagcatgggcagttcttcatcccagcacacactttttgtttgtcctttttattttgaaatcatttcagatttatatgaaagttaaaagattaatagagagaactcccaactttcctttgagtttcacagccttttaacatgtcagcacattgtcaccttgctccattgtctatgtgtgtacacacatcacttcctgctgtcgagcagcttgagaatggctgtgtatctcatgccctcttcccctttaagatttccatttatatttctcataacaaggccattgtcctacataaccaccacacaatcaccacattctggaactttaacatgatgtaatgcactgtcccactctgcagggcacgttccagggtcgtcggttgtctctgtagcacttttccgtcgcctgtgagagccagaccaggattacactttgcacgtggtgttgctttcttcagcctcctttcatctgaaacagctcctcagcctttttttatctttcatgacattgacatttttgacaaacataggctcagtgattttatagagtattcttaaagttggattgagggatatcctataaacatttgtttcttcctgatgagattgagattttgcatctccagtcaggaatacaacataaataatgctgaatccttctcagcatcatacccagagacatacgatgtccaggggatgttccagttgaccaactggacattgacttctgaaggacggttggacacaactcctgttggtgattcctttgtaagtggcattgattcatatgcataaaccctttaacttgtttttgagaaggcctgtgactggtgctgtagtgtaacttcacatcccaaccaaatggggttctctcacttacctgcttcaccgggcctctggctttccatgacaagcctcagttttgccccaaagtggagaagttccatatgctagaggcaagaaaatggtgtcctaccaagtggatattttagtgggactatttgtcaacacctactctagttgataaagtctaaagtaatcttttcatctcccctgattccaatacacaaattgctctcctgtatacagtattttttaattattaatttttttttttttgagacagggtctgtctctgtcacccaggctggaatgcagtgactccatcacagctcactataacctccaactcctgagctcaagtgatcttcctgcctccgcctcccaagtagctgggattacagttgtataccaccacgcccagctaattctttatttttttgtagagacagtgtcttactgtgttgcccaagctggtctcaaattcctgcttcaagccatcctcctacctcggtctcccaaagtgctggggttacaggcgtgagccaccacacctggccttaaatcatttttgaaaagaagaggagcctgtctttgatcctgcatctgcctttcactgtcctcatgcctcctcctgtccccattgtacttcctgaaagagcagcccatccctgatggggccacctcctcacatggcagctgcactcagcgccagctcagagcattccagtgctccagctgtttggaactctctctgctgtaacagcccttcaaggtctcctaattgccagagcccctgctttcccctcagtcctaactcccccttgagaccccctgctctggcccagagcttcctcactcactcctctcctgccaagacctctgctcaggcttttgttccctgccacccttgagtgtggtcatctcccaaagtgctacccacttgttttattaaaaaatactttttcactctggtagttcttctcattctcatagattcaagtatttgatgcctcccaaatctgtgttgattttatagaaccccgccctgagctctgatctccaactgtctgccattggcaagaacggtctgctttccttgtttgcttccacagtcagtgacaacaccatgcacttgcatgtctgttcccaatcccctacacacatgcaaacaaccacacaccttccatctctcatcaggtctcaggttggtccgttcacctgcacatccaccatcacctctcctctgaagatggcctcttagatggtttatctgcctcttgtctgttcccctgcccttccattcagcctccacattgccgccaagagccatctttctagaatatctctctagattttgtcattctccttcttaaaaatctcttatccctcttgccaagtcctgccaaataaagatcaactaggtgtggctttcacagttgaagccagcctacttttacagtataggccaaattcagacaaattctctctgtgaagtctttctgaccctctctgagacagaatgcattgctgtcttatctatgtacttttctactacgtgatttattccagtgtattatagggtcctgtgtatgcttttcccattgtagactgcgggtaaaaacaggtcttcctccttgtatccaagcaccaagtgtctcgtacataataggtgctccataattgataaaagagcaaatggataagtcaccactggttgaagaaacagataagaaggatcatgagactctcccatgcaaagcattcgaaccctgtaggacagcattttgtgttcattagctgcttccaccattgctgccctgacttaatgtgtgcggggggaggggcgtacataatggtctggctctgtcacccaggctggagtgcaatggcacgatcttggctcactacaacctctgtcttccaggctcaagccgtcctcccacgtcagcctcctgagtagcttggaatacaggtgcacaccaccatactcagctaactttttgtatttttttgtagagatggggtttcaccatgttgcccaggctggcctcaaacttttgagctcaagccgtcagcctgcctccgccgcccaaagtgctgaaattgtacaggagtgagccactgcgccctgccaccatccttaaaccattttttgtatagccaaggaaggtcttgaaatagagttggcatagtagaaagcataagaccagaagtcagaactgaggcttttgtcctggcttggagactaaagagctgtgtggccttcagcacatcttactgtatctcagttgtccactctaatgtgaaagtgtttggaatagatgatctctgaagttctgtcagattctgtggttctattatgaaacaaaagccctgccagtcactgagattaataaagtctaaacagcgcaaatggagacgaagttagtcatggtgtcagggaaggctttgaatggaaggaacaagatgctggatctgcatgtgtgaatcggcatgcacaaacaggcacactataatagctgaatttctaaagtaagtaaaaaaaatgtttaaatgcatgaatgtagtgtgggaagttaaaataagaaaaaaaaaatttaaagattgatttttacatcctattgctcctaaggaagatttatttacaggaaataaagttttcttctcatggaggcactgaaagaaaggctcataaaaattccctgaaaagttcattggtgcagggcttggtggcatgtgcctgtgttcccagctagtgggaaggctgaggcaggaagattccttgagcccaggagtttgaggcaagcttggacaacacagtaagaacatctctctaaaaaagaaaaaaaaaaatcactgaaaacagttctcctgacctatctcttgtctttcagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgt

SEQ ID NO: 36945 - DNA, 3882 bp, Homo sapiens
cggcgctccgcggcccgcaaggcgccctcttttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtagggccggccgcggcggcccgggctggggggggacgcccgcccgcacccgcggcccactcggcgccttgtctccgcaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggcaaggcgtggggcatggctggggggcgggatggggggtgtgggggacaacggggctcaaagggcccaataggggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattc

SEQ ID NO: 36946 - DNA, 98296 bp, Homo sapiens; identical to SEQ ID NO: 35980
